United States Patent 12,642,819 (COMPOSITIONS AND METHODS FOR TREATING INFLAMMATORY BOWEL DISEASE) - sequence listing, part 75

SEQ ID NO: 37 - DNA, 2185677 bp, Collinsella aerofaciens
  modified_base (178707)..(178806): a, c, t, g, unknown or other
  modified_base (234843)..(234852): a, c, t, g, unknown or other
  modified_base (281361)..(281405): a, c, t, g, unknown or other
  modified_base (411677)..(411686): a, c, t, g, unknown or other
  modified_base (626363)..(626372): a, c, t, g, unknown or other
  modified_base (700123)..(700131): a, c, t, g, unknown or other
  modified_base (726714)..(726737): a, c, t, g, unknown or other
  modified_base (793341)..(793350): a, c, t, g, unknown or other
  modified_base (794450)..(794459): a, c, t, g, unknown or other
  modified_base (802369)..(802394): a, c, t, g, unknown or other
  modified_base (809207)..(809238): a, c, t, g, unknown or other
  modified_base (836955)..(837005): a, c, t, g, unknown or other
  modified_base (951000)..(951009): a, c, t, g, unknown or other
  modified_base (952181)..(952272): a, c, t, g, unknown or other
  modified_base (966062)..(966071): a, c, t, g, unknown or other
  modified_base (969712)..(969758): a, c, t, g, unknown or other
  modified_base (1026600)..(1026609): a, c, t, g, unknown or other
  modified_base (1028992)..(1028999): a, c, t, g, unknown or other
  modified_base (1065436)..(1065444): a, c, t, g, unknown or other
  modified_base (1078460)..(1078473): a, c, t, g, unknown or other
  modified_base (1146809)..(1146908): a, c, t, g, unknown or other
  modified_base (1269883)..(1269929): a, c, t, g, unknown or other
  modified_base (1300007)..(1300016): a, c, t, g, unknown or other
  modified_base (1313589)..(1313598): a, c, t, g, unknown or other
  modified_base (1327076)..(1327084): a, c, t, g, unknown or other
  modified_base (1394905)..(1394914): a, c, t, g, unknown or other
  modified_base (1636762)..(1636769): a, c, t, g, unknown or other
  modified_base (1657649)..(1657658): a, c, t, g, unknown or other
  modified_base (1714079)..(1714109): a, c, t, g, unknown or other
  modified_base (1716995)..(1717004): a, c, t, g, unknown or other
  modified_base (1746120)..(1746193): a, c, t, g, unknown or other
  modified_base (1766440)..(1766469): a, c, t, g, unknown or other
  modified_base (1804606)..(1804615): a, c, t, g, unknown or other
  modified_base (1954671)..(1954768): a, c, t, g, unknown or other
  modified_base (2015997)..(2016006): a, c, t, g, unknown or other
  modified_base (2063233)..(2063242): a, c, t, g, unknown or other
  modified_base (2074506)..(2074515): a, c, t, g, unknown or other
  modified_base (2092442)..(2092541): a, c, t, g, unknown or other
agtcccttgcggcgtagttcttatttaagccgtccaggttttggggtgcagttcagagcgggagcgcttctggcgcaaacgctattcctgccagcagccttacgcctgctgatagtgcaggtgcttctcgtcgatatcggccaggtcgcggtcaaggtagcggcgtgcgagccagtttgccatggggaggttctggtccaggtagttaccgcactcctcaggagcagcaccggggacatcgccctcaaagctggcgacaaactcgaacagctcacgcacgagcggcagaatctcctcgctcgtcagctcaccaaaaacaaccaggtaaaagcctgtgcggcagcccatgggaccaaagtagacaatgcggctcgaccactcggcatgattgcgaaggaacgtggcacccaggtgctcgatggtgtggcactcggccgtgttcatgaccggctccttattgggcgtggtcaggcgcaggtcaaaggtggtgacggcggcgccggtcgccggatcgcggtcgatgcggctcacatacacgccgggctcgagcagcagatggtcaacggaaaaactcgcgatacgctccatggcagatcctctcggtagttaaattgggacggggctcttttagctggttcgaatggtcgcaccaatcataccagtcaaaaaagccccgtcccaaatgagctacccgggacggggatcaatgagttttaaatccccgtcccagaaaaatcattctaggtaatctagaaggacttttccgctctggggtctggcgccgttccgactagatctcgcgcacgctttggcgctcgacaaaataggtcgatacggccgtcttgcaggtatagctcttgggattgcggatgttgcccaccaggcggcgcaccgcgatctcgcccacctcgtgcttgggaacgtgcaccgtggtgagcggcggattggagaaggcgcccagagacagatcgtcaaagccgatgattgagacatcctcggggacacgtatgccgtgctcgttcagcgcgcgcatggcgcctacggcgagcacgtcgttttcggcaaagaaagccgtcggcaggtcgtcgcgcgagacgctgtcgagccatgcgcccatgtcgcgataagcaccttcgagcgtggtgcccagtgtgacgcgccatgtcgggttggcctcaagatccgcgtcctcaagcgcttggcgatagccgcgctcgcggtccttaaagttgcggatccgaaggtcgcccgccagatagccgatttgcctgtggcctttctcgataaggtagtccacggcacgcagcaccgaatcggtgttggcgatgactacggcatcgaagtactggcgatcgctccagccgtcgagcacaatcaggtgggcggcagcgtcggcgaacagggcgtagtcctcctcgcccagctcggtacccatcagcacgatggcggccgacgggtcggcgatcaggccctcgacctgcgggcgcacggcgtccaggtcgctaaagtcgagcgagacaaagctcgtgctcatgccgtggcgacgcgcctggcgctccacgccctcgatgaccgcgggatggaaggtgctctcgtccaggatggcgcccgtcttgcgcgcaagcacaaactggatgctctcgagctgcgtcgactgctgatagccaagcgactgcgcgcactccaggatgaccttggcggtctcctcgctcacgctgcgcttgcggttgagcgcgttggacacggttgcgggcgaaaagccggtaatgcggctgatctcgcggacgcttgctttagccatcgttccccctagcatcggtcgcggccgagcatcgtggcttgaccgccccgtggctcggcaactaaacgaccgcaaattcaatctaaacagaatagtaaatgtttaatagctagtttagcctgttgtcaggcgaagtggcacgactattcccccaacgggcgcatttgtccatcttaacgttattacgcaaggtcttcgccattgcttgctattacgcgtcggtaccattcgaagcttttctttttacgtctctcaaacgagcccgcaccgctatcgtctcgatcgacatagataaacccgtagcgcttacgcatctgtcctgtggcgaccgaaaccaaatcgatcgggccccaacaggtatatcccatgagttccaccccgtcgagctcgacggtctccctcatcgcctcgatgtgggcccgcaggtattcaactcgatagtcgtcttctatttcacccgaatcttccggcacatcaggagcacccaaaccgttttcgacgatgaacagcggcttttgatagcgatcccagatttcattcatggtgacgcgcagccctttggggtcgataaacctcccccaaggctcctgttttagatacggattaggcgccgagcgaagaaggttcgaatcgaactgaccttccgcatgcgcttttgcgacgcgcgtcgagtaatacgaaaacgagacgaaatcgaccaggtttgcagccagtacttcgcggtcatcatcccgatagggcacctcaaaaccatggcgggcgtattccttgagaacatggctcgggtacgcaccgcgcacctggacgtcggtaaacatgtaatggctgcgattctcagcctgcgcagccagcacatcgtccggatcacatgtagccggatagaagacacctgcgttgagcatgcaaccgatcttcgccccggggcacagttcatgacacgccccgaccgcacgggcactcgcaaccaatacatggtgcacggccgtgtgaaccgttgcatagcgattctccccttgctcgaagatgatccccgccgccataaagcacgcctgcgtcatgatgttgatctcgttaaaggtcagccaataattgaccaatccccgatagcgctcgaacacggtacgcgaatatcgatcgaacaggtcgaccaacctgcgatcgcgccatccgccatacgcatcgacgagatgcatggggacatcatagtggttgagcgtcaccaaaggctcaatgccatgcgcgcggcacgtcctaaaaacatcctcgtaaaaggcaaggccttcttcattgggctcggcttcgtctcctttgggaaaaatgcggctccaggcgatcgataagcgcaggcatttaaaacccatctgggcaaacagttcaatatcctgcttgtacctatggtaaaaatcaatgcctttgcgagcgggatagaagctgtcgggtgccaacgcacgcggatcaaggtctccccgcatgacgtccatgcgctgatcgccaaacggcagcatgtcggaattggctaaaccgcgaccgccttcgttccatcctccctcgcactggtttgcagccagagccccgccccataaaaaatcttctctaaacattatggtgtcgtcctttctatcaaattcccggcccacgctgtcgaacgcaacggactcggcaagtgccgcgcaacagcacagtaccgttgcgcggccaaggggtcggaccgcgcaacggctggggagcatatttgtgcagtagcctcttatgcctcgacggattcaacagcctcagaatcgccgctcttggacttcaacggcatcttctcctgtccttcaaatccaaaaaccatcgccaacgcaaacgtcacggcaccgccagcaagacacccgatggtgccggggatgatatcctgagcaaacatgagcacgttcatccatgggaaaccaacgccagtgaagatatagacgttggcatgaagaaggcttaccagcagaccaccgacagcaccaccaatcatgttccaggcaagagctttcttgtcgcgaaacaggatgccgtagatgatgggctcactcacgcgaccgaaggcataggtgatgaacaagttccagcccgtggctcgattctccttgtccttagcgcgcaggccataggcgagcgcgatggcaagcgtggtgtaggctacaaccgcggcgccggggtataagatggcgtcgtaaccgttctggagcgcggcgggcaatatggcggtatagatcggcacgtgcatgccggtggcgatgatcagattccagaatgcgccgataaccgcggtcgcagcgggaccggcaacagaggcgagccaaatgatgaaatcggccacaaggcccatgacaaattggacggcagggccgcagaggcacagcgcgaccggcaacatcacgagcaccgtacccacgggtacgatcagaacgcgcaacatatcaggcgagatcttcttaaagaagcgctcaacataggactgggcccaggtgatcaagatgaccggaagaacagcctgggtgtagttgacgagctgcatggggatgccgaagacgctgaaaggctttccgtcctcaacaatagcgagcatgtcggggtaaatcatcacaacggcgatgagcagtgccagcacagggctcgttttgaacttcttagccgaactgtaggcagcaaataccgggaagtaatagtacgccgcatcgcccaccagggaaaggatccgatacaggtcgctcgtttcggacataaaaccggcgccttcgggcccaaacagaataacgagcatcttgaagataccggcgacacaaaagatcggaaggatcggggtgatagcgccgctcacggcatcgagcagctgattgaagaggtgcttgggcgccaagcgctccttccagctaagctgagggccatcgagttcctcgtcaatcgataccgtgacctcgaatccgccctgcttacaaacctcgtcgtagaccttgtcgaccgtgggcccgatcaccagctgcacctgccctccggcgtgcacgacgctgatgatagacgagatgtcctcaagcttctcatcattcgagaggctttcatccttgaggctgaagcgcaggcgcgtcatgcaatgcgtaaccgaagccacgttttccgccccgcccacagtggagagaatctgctctgccacctttttgtaatttgccatcattggctcctttgcacaatcttggcttactgttcgaatcggcaaaggtcatgccccgaatggctacgggttacaatccttttttggagatgatccggttgagatggatcatcagatagagttcctcctcctcggagagcgtggcgtcccacgtttcacgacaataggaaccgatatgcttcacgcactctgccaactgcggaaactcctcacgaaagttcttgtacatctgcatgttggcgctgttcagcgactcgccggcttgaatgcgcttgaacaggtaccgcagatgcgtggcgaagcgggtgaaatcaaaggaatcgcggtcgacaataatgcggaaatcgctttcgagaatctcgataacgtcctcgagcatatcgtcgaactgctttgtgggctcggccgtggctttgacggcttcaacaacccgtgcgttcacgagattcatcgcaatactggcaatctcatccttgggaagccgctctccgagctccttctcgagtcgcatgacgataaactgggcagccttgtattccttcggatacgtctcccgcacttcataggcaagaggcatcgcgatgcggacccccttttgggctcgcgcaacggcaaacgacaggtgatcagccatgaacagcgtcgcattggtcgagaggtcgtagggcagttcgttggcaacgatgcccataactttcgccgcaaacatcacgatatccgagggaagatccctcatgacatcttgtcctttaggatcaatgtcgtaaaacgtatgctcgattttagaaagagggagctctcgaggaaaatctccgccgaaaccgacgcccctgcccatggcgatgacatctcgcccctgtccgtcacggcaaagaaccgcgttgttgttaagctttttaattgcaagcatggtgaacctcctttcaagaacactcacagaaaaaggcatgatagccaatagcagtgctattgcggtcatgccttacgtaacaatccgtgttgtattgctcttgggcatgcctccacacaggagtaacaatccaagatgcaaaatgcattatagcgctctccccgccccggggaccatcgggctggcgaacggtagatgtcggcccgccagcggccacatcgagcagatgggcgtgcttcgatcccgagcctagcctaggacacgggccatacgcgtcttgaactcggacaggaagcgcggagcatccacggtcagtgccacaagcgcgctcttgtccggatcggacaggcgacgctcatcgcagatggtgcgaccgcggtactcgcccagcagatcaacacgcaggttgcagccgagcgcacctacgagcgtggggtcgatcgccacggcaacggccagcggatcgtgcagcgcgcaaccacccaggtagggtgcgttcatctcgtacgagccaatgtagtgctcgaccatgctcgcaaatgcgcagcccgccatggtgcccgagcccgtccagccggcaatgtcgcggcgtgtgagcaccacgcgatgcgtcacgtccagacccaccatggtgagcttacggcccgagcgcagcaccgcgtcggctgcctcggggtcgctcgccatattggcctcggcgcccgcgctcacgttgccgggcacggtaagggcgccgcccatcacgaccacgcggccgatggacatcatcgccgccgcatcgcgctccagggcgagcgccaggttggagagcgggccagtcgctacgtagaccagatcgggaccataggtgcgcgcggcatcgatcagataatcgaccgcagcgttgccgtcggccgaggtcgcccccaccggctcgtagggcgacgcgggcacgctcgcgccgccgatgccgttcttgccgtgaatgagcgcggtggacgccggcggcgtatagggctcagtcgcttgcagaggacggtcggcacccaggtacaccggaacctcggggcgacccagcagatcgagcaccgccaggcaattgtgcgccgattgctcgacgcgcacgttaccaaagcacgtggtgatgcccacgagctccacctcggggctcgcgatggcataggccagcgccatcgcatcgtcaacacccatatccagatcaaggatcagcttcttgattgccattgttctactccgcttctccgtctttatcgtttaaccaaaccaatgttcaacttcggcgcgcgtgggaatcgattgctgagcgcccaggcgcgacaccgtcactgccgaggcgcgagcacccgcggccatgcactcaaagagcggcaagccctctaggcgagccgccgccaacgcgccgataaacgtatcgccggcggccgtggtatcgactaccgtactcgaaagtgccggcatgcgcagcagctcaccgccatcgccgagcgtaaccgagccggcaccgcccaacgtgatgaccgcagctccggcacccttgtcgagcagcgcattgagcgcggtgacgcaactcgcgtcatccgtgggcagaatgcccgtcagcacctggcactcggtctcgttggggcagaccaagtcgaccgcaggccagacctccgcaggcagctcgcaggcgggcgctggattaaagaccgtatagaaccccagctcgtgagcgcaaacaagcgcctcggccgtcgctgcaaggtcacattcgccctgggcgataaagacgcttccggcagccggggcaatctcgctggcgtcgccgtcgagctcatgagccaccagacgcctcagcgcgcaggcaacgtccgcgcccgcaagcgcatggttggcgcccggtgacagtacgatgcggttgtcgccctcgcagcgaacgatggtcgccgttcccgtctccacgtcatcgcgatgcactacaaagtcacagtccacgccggcgtcttggagccccaccacgagcgacgcgccgaacgcgtcgcgaccgaccgcgccgatcatgtgcgtgcacgcgcccatacgcgcggcagctacggcctgattggcgcccttgccgccggcgttggtgataaacccgctgccgccgacggtctcgcccgcgcgcggtatgcgctcgcacgccaccgaaaggtccatgttcatgctgccgaacaccgcaacgatgccgcgatctgccatggaaacctcctcatctgcgggctttgcacccaccgtcgaccgtcgattgcgcgccttcgcacctctataactttagttcactttgatgtgaacgcacccttgaggttgcgccagcagcaagcattcacaggagcaggcagctacaatgaatacgtgctgattattctcgtcattggatgatgttttatggaacaattctcgcaatcgggctcgcgcggtcgacgccgcacgggcaacgagccggcgccgcacgaacgcgtgaagagcgaacgccgtgccaacgagccgcgacgcaccacgagcccccatcgcgcttctgccaacaacgcgggccgcgccaacactcccgccgcggagcagatgcctgctcgccccaagtcccgctacatccctgcccttgacggcctgcgcacgcttgccgtcgtcgcggtggtgctctatcacctcaacctcacgtgggcgcagggcggtctgctcggcgtcacgatcttctttgtgctttcgggctatctgatcacacgcctgctactcaacgaagtcgctaagaccggccgtatcgacctcaagagcttctggatccgccgcatccgtcgcctggtccccgccgtggtgaccgtcgtggtggtgacctgtgcgctgtgcaccgtcttcaaccacgtgatgctcaccaagatgcgccccgatatcctgccgtcgctgctgttcttcaacaactggtggcagattgcccaaaacgtctcgtacttcaacgccctgggcgatccctcgccgcttacgcacttttggtcgctcgccatcgaggaacagttctacctggtttggcccccgctgctgctcgctatggtatccatgcacatgagcaagcccaacacgcgccgcgtggttctgggccttgccgcggtatctgcccttgccatgatggtgctttacaaccctgccgccgaccccagccgcgtgtactacggcaccgacacccgcgtgttctcgctgctgctgggtgcctggatggcctttatccccgatcgcgacctggcgccggtgcgtctcgctcgtcgtttggggctcaatcgcctggccggcgccgccaagcacggcaagaacgccgagggcaagcctggcgagaaggccgacgaatcagccgagaccggcccggcacagccgagcgccctcgtgcgcttttggtcctcgcccgcatccatcgatgtgttgggcctcgtgggtctggttggccttgccgccatggtcgcgctcaccaacggctacaccgcgttccagtatcgcggaggcacgctgctgtgctcgatcctcacactcatggtcatcgcggcctgcgtgcagccccagggaatagttgcccgcgcgctgtccgccgagccgctcgtatgggttggcaagcgctcgtacagcatctacctgtggcactatcccctgctgttgctcatgaacccggtcgccaacatcaacgatacaccgtggtggcagtacattttgcaggtgctgttggtggtcgccgtggccgaatgctcatatcgctttatcgagacgccgtttaggaagggcggctttgggcgcaccgttgccgaattccgcgatggcaccaccacgcccgccaactgggcacgcacgcacgtccccgtctgcgcagcctgcgctgtcgtattggtcgttgcactgggcggcctgatctttgtgcccgagacgtctgcgctgagcggcgagggcgccgaagtcctcaacaaggaagccaagaacaccgcgcccaccgaccagcaggcggccgacgacaccgacaaggacaacgacggcttccccgatggctcctacgatctgcttatgatcggcgactccgtgtcgctgcgtgccgtagacacctttgacggtgtgttctcgcacagccatatcgatgccgaaaagggccgccagtttgatgcgggccgcgcgacatttgagggctatatccagcagaaccttgccggcaagatcgtggtctttgcactgggcaccaacggcttggtaaccgacgaccagatcgacgccatcatggacgatgcaggagataagcgtattgtggtgtttgtgaacacgcgcagcccgcagccgtgggttggctctaccaaccaggccatcgctaacgccgctacgcgctacaagaacgtgcgcgttatcgactggtacggatacagcgccaaccgcaacgacctgttcgatggcgatggcacgcacctatcgaccactggcgtgactgagtacctcaacttgatccacgatgccgtcaagaaggacctgcccgtgcatcccgaggatcacgtcaacgatccgcagccggcagccgtcaagtctgccaccgacgcactcgtcaatgcgcttgccttcaagccgcacaagctgggcaccgacaaatagcccgcagcaaacaacccaaaatcactcttttcgagccggccccaagaggtcgcgggcaaaaaacaggccgcagtccatcgctgcggcctgttcggaagcaaaagtgggcgttaagcgctgtagcccatcgcttgcaggacaaacatgacgaccgtgagcgccgtaatcacgccgatagtcgcccaagtgagcacgttccacacgcggccgttgcggttggcgcccataatgtgacgctcggcggcgataaccacctggaacaccagaaccacgggcagtagcacgccattgatgacctgcgaggtcatcataatctggaacagatcgacgccgggcataagcaccagcacggcagagataccgatgatggccgtaatgatgccgcgatagaccggggcctcgtcccagctgcggtcggcaccgcgctcccagccaaatgcctcgcagatagcgctcgacgtaacgcccggcagcacgcaggcagccaagaagctcgccgcgaccaggcccgaggcaaacagtaccgtggaccactgacccgcaataggctccagcgcgcgggcagcatcggcagcatcgctaatctgaatgcccgccgggaacaacaccgtaccggtcgtgatgataataaagccggcaatgacatcggcagcaagcgagccgctcacggtatcgatgcgctgcagcacgatatcgtcctcgcccgcgttcttatcgaccacgttgttctgcgccaagaaaatcatccacggcgcgatggtggtaccgatcgtcgcgaccacgagcgacacgtagctggggtcattttgaatgttaggcacgaccaggtcgaccgcgacctcaccccagttggggccagccataaacgcggcgacaatataggtcacgaacacgcagctcaccagcagcagaatcttctcgatgcgctggaaactacccgacatggtaagcatccacaccagcagcgccaccaacggcaccgaaatgctcgccggcacgccaaagagagcaaggccgctggcgatgcccgcaaactccgaaatggtaacagccgtgttggcgatcaacagcgccgccatagcaagtacactcttgcgcacgccaaagcgctcacgaatgagcgatgccaggcccttgcccgtgacgcagccgcagcgtgccgcggtctcctgcgtcacgatgagcagcacagtcatgacgggaagcatccagagcatcttgtagccatagctggcgcccgcgctggaatacgttgcaatgccgccggcgtcattgcccgaaagcgccgccagcagaccgggacccatagcgccaaagatggccgcgatggtcaacttttgcttggtgcccgacttttgcttggtattttgcacgcgaccacctaacccatgaccgacatggtgagcagcaccgcagcggcgcagtacgctacgcacgagatcatgacggcaataacgttcatggcggtgcccgacgtgttgaggtcatgctcgtcacgccagaacagcaccatcaggtaaatcacggcgctcatgttgccaaccaggcaaatgatggcagcgatattaaagcacccggtaaagagttgctcctcaaacatgggcgcatcggggaacgcggcagtgcgcaccagctgcgcgcacaggtaagtaacaagcgaaaggatcaggcccatacccgtgctctggaagaagaatcccaggtacggtttgggctcgtcgtcgtgaccgtcgtactcgaggaagtagttcttgacgaacgacaccatgcgcgaggccgccagcagcacgagcggcatggcgcacatggggaacaccaccagatgcgcggagcccagcgccgtccccagcaccgtcgccataatgcacgaggcgatgccccacacgacgacccagtactgacgatgcacgaaccagctgagcacgttcgtcgagtcgtccgacgcgctatcgcccgagccgacaccggcgatctgcaggtcctcctgatgctcctcggcgataacgtccatggcgtcgtcgaaggtcacgatacccaggatatgacggttctcgtcgcagacagggatggcaaccaggtcgtacttggtcatctcgtccgtcacgtcttcctggtcctcgtcgggcgacacatagaccaggtcgcgataggccagctgacccagcgtggcgtcgcggtcggctacgatcagcgtgcgcagcgaaagcacgccggtcagcatgccgctcggatcctcggtatagacgtagtagacgctctcgaagtcctcatcgagtttgcgaatcgcctcgatggcatcgccgaccgtcgccgtggcgggcagcgagacaaactccgaggtcatgatgcggccggcggtgttgtcctcatagcccagcaggttacgaatcgccttctcctccttgacgcccatcaggcgcaggagcttctcggccttctcgtaatcgagctcgtcgatcaggtcggcggcgtcgtccgggtccatcatggccagcatcgacgatgcgtccgtgtcggacagaccctcgagcatctcggtcataagctcgtcgtcatcgaactccgagatggcctcggcggcctgggcagtatcgagctgtgcaaacacctgcgcacgcaggcgcgggtcgagctgctcgataatgtcggcgatgtcggcagggtgcagctcgccgagcgtcttgtgcgacaccgagagttgaatgttcttggtcgagcggtcgagcaggtccatgtaggaccaagcgatgatgtcctcactgagtggcttgcccaggtgcttcataaagccttcgacgatatgctcgagcgcggggctgatggcgcgtagcagaccgcgagcaccgacctcggcgcccagcaggcgcagctggttttcgcccgacatggaaaacttgatgtcgtttacgcgcacgaccttcatgccctgcgtgtcgacaatctgcttgttgagcacgtcgcgggcaagcaagagttcggtcggctgcaggtacgaaaaacggatttcggtggccgacgtcttaaggtgtacacccgtctcgtcgatacggtcgacccatttgcgccagctgatcataaacggcgtcttgccgggtccgcggaacgcgagcgacgtcacgtgcggaaaaacttcgccggtagcaatgccaaaatcgttgaccacgccgagcttttcgccatcgacgtccaagaccggcaatttgagcatctcactcagataattcaatggtgctccccatcattattcctccgaacgcggccgcatgtgcgacgtccgggggcttctggatatgtatacgcatgcgcgggctgcacgccgctcgacgcttacaccccgtgcatgcgcaaaaagcacctgcatggggtcatcgactgtatggtcgaggtttggatttcacctgtaacctttctcttgaccctcattaaccgcagtaactatagcatcagcatcgccctgcggcatcgaatttatgcgctgcacattgcaggcataccaaacgctgacgtatccgtgacatagccattggggacgttcttaaatgactacccaataactactctgtggtgtcattgtcctcggcaagttgggggagcacagcgtccttgggcatggtggccttcgtcagcgaggtgagctttttgctcagcgacgtgtccgtcttgaccaggtcgctgagcgtcacgatcttgtagccgtcggcgatgaggccgtcgataatctgcggcagcgcctcgagcgtctgctcggcgcattcgtctctatcggtgagcagcacgatattgcccggcgtcaccgaatcgagcaccgtcgagacctgctcgtcggcaccgttgagtagccagtcgcccgagtcgatattccacgagaccacggcggagaccaggtccatcgcatcaatccagttttgctcgtcaaaggcagcgtagggagcacgcagtagcatcgtcttcacgccggtcgccgacttaatcgcatcggtgcctttcgtgatctgttcgcgtaccgcctcacggtcctgacccttgagcgaatcgtcgctgtagctgttggatccgatctcgcacccggcatcgacaatcgccttggccgtggcaggcgaggcctcgaccgcatcgcccgaaaggaagaacgtcgcggtgacgcccttttccttgagcacctgcaagatctgtttggtggcgccgctcggaccctcgtcaaacgtcagcgccacgtactttttgttgcccttgggcgccacgctggcgcacgcaacaacgcaatcggtggcgggcacaacctcgccgcgatcctgcgtcttgcccgactgctcaccaacccacacctcggagcggccctggacaccccacgtctgcacatactcgatagcgcccgtgccctcgaccttgagcttgggctcgataaccgtagcctgaacctcgtgtttctcgtaggtgttacggccattcttgaccgtcaccttctcgccaccctcgagttcgcggctatcccatttgccctgcttcacgcgcttgccgtcgaccttcaccgacagcttttcgcctccatggcgcttgagcacactgtcatcgacggccagcaggtcgcctgcgtcgtaggtgtcagtcaaatcctgttcgtcgatgagattctgcagcgtagagcccacgcgcaccgcggtcttctggccgttgagctccacgtccacgctgcggttgacgtagcccacgacggcagcgataaacagcacgagcgcgcaacccacggcgatgagcgcatagggcaggcgagacgaacgacggggtgtgcggctgttgccgatgcgagcgctgcgatcgctaaagccgcggctatggttgagatacatcgcgccgggcttacggtgacgcttgcgctgaccgctaggcagctgccccaggtcgcggcgcgccgtcggacgcgcacccgaacgcccgtttaagttggatccgttttggcgcatgtgccctcccccataaacacagcaagccggagcaacaggtctccggcttgcctcccatcatttggtacgtcgctattttgtagcttttgacgagcctccgctcgccttttggtattcgtccttaaaggccttgaacatgccgcgcgtcttgccgagctgcttgcccagtgcgcgactgcccttgtccacggcaaccgatcccttgtcgtcgagcaccttggcgccctttttgaccttgtcgcccaccacgacgctggcctcggcggccttggcagccgcaccgcccgaatacccgagcgacttgacctcgtccgagacgaccatcgcgccgttctcgtagccgcgcagcatcgtcggcggcacctgcgtgtcaccaaccaaaacactcgaagcagcaccggcggtcacatagaatgcctgcacgatgcccgagcgtggcttgaactcaacatccgagcaatagcccacgacgtcgcccgattccgtgcgcacgtccataccgacccagatgatgcaatcgtccaggttgatgtcgaggcgcttggcggcggcggcatcgtacgtgtccttgacgtcatcaaccgcaatggcgccctcgtagacaccaatggcgtcgagcgccacgaatcggtcgggacgctcgatcatgcccgcgatatcggactggcggaccataaagccgaccacgcgcgtaccgcccggggtaaagaccggaaagtgaatctttccgagctttttagggctgcgcggcgtgccgtcctttttggtgcgcttgtcctcggtaggcttgcgatagatcttggcgccgacaaaatccccagcgcgcattatgcctcggtcgagggctccgcagcctcggtatcagcctcgacggcgttctcgaccacgacgtcggcggcaggcgtcacgttgccgcccgaaatggcgtcgttgagctgctcgcgcagctggtccatgcgctcgcgggccaggtcgaccttggcgcgcaggtcgtcggtcttggcgtcgaccatcgggccaaagtcattcaccgcagcacgggcctcctcggcgccgtgctcgtaggtgtcgcgcatattgtcccaggcgtcgttggcgatatcggcagccatggcgcgggtctcggcgcccgagcgcggggccagagcaacgccgataatagcgccggcagcggcaccaaaaagtgcgccggagacaaagctgaaagtcttacccatgatcattcctctcctgcgggcacgtcggtgcccaccgtttgaatgctgtccattatacccgcagcgcatcacttgccgctccgctcatctgcgtacggcaaaagcgcaggtacgtgatggtgataaacgagtaggcctactcctgaggcatagccggcatggccactgtggcacccgggtcctcgccggcgccgtccacgagcagcaggccgccctcatgcgcaggtcctgccggaaccgtcgccgcgccgccaaagacagccgcggaagcctcgtggttctcggcaaccgcgccctcggtatcgatcgccacctggggctcgtcgtcaaagttggggacgccctggggctcggtgggaacgggctcggcggtcacatcggcagcgggctcggggtcgaccggcacatcgccctcgtcagcgccctcgtcctcggcagcatcttcgccgttcgcagcggcgacggcctcgtgaggatccttgccctcggcctcggcgcgcatgcccagcaccaggttgcgcaggcccgcgaccgtgccttccacgtcgggggtaggctggtcggcgtgcagataggcccaatccatcataaaggtggccgaagacagcgcgccgatggccagtgcgtcgtcggggcacgaaagctcaacctcaaagacacgctcatcgtgttcgcttacgcgggtgcggccgcacgagatgctaccggcaagaccggtctcgttcatgagctcaaccgtcacgtgctccaacaggtggcagagctcggtctggcccatgcagtcttggaactcgcggccggaatcgcccaggcacaggtgcttggcaatcgcgggcaccaggtagtacacgcgcgccgtggcctcgatgtcctccgaggtcatgagcggcatgccggggttcaccagcacatgcgcgcagatcttgtcctcactgacggtgaccttaaggatgttgaacaggcctgccataactctcccctactcttccttgtcctactcgtcgccgtcgtgcggattcgcggaacccgcacccgacgtcgtcggctcgtctaccgaagactcggaatccttcttatcggtttcggccggagcgatcacgcgaatgagcgagatgcgctggccacgcatcgactgcactttaaacttgtaccccgcgacctcaaacacctctccgatgtcgggcaccgagtcgcaaagctccaaaatccagccggcgatggtctcataatcatcgctttcctcgagcggccaaccaagctcaatcgcgtcatcgcacgaaaaacgcccatcaacgagccactcgcggcgcgaaaggcgcgtgagatacttgttgtcggggtcgaactcgtcctcgatctcgccgacgatctcctcgacgatatcctcgatggtgataatgccggccgtgccgccgtactcgtccacgaccaccacgatctggtcgtgcgaggtctgcatctcggacagtagcggcaggatgtccttggtgtcgggcacaaaggtggcgtcgcgcaaaaagccggcgatgggctggtcacccttgccgtcgagcgcgggttggatcaggtccttgatgtgcgcaatgccggcgacgttgtcgggatcctcgtgatagacggggatgcggctgaagccggtctggcgcatggtggacagcacgtcggcgaccgtctcgtcgtcctcgcacatggtggtgtccacgcgcggcaccatgacctcgcgggcaacggtgtcgcccaggtcgaagatctcgtggatcatgcgcttttcctcgtcgagcaggtcgtcctgctccgagaccatgtacttgatctcttcttccgagacgttctgacggtcgtcggcactcttgatgcgcaggatgcgggccaggccatcggagcaagcgccggtcagccacacgagcggacgagcgatcttttggaaaaacgacaacggccccacgacctgcttggacacgccttcggcgttggccaggccgatgcgcttgggcacaagctcgccgatcacgatggacacgaaggcgaccgcgacggtgatgatgaccggcgccaggccgcgcgcgatggcggagagcggcgcgatgccaaagctcatgagccacgtggcgagcgggtcggacagactcgtcgaggcgacggcggacgaggcgaagcccacgagcgtgatggcgacctggatggtggcgagcagctggtcggagtcggcagccagcttaatggcacgctcggcgcgcttgtcgccttcctcggcctcgtgctccaacacggcgcgcttggccgtggtgagcgccatctcggacatagagaagtagccgttgatgagggtcaaaacgagggtggtgataagggagatggttatgtccatcgggagtttctcgaacctccaagattcgggacgtcaggttaaaacgttgatggcggatacggcaattgcaccggcgcccaaacgagaacgcgggcgcgcaggcatggtcgctagattacgaagaggatcaccgccatgaactggaagatgctgccggcgagcacccacaggtgaaacacgctgtgcagatagcgcacgtttttggcgatatagaacggcacgcccgcggtgtagcacacgccgccgacggcgagcagggcaagtgccacgggattgagcagcgcaacaagttcgggcagcttaaagacaacgagccagcccatcagcaggtagaccaggccgcttacccaatgcggctggcgctcgcgtaggaagcactcgagggcgatgccgatgatggcgatggcccatacggcaaagaacagcacagcgccgccgtcgtttgcgagcgtgatgaggcaaaacggcgtatagctgccggctatgagcaggtagatgcagctgtggtcgatgatgcgaaacacgcgcttggcgcgcgcgggctgaatcgcgtggtagagcgtggaggctaggtattcgaggataatgctgacgccatagacaatcgccgcggccatatgggccgggcctccgccgcgcagggcggcgaatacgatcaggagcaccaggcccgcgatacccagcaggcagccgacaccatgggtgacggagttcatgatctcctcgcccactgtgtagtgtggaacgaccgcggtcttgggtcgcggcttagaactgtcgctcgaatcggacatgccggttacatcctccaacgtaaagagttctcaacactatatcaaagcgtctaggtacgtgcgaaatttgcaccatacgtgaccctttgtttacccattctttgcctgttgacgcatcaacggcgaacgtccataatgcgcttgcattaaatgttgatgtattaacatcttataggagaataccgcatggctcaaaacgcacgttcccatcgaaagctcaagatagccggcatcgttgcactagtggttgtcgttgcgctgctcggatttgccggcaactttctgtttgacttcgcgctgaatccccgcgcgccatacaccatgaagatgatgcaggatagcaagaacgacaaagaaggtgagcagccggatgccgaggataccgaggcgcgggcgtggtttaaggagaaccgcgagagcagcagcctcaccgcggacgatgggaccgagcttgccgcctggtattttgctgcgtcggagagcgcacacgactacgccgtctgcctgcatggatataccaacgagcccatcggtatggcccgatacgtcaagcgattccacgaccgcggcatgaacgtactcgcacccgccgcccgcgcccacgagcgctccggcggcgactatatcggcatgggctggcccgaacgcctcgacatcgtcgcatggatcgagcgaatcgttcaggctgaccccaaggcgcgcatcctggtctttggcgaatccatgggcgcggcgaccgccatgaacgtcgcgggggaatctctgcccgcaaacgtgaaatgcattatcgaggactgcggttatacgagtgtttgggacgagttttctctgcagctcaaggacgtgttcggcctgcccagctttcccttgctcgatgtagcaaacttggtgtgcaacgtgcgcgcgggctacgactttcataaggcgagcagcgtggaacagctcaagcgcgcgacggttcccatgctgtttatccacggtgaccaagacacctttgtgccgtacagcatgctcgaccaaaactacgacgcgtgcgccagcaaggtcaagcaaaagctcaccgtccatggcgccacccacgccaagagcgcgcaggtcgaccccgaactctactggaacacggtcgacgacttcctcgacgagtatttttaggcaaaaagcaacgtctggggttttgttgccaaaaatcggtttgtggtcggcgctattcgattttcctcgcacttccaaaaagccgcccgtgggcgctgtgctcacgggcggcttttgctcaacttacgctacaaaggcgcttattttgtccaatagctaggcgctacttgacctcgataagctcgtacttgctcgtgcccaggccgatcttctcggcatgcgcgatgcacacgcgccagtcggtgtcgggatgcgtgatgcagaagggatccttggcctgctcgccctccagatgctcgtggttgtgctccatcttggccgcgctatcggtgagctcggtgtttggcagcggctcggatgccatgacggcatcggcgcaggcctggtcgatggcgaccgggtcgaagctcgcgaacatgccgatgtcgttgacgataggcgtatcgttttcgggatggcaatcgcaattggggctgatatccatggcaagcgagatatggaagctcgggcgaccgtcgacgacggccttggtgtactcggcgatcttgcagttgagcacgtcggccgcggcgtcatagccgggcttgatgcagtcctggttgcatgccgcaatgcagcgaccgcagcccacgcagcgatcgtggtcgatggtggccacgtgcaccgtgcgggtgttgccgttggcaagctcgcgctcgcgggtgtcgttgaacgagacagcgtcgtgcgcgcagatcttttcgcaggcacggcagccaacgcagtgctcggtcgagacgttcggcttgccggcggcatgctgctccatcttgccggcgcggctgccgccgcccatgcccaggttcttcatggcgccgccaaagccggcctgctcatgacccttaaagtgggtgaggctgatcacgatatcggcatccatgagcgcctgaccgatcttggcctcgtgcacgtactcgccgccctcgaccggaacaagcgcctcgtcggtgcccttgaggccgtcggcaatgatgatctggcaacccgtagcatacggggtaaagccgttctggtaggcggtatcgatgtgctcgagcgcgtttttgcggctaccgacatagagcgtgttgcagtcggtgaggaagggcttgccgcccagctccttcacgacatccgcgacggcgcgggcgtagttggggcgcaaaaagctcaggttgcccagctcgccaaagtgaatcttgatggcgacgaacttgttctcgaagtcgatctgctcgataccggcgtgacggatgaggcgcttgagcttgtcgagctggctctcgcgagcatgcgtgcgcaggttggtgaagtacaccttagcgggtgcagttgcggtcatagatctatcccctcggtctatatggcgttacagacatagaggatggtaccagttaaagcagagttaaagtcaagtacggcacctagtcattggggacgttcttaaatgactactcttggactttgagggcttcggccagactgacgcgcttgatggagcgcgtgtgcagcagcgccacgaccaggtaggtcgcaaagccgattcctgcgcacgccgccatggaccaagcgggcacgtagatctcgatattgccgttataggcgagcagcatcgagcggaagatggccgttagcgagccaataatgaccggcaggctcagcacgagtgacgctgccacgcacaacgtgatcgagcggatgtacagatgcgaaatctcgctatcgcgatagccaaagactttcatgtagctgatcgaacgggcgctgtggtcgatcacagccttggtcagcaggtacataaacagcaagaagatgaacaccgcaagcccaaccatcatgccgatcattttgctcatcatgccgatgaactggtcgcccacggcgcgcatgtcgtcgggcgtggtatcgccggcaaagtagcgcgcgtcgaggtcgagcttctcgttgctcacgtagccgttaaagtaggccgcatcgttgtcaaacagctcgttaaagtcttcgatgctcatatagacattcatatccgacttagagccccaaacgcagtccttgcccacgtactcaaaggaataattctcgccctcgtacttgtcgcgaagcttaaccttctgaccctcgctccagccaaacttgtcgagcaagccaccgccaaagacgacgcgtccgtcgctgacgtccagtcctttccagtagcgcgaatcgggcgagatgccgtagatggaaatcgtctcctcgccatttccgtcgccgcggtcgtattgcagctggtagacggcgtatttctcggcctgtgcgattgcgcccgcgccgttatcggtcgtattgaccgggtggatatcgtcgttgtcagtgtcgatcttagaggccttgtcgatcaggtcgatagcctcatcgtggtcgcagccgagagcatcggcaaggtcatcgaggcgcgcataaagcgcatccttcttgtcctggaccttggcgagcgcgtcctgcgccgcagccaggctctcggcagacggggatgcggtcgcggcatcggctgccgcctgcgccgcatcggccgcgtcgtcgagctcgtcatcggcatcttgggcggcagaaagcagcgcgccgtcaaccgactgcaagcactcgagtgccgaccactgctcgcgctcctcggcagtgccctcgagctccagcggagccttgagcgtgtactggtgctcggcgaccaggctcgtctcgaggttgtccgcgtagtgcgtcatcgtgggcagaatcgccaggccaaagagcagcagcagcgaggcaaacgcaatgcccacgaagagcgtggcgaagttgcccaggttgcgcaggaagatacgcaggcggaagcgcgagacaaagcccatgcgctccggcagctgcaggccgcgcttggtgccagacttgccgctcgcctcgtggcgaagaaactgcaacggcgtcttgcccatcttgcgaagcagacccaccagcgtgatgaggatgagcgcagcggcgggaaccacggcgcacttcacaaagatctcccagctccagtacacctggaagggcggcaggctgtacgagccgtaatcgaggctgcgcatgggctcggtaaagaacacgacgccgagcgcagtgcccaaaagcaccgcgaccacgcccacgatggcgggaagcgcaaggtagtgcagcacgatctcgcgtcgacgatagccgctggcgagcagcgtgccgatgatggcgctctcctcctcgatggtggcgtcggtaaggaccacaaagacgaacgccatgatcacgatgatgatgtcgagcagcgtcatccacatcatggagtcgccgtctacgtcgtcgcgcgcgtagccaatgccctggttggaatcggcgtcgatgaggtcatccacgcgtgcgtcggcatcggtgagcgcctccaccatatcctgctccgcatcgacgcgatccgcggtggagagatcgcgatcggtaaaggtaaaggagtaggtgtaggcaggcgcgccgccggcgtccttaagcgcggcaaagccggcgtcggtgacctcggccacaccgtacgtgatggtgttcaccgtaaagtccgaattgttgaggaacagcgcctggctatcgggctgggtcatgatgccgcagatggtgtaggtgcgaccctcgagctcgactttatcgcccacggacaggttgttattggtggcgaagacacggtcgattgccacctcatcgtccgccttaggctgcctgccttcgcagtaggacgcgatatcgaccttggtgcggtgcgcataggtgcgcagcgtgcgcttggttccatcgtcgccggcggtctttttgatgatggcatcgatggagaaattcttgtagagcgtgacgccaccgacgtcgtctgccgcgtcctcggctgccttgagctggtctttggtggcctcgaaggaggtggtcacgcggccgtcctcgatcgcgtacgcatcgcgcatgtcgtcgataaggcagccgatggaatgcgccgcgagcaaaaagcccgatgtaagggcaatgcttccgcacataagcaaaaagatgcccaggtacttaccgatattgcggcgcagctcgcgcgggagacgttttgcgagaggtgtcatggcgccgcctaccaatcgagctcggcggccgcgacgggcgactcgttgagctcatcctcgacgatgcgcccgtcgcgcaggcgcagcacgcgattggccatgcgggcgatggcggcgttgtgtgtgacgatgatgatggtgcatccgtactcgtgattgacatcctccatgagctgcaagatttccttggacgtcttatagtcgagcgcgcccgtgggctcgtcgcacagcagcagacccgggtttttgacgagcgcgcggccgatggcacagcgttgctgctgaccacccgaaacctggcgcgggaacttgttgcggtgctcgtagaggcccagcgagcgtagcaggtcgtcaatgttgagcggctttttggacaggcatgccgtgacctcgatgttttccttgatggtgaggtcgggcaccaggttgtagaactggaagacaaagcccagctcacggcggcgatactcgcccaggtcggtaggtttgagcaccgtgaggtcacagccgtccaccagaatggagccggcatcggcatcctccaggccgccgatcaggttgagaaaggtcgacttacccgagcccgagggccccagcatgacgcagatctcgccgcggttgatggacgtgtcgatgccatcgagtaccgtcaggcgcgcatcaccgtcgccgtaatgctttttgagatccttcacctggacataggcttcctgcgttgccatggtatcccccgttgttagcctcgtactactttatgagcgtaatagtaaaccatggcgaactattttggagcgaggccggggatttatttcagaccagtcattggggacgttcttaaatgactaggtggctaggcgtgggatttggtgcgtgcgagggcgaggcctgcggcggcgatggccacggcgaagagtgccgtgacgcccaggtcgcaggcgatgtcgcccagcacggtggacgttaaatccgaggcgagtgccttgctgatcgcgtcgttcacccaatatgtcggcacaaaatgcgccacggtctgcacggccgagcccatgagcgacagcggcatccaggcgccgcccaaaaacgtcatgagcatgccaagcaggttgcccacgccgttgagcagttcctcgcgcgcgcccaagctcgacaacgtaaagccaacggccagaggcgtgcacgccagggcaaacgtcgccgccagcgccagacacacacgacccacgccgacctcagcgaccgcgccggcaaagcccacgacacccatcatgctcgacacaaaccagatgcagacggtgagcacggcggcggcggcaaacacggcaagcgaacgttggcgctcggagattgggccggcatccatacgacgcacgcgctcgggctcgttcatgcccgagaacaccaaccccaccgatacgatgaccgacgagataatcgcgtacgcgccaaagttgaagtacgactcgagcgtggcggcagcagccgagtcgaccttgacccgctcgatctggacctccgcgcgctttgcagcggcatgttcggcggccttggcaacgtcgccgttggaggcagtgggctcaagcgccgccgcagcgcccgcgagcgagatccagcgcgaggcctcggcagacgaaagcgccgccgccatggtgccggcaccgtaggtcacatcgagcttgggcagggactcccccgcgcgggcagccgcgaccaggtcgtcctcgaacccctccgggataaagaacacgcagtcggcgctgcccttggcgctgttgctcttggagagcgcgtccgcaaggtcgtacgtgtcatcgccgacgcccgtgaccaggtcaaaccgcgaacctaggtgcttggtgagcgcacgtgaaagatcactgccatcgcggtcgaccacgatcacgttggcgtcgtagggcttgtactcggtgagctgcgacgagttccagctcaccgatgccgcgatgaatacgcccatcagcgaaatgaacaccgtgtagatgagcaggtagaacgggtgagcgagcgccatgcgaagcgcggtcttaaaggtgctcatagcggctccttccaaagatcagcgtggcggcggcaacgaacagcagtgccatgaggaccagtgcgccggcgcgaacggcaaaaggatccaggtcctcaaagaaatacaggcggttgaacatgtcgcagatgagcttgacggggttgagccagcactcggccggacaggcgcgggcgacgtcatcggcaagcgccatcgccggttcgccgtagagcccagcgaacaaagcgcacgtggtggcaaagcctgtgaggatgcccgacttggatgccttgccgcccttaacgggaagcgtgcccacaaagagtcccaagcccgtggcggcaagcgcggaagcggcaccgcccaccagacacagcccctcgcgcccgccaaagtcgacgcccacaaccaggcgcacgtagccgatcgcgatcgccatcgaggcaaaggagaccagccacgagcccacaaagataccggccagcgacgccgttttggaaagaccgcccgcgcagcggcgcgcgccaaggcccgacagattgggctgcagatcgacgacgctcaaggcggcaaactccgcagacatcatcgcgaccaggccaaagagcgcgtaatagtagatgaccgtgccatcgggcgtggtgcgtgtcaggcttacgcggcgggtgccgccctcgagcgacagggcgcgcgcaaccgcctccgggtcggcgagcgccgccgggttgtcctgggcaatctgagacatgagctcggcattttgtgtatacgagcttgccaccgtctccagaatgctgcggtcggtgagcaccgttgaggcacgcgagctgtcgtagctcgacagcaacgtgagcttgggtgcgcccgcgtcgtcgaccgtatagatgcccgcgacctcgccggccttaagcacacggttcgcatcggctgcgtcgtcgcactcgtggatctcgagcagctgattgtcgctctccttggcaagcgacgtcgccacgtccttaaaggtcgaggcgtcccaggcctcgtccgctatgacggcaaccggtaccgggtcgaccgtgccgtcagagctcagattcgcaaacataaacatgaacatcgtggaaagtgcgatgggaaagagagcgccccagacccacgtgctcggccggcgcagcagcgtcttgaccgtagtgatgatggtgttgaacatgactgccccctagtcgcgcagctcgcggccggtgatctcgaggaacacgtcgttgagggtcggcggctcgctccacacgcggccgagcgccacatcggcggcgcgcagcgtgtcgaggatgtcgaccaaattgtgcgggctcgcttcgcaggtgcagacgagctcgccgccggacagctcaaccgaaagcacgtgctcgagggcgcgcagccgctcgaccgtggcggtctcggcggcgccgacctcgacagtcacgcgctcgcccatttgaatcatgcgtttgagctcgtcattggtgccctgcgccagcacacgtccgccgtccatgatcatgatgcggctgcaaatctgctcgacttcctccatgtaatggctggtatacaccaccgtggcgccctcgtcgcgcaagcggcagatgccctccaggatggcgttgcggctctgcgggtcgaccgccaccgtgggctcgtcaaagaagatgagctcgggcttgtgcgcgataccgcaggcgatgttgaggcgacgcgccaggccgcccgagagcttgccggggcgaaacttggtaaagtcgcccagcccgacaaagtcgatcgcctcgtccaccagcgcgcggcggcgcttgcggtcgttgacgtaaaggctgcagaaatagtcgatgttctcgcgcaccgtaagctcgtcaaacaccgccacctgctgcggcaccacaccgatgcggcgcttgaggtcgtagcgggcgggcgtcatgggctcgccgaacagctcgatggtgcctttgtcgtaggcgagcagctgcagaatgcagttgatggacgtggtcttgcccgagccgttggggcccagcaggccaaagatctcgccgggggcgatgctcaggctaaagtggtcgagcgcgataaggtcgtcgtagcgcttgacgaggttttcgacgtggacgatgtctgtcatgaggcggcccttctgttgattgcggcccggtacgattgcatcatcgcaggagcgagcggcgcgcaccagtgagctttgtcacgagtgcggagcttggccgtgcggcctgccgacgtccccgctttgccgcgtgggaggaatgtcacggttgcgcaggcggtccctccaccacgcgcggcttcgcgtacaatacccgtatgaacaggcttttcgacaaatcgatcgtgctggcgtgctgtattgcggccgccatgggtcttgctgtggacgctcgcctggtcgcggcgttttgccttggcgttattgccacctcgctggccgaggtcgtacagggaaaccgcgcccgccgtgtgagcgaggccgcgagctacgcctgcatcatcgcggctgtcttcgtgccgccgtttgtgccgtttgcgcctctcgctctctatgacatcgcgcgacgcgttcgccgtgaacgaatctggcccgcgctggcgattggcgccgtgtttgtctgcgcgcttgtcgcggaccttcgtggtggcgtgctcaccacccgaacgctgctgttaaccgccatcctttcggttgccgccaccttgctatcgctacgcaccgcccagttggagcgcgagcagcggcgcatgcgccgcacccgcgacgagctgcaggaacgagccctcgcgctcgaggcgcgcaaccgcgatcttgccgatcgccaggactacgaagtcgagctcgcgacgctcgccgaacgcgcccgcatcgcgcgcgagatccacgataacgtcaggcaccagctcacgcgcgcctcactgcaggccgaagccctacgcgtggtccacgccgacgagcctggcgtcgccgccgatttcgccgacgttaaacgcacggttgacgaggcgctccagcttgtgcgcaccagcgtccacgcgctcaacgacaacgccgtcgacctttccgtgcagctcgaacgcattgtcgaaggcacacgctcggacggcggcccgcagattgagcttgaagttatggccgaacatgcgcccgcaaacgtcgccaactgctttgcagcggtcctgcgcgaagcgctctccaataccatgcgccacgcttgcgcccagaccgtcaccgtacggtgcatggagcatccgtcgttttaccagctcattgttaccgacgatggcgtgggtgaggtccaagcaagcggccgcggcaccgcggagggcatggggctcgcctccatgcgcgagcgcatcgaggcgcttggcggcaccttcaccgccggcccgcgtgccggcgccggcggctggcgtgtgtttgccaccgttcccaaacagcaaggagatgagggccgatgaggctcatcgttgtcgacgacgaccgcttggtggtcgattcgctcaagattatcttgggcgcccagccgcagatcgaagtggtgggcaccggtgccaacggcaacgatgcggtggcgctctacgccgagcacgcacccgatattgcgctgctcgacatccagatgccgggacgcgacggcctttcggccgcgcgcgagatccttgagcacgaccctgcggcgcgcgtggtgtttctgacgacgttctcggatgacgagtacattgtgtcggcgctcaagctgggcgcccgcggctacttgattaaaaccgacgtcgctgccatccctcccgcgttgacacaggtcatggatggcaaacgcgtgctcgagggtaaggcgatcgaggatatcaactttgatggggcggacgtcgaggccggcgcgacccgccggcccgccgcctttgccggtctgaccgaccgcgagttcgaagtcgccgagctcatcgcccgcggcctcgacaacaagaagatcgctgccaccgcctatatgggcgaaggcaccgtgcgcaaccacatcagctcaatcctagccaaaatggggctacgcaaccgcacccaaatcgccatcgcctatctgcgaggctagccgctggctgccgccaatttgatgccatttcaaaactatgccggtttactacgatgaaccgcatatctccgaccacggcaaattgcgcacttacaaaaccgcaggtagaacacttgcgatatttgcaaaaatgctggtgtggtcaggaatctcggattcatcgtagtaaaccggcatagttttgttcgggcggccctgcacgagtgtctccgccagcctcgcgggaccaaaatgagccgttttcctccgtccccaagggatcagccgaaaccgctcgccacgaaacctgcccatctactacgtttgactcgatacccttgaccatacccgcttttcatgaaaaaccgcaggcgttctacctgcagtttttatttcgcattacttgccatggttgagggtagcggcttaaacgtagtagatgagcccatttcgtggcagacgggtcacgtgacagccctcgcaaggccaaaatgacccgattccctctgtccacgggagatcaagggctgttacggatatggtgtcatttcaaaactatgccggattacggagctaaagtcggggccctcatccataccaccattttttgaaaaacggcaggctatctacctgcggttttgtttttgcgtttttctgcatggtgggaggttcgctatccagccccgtaatccggcatagttttgttcgtggcagcccaaccgcgcgctcacgcgcggggccggtggggcatttttgcccctccggcccctattccagctctattccagcgctactccggcttagtttctaccgtgggagtcttgtccgctgcgactggggtgcgggcggtgtccatagtcaggcagtgcttggggcagctctcgatgcactcaccgcacaccacacaggcatacgggtcgatcgaccacgttccacccttgcgatcgaccgcgagcgcgcccgccggacagcgacgcgcacacatgccgcagcagatacacacgtccatgtcgttgacgatatgcccgcgcaagcgctcgggtgccgcgagcttctcctgcggatagcacaccgttaccggctgcttgaccatagagcccaaggccgtcttggcaaatgtcagcaaactcatgccgcgcctacctttccgtgcagctaatgcaggggtcgatggtcaggataatcatgggcacgttggcaaggagtacgccctgcagcgcatgcgtcagacccgccaagttctgcgacgtcggcgtgcgcacgcggaaacggtccaggttcttggtgccgttgccgcgcacatagtaatacgcctcgccgcgcggctgctcaatcacaacctcgccgcgcgcgccgtcggccggcgtaagcttggtgcgcccgccaatcccgtcgtgcggaatcttgcccacaagctccttaatgatgtccatggcctgcgtgacctcggcgcaacgcacctggcagcgggcatagcaatcgccatcggtagcaacgatgggctcaaacgcggccaagtccgcataggcgccgtcaccgaacatgcgcacgtcgtagtccacgcccgaggcgcggccgaacggaccgaccatcgaaagctccagcgcgtctttcttgctgatcacgcccacgccatgcaggcgctcgccgcagctgttgtcgtccaaaaacgtatgcaccagggcctcgtagtcggggcgcatggcgtcgagcgtctcgacaatgcccgccagctcggagtcctcgatatcgtgcttaaggccgccgatctcgttaatcgacagaatcacgcgcccgccgcaagtgctctcaaagatcttgaggatctgctcgcgcagggtccacgaccgatagaacagcgcctcgaagccaaaggcgtcggcgagcaggcccagccacagcagatgtgagtggatgcgcgaaagctcgtgcaaaatggtgcggatatactgcacgcggccggacacctcgatgccgagcatacgctcacaggcgctggcatagccgcagctgtggcccacggcgcagatgccgcagatgcgctcggcgatgtagccaaactggtgcatgtcacgcttttcggtgagcttctcgagtccgcggtgcacaaaaccgatctgcggaattgcctcgatgacgcggtcgtcctcgatcaccaggtccagatgaagcggctcgggcagcaccgggtgctgcgggccaaacggaataacggagcgatgtgccatgggccttacgcctcctttttctgcttgtcgcgggcggccttggcggcaagcgccgcgcggaccttggctgctttctcgggatccatggcagcgagctttgcctccatctcggcagccttgagcgcggccttcgcagcagtttcatcgtgctgagcatcggagccggcagccgcagcggactgggcgctcgccgcagccgaagcatcgccggcactcgcagcgctctcccctgcagcagccgcagccgcggcggacttctcggcagcggccttgcgcgccttggcctcggcggcggcacgcaccttcatggccttctcgcgcgcggccttcacctcgggcgtgataacgctcatgggttcggcagtcgagacctggtagaaaaagcccttaaagtcgatctgcatgtcggtgatggcaagaccaaacaggtcgtgcgcctcgttttcaaacgggaataccgccggatagtacgagctgatggacggaatctcctggtactggtcgataccctcgaccaccagattctcaatcgcatagtttccgtcccgcgcggtctgctcctgagcagcacgaacgttgataaacgtatagaccaagcgatacgtgccgtcgtcgacgttgcgctcggcgtgcatttgcacaaagcgcgcgccgacgcccttgagcacctgaacatgcggcaggagctcgtcgatcccgacggtggtatagatagccttttgcattacttggcctcctttgcagcggcgggcgcaccgtcagccgcgcctgcgtcgacaccggccccggcccccgcagcagctacaaacccgtcctcgcctagctcaacgccaccatcccaggtagcggcgccgcccacggtaagcgggtcaccgccagcgcgcatcacggcctccttctggtccagaatgccgcacgcctccacaatggcgtcgatcaccgtctcggggcgaatggcgcacccgggcgcgtacacgtccacgggaatcgcgcggtccacgccgccgatcacgttataggcatcgcggaacacgccgcccgaacacgcgcagatgccgcaggccaccacgcacttgggctcgagcatctggttgtagatctggcgcacgacgggcaggttctgggcattgaccgaccccgtcaccaaaaagatatccgcatgcttggggttgccagtgttgaccacgccaaagcgctccgcatcgaacagcggcgtgagcgaggccagcacctcgatatcgcatccgttgcaactcgagccgtcgtaatgaataacccacggcgagcgcgacattttatgatccatggatgctgcctcctaaataaacacatcgacgagtatgggcataaggttgagcaggccaaacaccagcgccacgccccatccgagcctaaagcagctgcgccaggtgctgcgtgcgaaggtgttgtcgatcaggacctcgacaaaatacgtcgcgaccatcacgaccagggctacaacccagctcacggggttgtcccagacaaagaacatgcccacccacatcaaaaacagcacggtctcgcaccagtgcataagggtcatcttggccagcgtgccgccgctcatctcggtggcgacgccctggacgatctcctgatgcgcatgatgcgagtacgaaaggtcaaacggcgacttgcgcagcttgatggtgagcaccgcgagcagcgcaaggaaaatgggcgcgctgtacacgatgatgggagccgactgccccgttacggcgatggaatcgaagctgtcggtggcaagatacaggcccacactcatcagcaaaacggcgggctcgtaactcataacctgcagcaactcacgatcggcgccgacctgggcaaacggactttgcgtcgaggcggacgccagcaccacaaagatcgcggcgagcgtcaccataaaagcgcacagcagcgtgttggaacccgacacaaagatgccgccgcccaccacggtaaagatgagcgcgcacgccatgtaggtatcgtccatggtgtttacgctggcaggggctttgcgcaggagcttggcaacgtcgtagaagggctgcagcaggcgcgggcccacgcggccctgcatgcgggccgaaagcttacggtcaagaccgtcgatcagaccgcccacaagcggcgccagcaaggcaaacgccacggtgccaataaaaatgcccacgacgcccgaaccttcaaaatacttgccgcgcagcaccgagggcgcgctcatggcaagtctctcgggcccaatccacgcgcaacacagcagcgcaaacaagataatgctgcagcacacgacgctacccgcggggccaatacgcttctcgccaagggcgtcctccgagtaccaattgcgcttttcggccttcacctcgtgtcccatcgagccgcggaaatggcgatatttgtcggttcccacacccgaaaggtacacgttgacgtgcggcttgttgctcacgcggaatgaagtcagcagcaccacggcgataaacgccacgataaccaccatcagatacatagcgtccttgccgataacgtacggcacgcggccaaacaccatggccaagtaaggcgacaccagaccgctcgagataatcggaaacgccacgcagcacagaatcagcaacgcggcgatggtgttgagcgccatccattcggtcttatggacattgacctcaacgttttgagccgtggggtcgacgcccgaaagcttggcaagccacttgccccagaagtaaaacgtcgcggccgagccaaaggccagaaccatgatcatgagcacgttgccggtctgggcaaacgccaccagggcgccccacttggacacgagcatgccaaacggcgccacaaacatgcccatgatgcccagcatcatcaggcgcgtcaggtgcggcatgcggctgaacataccgtccatgtcctcgatattgcggctgccgatatgatgctcggccgtgcccacgcacaggaacagcaacgactttgccaccgtgtggaacaggatcaggaagatggccgcccatacggcctcgggcgcgccgacacccaagcaggcactgatgaggcccaagttggaaatggtggagtacgcgagcacacgcttggcgttgctctgcgagatggccatgagggcagcgagcaaaaacgtgatggcacccacactcgtgaccataaagccggtcacgggatagatggcatagagcgggctcagcttgaccatcaggaacacgccggctttgaccatggttgacgagtgcagcagggcgctcgtgggagtgggggcaaccatagcacccaacagccacgtgtggaacggcatctgtgcggccttggtgagtgcggcgagcgacaacaggatgaccggcatcaccagcagtgcggattgcgcggtaccggcgccggaaagctcgatcatgcccgagatggtcagcggcatgccgttaacgtgcaagaacataaggcccgccaaaaacgcgataccgcccagcatgttaaggatgatctgggtgaaagcgttcttgatggcctcgggcgtgcgcgtgtagccaatcataaggaacgagcacacggtggtgatttcccagccgcagaacagccactcaaggttgtcgctcgtcacgatgacgaacatggccgagaggaacaggaacataagcgccaggaactgcgggcgacggtcgggcgcggtctgcccgcgcagtgcggcctcgtgctcgtcgtgggcctggaagtccttcatataacccaaggcatacacgcagatgaggctgccaacaatgccgacggcgaggaccatgatcacgctcatgtagtccaggtagagcggcgtcgccgtgacggcttcgaccgcgggcagcgtcatggctgcaaaggcgaacgagcccaccagctggactatgccgagcaccgtggcgagcgcgttcctatatttgtacgcgttgtacaggattacggcgcacaggatgacgtcgatgacggagctgatgatcgagagcacatgcgaggtgccggaggcaacctcaaagctctgcggacccatgccaaaaaacatgacggcgactacaactgtcaccgccataataatgccggagcctatgagccccaccgcatcgcgggcgcggtcaccgcgcgcgagcagcatgcccagcgccggtaccagcggaaacagggtaaggaaatacagtagcgtcataccatcactcccccgtgcaaaaacgctgcaattgtttaacgttatagctcaattgaggagtagcggcggcaggttttcggtcaactggggagttttaggcgtacggggtaagggcacgtccgctttggagcagagaggcggcaagaaaaatgcgcccctgtgggcgcaccatcccgtttgctattccgcctttttaacgcgcggcttgcgacctcgcggcttatcgaccagtgcggactcaccgctctcgcgatactggcggcaccaggccttaaccgaagactcgcttggaatcttgtgtttgatcatggcctcgcgaaccgttaagccgttttccaagcggtccttgaccacggcgagcttaacttcgtacgaataggtgtgatgatgcgaaccggcgttgagaacggcgtcggcaccgcccacggcatacgcgcgggcccactgacgagccgtggcctggggaatgccaagctccgcggcgagggcgcgatgaccgaccccctcttggaggatctcgacggcgcgctgcctaacctcgggcgcatgcgtgcgagtcctagttgcttccgacatacctgccacttcttagccttaaccgttaatctgctttcttacgtgcaagttagatagtagcattttactgtttgctcaaagcagttaattaaaatagacgcggcgttatctgggcatttggcaccaaattacgacatttctttatcgattatttacgctggtagctgactcgcagctaatcgtcattcgcttgtcaacaaaattggcatctctttatgtcctttgatatagaggatatagttattaacccctcccccaataattttgagtgatctgcgaggcagtagacgtcctcactcctcatggttaccgcgcattgccatccaccggagcaaaacaaaaagggcgggacctgctgcgcttgcaggccccgcaccggttgacacccgacggggcacagccgggcgagacggatccgtgctaccgccccgcctggccgcgatgttcaactacagctcgttggccgcgtgatacgccgtgcgaatggcgctcgcaatgtcggcggtgcgctcacccgagcagtcgcccacgcaggtcacgggcaccgtcacgccatccaggtcaaacgcgttggccttggagcccacggccatcaccacgtaatcgcaggcgatcttcaccggctcctcggcgccgtcctcggtggtgcgaacagcctccacgccctcgtcggtaatggcggtcaggcgggtcttcacgtgctgctccacgttgtgctcggcaaagtcgctcatgatcagcggcagaatggtctcggactcgcccgcggcaatcttgtcgagcatctccacgatcgccacctcgcagccgtgctgcagcaggtactcggcagtctcggtgcccaccaggccaccgccaatgacggcgacgcggcccgtaagctccaccttgccggccagcacgtcccagctcgagacgaccttgtccgaatcggcgcccggaacgggaatgaccacgtcgtgtgcgcccacagccacaatcgcggcgtcggcggcgttgaggtcctcagcggtagcggcatggttgagctcaaccttcacacccagaccgggcagaatcttctcgtaatactcgaccgagcgcatgatctcgtccttgcgcgggggcgcggccgccagcacaatctggccgcccagatggtcgctcgcctcgtagacggtcacgtcgtagccgcgcttggccgccacgcgcgcggcctccaggccggcgatgccgccgcccaccacggcaatcttcttgtcgccctcgcccggcttaatggcgatggtcgcctcgtcgccgttctcggcgttgagcacacacgaaatgtacttgcggttttgaatcgcgtcgacgcaacccttgttgcagttgaggcactcgcggatgggctcacccgtggcggccttcagcgcaatgtcggggtcgcacatgagcgagcggccgtaggcgatgatgtcggccgcgccgtcttccagaatcttctcgccggcctcgaccgagacaacacggcccacggttgccaccggcacggagaccagggccttgacgcgctcggccacgggcagcgtccagttgtagggcatggcgcccatgggcggaatggtgtcgcccatgttgccggtgtggttggcctgtgcgacctggatcatgtcgatgcccgcgccctcaagcagcttggcaaactcgcaggcctcgtcgggctgcaggccgcccttgccgcgcggcgtgccgtcggggttctccataatcacggggagtttgtactccaccatcagctgcggcgcggcttccttaatggcagcgacgacctccagcgcgtagcgaacgcggttctcgaacgaaccaccgtactcgtcggtgcgctggttgaggatggccgagcacagcgaacccaccaagcggtcgccgtggacctcgatggcgtcgatgccggcctgctgtgcgcgagcggccgaggcagcgatggcctccttaatctgggtgagctgctctacgctcgcctcgttcacaaagtgctgcatgtcgtgatgcagcttggcgtaggcctggttgcggatctcgttggactcggccatcttggcggcaaaggtctcctcgtcgccggcggccttggcctcctgcgcggccttggcggcagccatggatcccatgaccatgcggccgacaccgggcacgtcgtactcggggtggaacagctgcagcgcgaccttggcgccgtgtttgtggacggcgtcggccagcgccttaaacgtggggatctgggcgtcggttgccagcttgggcgtggggcttgcggtcatgacgggagcgacgtcgccgatgacgatgtagctcacgccgccacgggccaagcgctcgtaaaaagccaggctgcgctcgccgatggaaccgtcacgctcctcgtagccggtggtcagcggcggaaacataatgcggttcttgagctcaagggggccaaccgtaatgggctggagcagcttggatgcaggtgtggtcatggacattcctctcttgtaggcgcggcggcgatgatgccgcgtagttatctagaggatatggcatgggaatacaacagcgcaacggaaatcggcgaatatcaggtggcagcaggtggatggggatgggcggggcggcccgtcggtttatctcaatctgtaacagttacgcggcaaaaccgggtcttactgttacagatcgagacaaaccaaacccgcctgctagaaaatctcaatctataacaacaactcggcaaaatccgtccctcgtgttacagatttagacaaacacgacccaacccaccggtatatctcggtctgtaacacctagccgcccaaatcgggtctagatgttacagatcgagattttgtttgagaggccgagaattggaccgaaaacacggtcccgaaataacaaaaaagctcgccggctaggccgacgagctgcaagttcttggtcgcgggggcaggatttgaacctacgacctccgggttatgagcccggcgagctaccagactgctccaccccgcaatgtctgggcgcctcatgtgcgcaagaaagaatattacgcgggagttcggtaaacggcaaggaaaatctcgtagagcataattccttcatatttaaacccctcagcccctatcaccgtaaacgaatcgcagccgagcgccgtcggcggcgcgtatacaatggtgcgcgtccttttatgccaacaccgggagtagacatgctgctcgctatcgatatgggaaacacgcagacggccatgggcctgtttgacggagacgagctggtgcagtcgtggcgcatgcccaccgaccgctcctataccgccgacgagatccatgtgcgcctgatgggtttctttaagatgtacggcctttcgctcgatgcggtcgacgcgatcgcctttgcgggcgtggtgccgcagctctcgcgcgagtggcacgccgtggccgaccgcattgccgcggacgccatcgtcatcgggccgcagacggccgccgtaaccaagctgcgggcggcgcgcccccaggccgttggtgccgaccgcatcgccaacgccgtcgctgccgagaccttctatggcgcgccggcgatcgtggtggactttggcaccgcgaccaatatcgacgtcatcgatgaggacggttattacattggcggagcgatcgcgccgggcattcgcatctccatggacgcgcttgccgcccgtgccgccaagctcgccagcgtgccgctcgaggcgcccgagcacgccatcggccgcgataccgaggagtgcatcaaggtcggcgccgtaacgggcgccgccgccatggctgagggcctggtcgcgcgcatgaagcgcgagctgggccgcgaggatgccaccgttatcgccacgggcggcctcgccagcatcgtcgccgattcgaccgacgccttcgacatagtcgacggccaactcaccatcaaaggcatctgcgaaatctaccgccgcatgcaggagttagcgtaggctctggcgaagccgagacgctacagtccgcgaattcgtacagcctcgggcggaaactcctgctcgccggcatcggtcttgatggtcgctcggccccagatgtccaggcccgcaaacacaccgaccgcaagcggcaaaccgttgggcgacaccgccgcaacttggcggcccagcagcggcaccatgtcgaagtactagcccagcacgggagccagcggccccgcggcgccttgcggcgtgttggcaacaaccgcccaggcgtccacgcgggccagcatggcggcggccagcgcctcgaccagcgcttcgtcagccacacccacaccgagctcgctcaacgccgaacgctcaatatccaccgtcacggcaccgaacatgcccgcagcaccggcaccgccgttcacggcaacacgcgcgagcgacgtctcaaacgcaggcgcaccgcacacgatatcgctcggccactggatacccaccttaccggcaaggcccaaccccggcgtcgaagccgtgcccacgagcgcgtccatcatgcccatcgcggccacaaacggcaggccgtggaaggcatgcatgttcacatccggacgcacgaccagcgaaaacgtcagcgaagcatcgcccgcgctccacgcgcaccagcccgcggacacgccctcgcggcccgcgtcgcgcgccgcgtcgagctcggtgccggcggcaacagcattcatctcgatcatctacatacgccccaattcgcccacgatatgacccacgcggtcctcgggctccttgacctcgacgccgttgtagcggaagaaccgcgccgggtcgtgcatcaggtcctcgagcggcaccagcacaaagtcgcgctcgccaatgagcggatgcggcaggcgcagctttttgccgccgtgggtctcgccgtccatccacagcaggtccaggtcgatggtgcgcgggccgttgaccttgacctttttggagcggtcgcgccccagctcgacctcgatcttcatgagctcgtcgagcagcaccaacggcgccagctcggtcttaatctcgatgacagcgttggcaaacgcgtcctggcgcgtctcgtaggccggctcgctctcgtagatcttggaggagttggacacgcaggtgagcggaatctcggcgatcatgtcgcgcgcggcgcggatgttgtcgcaacgatgccccaggttggagcccacggccacaaacgcacggcgcggctgcggcttggcgacggcccagtaaccgttcaggaactgcgcaaaacccgcggcgtcgtgcacgcgcacgatgttggcaccggcctggatggcgcccaggcacacgccaaacgtggcggcatcgcgcgcggcggcctcggtcacgcccgagacagcgcccacaaagcgcttgcgcgacacggcgcacatgagcgggtagcccagcgacgccatcttggcagtctcgcgctggatgacgatgtcctcgttagccgacttaccaaagcccgggccaggatcgatgcagatgcggtcgcgagacacgccggcatggatgagcgtgcgggcctggtcggacagaaagcccataacgcggcgcatgatgggcgccgaatcgggcagggtgaagcggcggagctgcgaggtgggcacgtaggcttcctcgcggcgggcgctgcggcgcatcatggctgccaggtggtcattggactccgatgcgacctcggtggctgcgggcgcggcctcgggcgcgggcgcgacggtctcggcggcagcaacctgctcggcggccggcgtctcctgccccagctcggttgcgggctcggacgtgggctccggttcgccaaacggcaacgagggctgcaccacgccgcccggaagcttggcctcaaccttgggctcacccagcagcttgccgcgacggcggcgagccggcttctcggcctcacgcgcggcctcggcagccgcctcgcgcgccttctcggcaacaaacgccgctgccgaggtatcgagctgcaccgttgcgtgcgtgcgggtgggcgcggcgacctcgccggcatgcatcacgatgacgccgcaggtgctcgtcttaacaaactcgaccatcttgggatcggtgaagccggtcacgtcgttgacgatcgaggcgccgcagcgcacggccgccttggcaaccgccacatgacgcgtgtcgatcgagacgatggcgccctccttggccagcgcgcgcaccacgggcagcacgcggcgagcctcctcgtcggggttgaccggggtaaagccggggcgcgtggactcgccgcccacgtcgatgatgtcggcgccggcgtcgagcatcgccaggccgtactcgatggcagcatccgggtcgaagtgctccccgccatcgctaaacgaatcgggcgtcacgttgaggacgcccatgatgcgcggacggtcaaagctgagctcgtactttccgcaccgccatgtcttgctgtcgttcgccatgaacatcctcctaaaatgcccacgccgccgagcttggggagctggcggcggggtcgctttgcactcagtctttctattgtatccgcgcgcgcgggctagaacgcaaacgcggccgcgatgtcgcaagaaatcagcaggtcggcatttgcatcctgatcggtgggagcaaggttgcaaatggccagcgtatcgccggtaaagtaacgcgtaaggcccgccgccggatacaccacgagcgaggtcccgcccacgatgagggcatcggccgcggcgatggcggcaacggcaccggtcaacacatgctcgtcgagcggctcttcgtagagcaccacatcgggcttaatgcgcccgccgcacgcaggacacacgggcacgcccgcggcgtcctcgtgctcgcgcgagcaaatccattcggcgctgtagactgcgccgcacgtctggcagacattgcggtggaccgagccatgcagctcgaacacgcgctgcgagccggccatctgatgcaggccgtcgatattttgcgtcaccacggcattcagcttgccggcgcgctccagctcggccagcttggtgtggcagcgattgggcttggcgccaagcgcgatcatcttggtgcggtagaagtcgaagaactcggccggatgcgcctcgtaaaagctatgcgacagcatggtctcgggcggataggcaaactgctggtgatacaggccgcccacgctgcggaaatcggggatgccacttgccgtggaaacaccagcgccgccaaagaagaccacgcgcttgtgggtgtcaaacagatccgccagcgcggcggaggcctgcctggggtccgatattgcctgcgtcatatgagtcctccgtccttgttagtcgggcagcgttgagcgacgtcccagcatgcggcctttaagtcagcatgcgcggatcccaccccgcccctgttgcgctaatcttaagcctgccaaccccgtcgaaaggacaccatgcctcagacttacactttcgcctcgtggaacgtcaacggcctgcgcgccgtgctcaaaaaggacccgagctttatccagatcgcgcaagaactcgacgtcgatatcctggcactgcaagagaccaagttgcaagaaggccaggtcgatattgacctgcccggctatcaccaaacctggagctacgccgagcgtaaaggctattcgggcaccgcggtctttagccgccaggagccgctgcgcgtactgcgcgccgatgcgctgctgccctacgccggcggaggcgaggcggccgtgctcgtcgcccaagtcgcaaccgagggccgcgtctgcgcgctcgagttcgacaaattctggtttgtggatgtctacacgcccaacgcacaaaatgagctcgcgcgcatcgacgtgcgtatggcctgggacgatgcctaccgcggctttttgaacgcgctcgagcgcgagaccggcaaacccgtcgtaacctgcggcgactttaacgtggcgcatgaggagatcgaccttaagaaccccaagtccaaccgcggcaacgcaggcttttcggacgaggaacgcggcaagtttaccgagctgctcaacgccggctttaccgatacctggcgcgcggcaaaccccgacgtcgagggcgtctacagctggtggagctatcgctttaatgcccgcaagaacaacgccggctggcgcatcgattactttctggtaagcgattcgatcgccgccaacgttcgcgacaccggcatccgcggcgacatctttggcagcgaccactgccccgtcaccctcacgctagagctctagccccaagtaattcctctaggggacagaggaaaacagatcatgtgacccctctccctctataaggtgcggtggaatagttcctgtttgggcagcaaatagccaaaaacgagaaccattccaccgcaagctcgtgagggaacgcgaaatgccttacagcccgtatttcacgacgacacggttaatgcgacggcaccaaggcttgtacaaggcagccaagaacacgcaggtcgcgaggccgtgtgtgatatcgaacggcactgccgtggcaagacgtgccatggcacccgcccacgtgagcggttgaacaaaaccgataatgtcgtaggcgttgatcacaacgccgtacagcaaacccgaagcaaagccgtaggtcagcagcgccggcatacgcacggtgccatcggcgcgatcaaaagcgccggcatgcgccagcgcaccgccaacgtatcccacgagcccccaggcatacatctgccacggcgtccacatgccctgcccaaaaaagaaattgctggtcagcgccgccaacgcaccgaccataaaaccattgcggcgaccaagcgtcgcccccgcgataatggcgatggcactcacgggtttaaagtcgggaatggggccaaacaagatgcgccccgccgcggccaatgctgccagaaccagcgtgggcataatctggcgcaaacccggacgagacgcctcgtaacccgcaaagaacagcgcgagcaccagcgccaccacaaccagcatggccaatgctgcctgctcaacacccgacagcaacgcggcagccatcaccgccggcaccgccaacaacagcgggacctccagttttgcaagcaagcgcgcgacgcgataatccgtcatcccatcacgccctataaaacacgttatcggcaaagaagtcggccggcggctccatgcaggcaatctcgccgtcaaacatcatgacgacgtcgtcggctacctgctcggcaaagtccaaatcgtgcgtagccatgatgacggtgccgccagccttcgcatggtcacgcagggcgcgggcaatgatgcggcggctgaacaggtctagacccttggtgggctcatcgagcaatagcagttcggggccgattagcagcagttttgccaatgcaagcagttgacgctgcccgcccgaaagatcgtacggatggcgtccatccagacccgacaaccccaagctcgccgcacgctcccgcgccaagttctcgtcatatccgcaggtcgaggcccattccatcagctcatcgcgaaccgtctcggcaaccagcaatgctttgggattctgaggcagcagcgccgccgaggccgctccgcgcaccatgcggccgcgctgcagcttggcggtcttcgccagcaccgagagcatcgtcgacttgccgcagccgttaccgccaacaaccgcatgcaccgcaccggccgaaaacgacgcatcgagcccacgcaacacccagccggacgctcgatcgtagcgaaaccagccttccgacagggtggtagccgacccgccgtgcattttttggagtattctgcttccatccgtgcgcgagaaggcttccgagccgttctcgagcgacgtttgcgccacaaattcggacgatttgtccaattccgaactttttttcgcgctcgatacgtccccgggcggctccagagaacccaaattgtcctcacgcctgctgaatactccgttttttgcacatcggatggcaccccaccccaacatgtcatcggaaaacagcgattctcggcgtcccaaagaagacatatccgccacctcgcgcacgcgaccgccctcaatccggtgcgtacacgtcgcatactcgagcatcggccgcggctgatgcgtcgccacaacaaccgtgcagcccagctcgcgattcacacgaaacagcgcgtgcaggaaattcttctccgcaaccggatcaagctgagacgtgggctcgtcgagcagcagcacgcgcgggcgcaacgccagaacggccgccaacgacagcaactgtttgcgaccacccgaaagcgtgtcagtatcgcggtgaagccaatcttccagcccaaagaaatagctggtctcagctacgcgacggcgcatctcatcacgtgctagccccaagttttccaggccaaacgccatctcgtgccacacggtttcgcacacgatctggttctcgggatcctggaacacatagcccacgcgctccgccgatgcccgcacatccatgtcggcgacgggctcgcccagcacgcgcagctcgccggagcgcgtacccgccggcgcgatctcgggcttgagcagcgacagcagcgtcgacttgcccgaaccggtaccgccaacaagcagtgcaaacgcaccttgggaaacacgccaatcaagcccctcgagcaccggtgcctcggccccgggataggcaaaactaaggcctcgcacctcaatcgccggcgcggccgagccatatgccacacccgccgccgagctcctatccaaccgagccatcagccaaacctcttctcatcaatcgcgtgcgacgcgcaaggcagcatcatccaggcagcgtacacgacatagcccagccacggcgccggcaccgatagttgcgggtaaaacgaatactgcatcgtcgcagtccacgccactgccgtcgtggccatgccaaacagcgcaagtccaaccagcgcggcaacatcgccgcgccccagccgataccgcgcatacgtcgttcgacgcgtcgcggcgccccacccacgggagcgcatggcgtccgcacgctccagcgaatcttccatgccccagcccatcaacacgctcgacgcccgcaggcgcgatcgcacgggatcggtgggcgcgcggcccggcacatcaatcgcatcctgcaccgccagcaccgtacgaccgcggcgtaaaaactgcgggataagcctcatgcacatcgagatcatgagcgcaatcaccggtgcggcattgcccagcagcgcgagcaccttgtcgtattcgagcatcgacgccgcggcctcaaaccacagcacgctcgccacaaacagcccgcccatgcacaggccgtataccatgctttccagatacaccgcgcgcatgccaatacggaacagctccgtcgagcccgaggcgctaaacagcggattgaccagcgcgataatcaaaatcaccggcagctgccagcggagtgcgcccagcgtgcgggcagccccgcgcgtcgcaaatccatacgccagcccgcccgcaagtgacagcgcaatcagcaccggctgcatcgagaacatggtgagccccagcgtcagcaccatgtagagggccggcacagccggatgcgacatcgagaatgccgcgacgggctcgccgccaaactcctcttgtatgttgtccacgggcacccccgtcccctcgctcaaacgacagctccgcagcaccgccaacgccgcacgcaagcagcgcaaacgccacgccggcggcaccgacatcggccgccatgagccaatcgctacgcgctcaacatatgcctgcggtatcatattgcgccgtgtatcgtttccaaacacacgtctctataacgtaacaggagatcacatggacgcaaccgcaattatcctcgctgccggcgagggcacccgcatgaagtcgaaccactgcaaggtttcgcacaagatcctgggtaagcccatggttcagtggatcgtcgacgccaccatcaaggccggctgcagccgcgtcgtggtcgtcatcggcagccacgccgacgagatgcgcgcccttatcgacggcgcctacgccaacagcgccaccaaggtcgagtgcgtcgagcagactgagcgcctgggcaccggtcacgccgtgaaggtcgcgctcgaggcctgcggcatcacgcaaggccccgtcgtcgtgctcaacggcgacttgccgctcatcaccgccgacaccgtcgccaagttcgcgcagaccgtcgctaccggcgagctcgcctgcaccgtcatgaccatgaccccgcccgatcctttcggctacggccgcatcaagctgggcgccgatggtcagatcgagcgcatcatcgagcagaaggactgcacgcccgagcaggccgccacgctgctcgagtgcaacgccggctgctacgccttcgacggcgcgcagctcgccgcacacatcaacgagatcggcaacgacaacgcgcagtccgagtactacctgcccgacatgctcgaaatcctcaagggtcacggccaggcggtctccatcttccactgtgacgactaccgcgacggcttgggcgtcaacagccgcatccagctcgcacagctcaccgccatcgcgcgcgaccgcatcaacgagcactggatggccgagggcgttaccttcatcgaccccacgcaggcctggatcggccccgacgccaccatcggccgcgacaccgtcgtgtggccgcagacgcacctgatcggccgcgtcaccgtgggcgaagagtgccagctcggccccaacagccgcctcaccgacaccaccgtcggcagcggctgcaccatcgatgagaccatcgccatcgaggccgtcatcgagaacggcgtcgactgcggcccgcgcgcctacctgcgcccgggtacccatatgctcgacggttccaaggccggcacgcacgtggagatcaagaagtccacgatcggcgagggttccaaggtgccccacctgtcctacatcggcgacaccaccatgggctccggcgtcaacgtaggcgcgggctccatcacctgcaactacgacggcgtccacaagcacaagaccgttatcggcaaggatgccttcatcggctccgacaccatgatggtcgcgcccgcccaaattggcgacggcgcgctcgtggccgccggctccgtcatcaccgagccggtcccggcagacgcgctcggactgggccgcgcccgtcaggtaaatattgagggctgggccgccgattatcgccgccgtctgcacgaggacgacgaggtataacgttttaccaagcatctaaggagctgttcccatgggggacggctcctttttctatgctgacctgcgtggccggatgagtggtcggttcgtgtccgttgacggtaaagacgttatcaagactcgataaaccccgccgcgcggttacaatgcaacaaggcatctatatggcattcgatataaaggagaagggtaatgccgattaatgatcccgagaagtcggagaatatgcgcaagtccatccgcgtgtattccggttcctccaaccgtcccctcgctcagaagattgctgagtaccttggggtcgagctttcgggccttacgctaaagcagttcgccaatggtgagatttacgcccgctacgacgagaccgtccgcggcgccgacgtcttcctgattcagtccgtggccggcggcaacgttaacgacatgctcatggagctgctcatcgccaccgacgctgccaagcgcgcatccgcccgctccatcaccgccgttatcacccactacggctatgcccgccaggaccgcaaggccggcccgcgcgagcccatcaccgcccgcctcgtcgccaacctgctcgagcgcgccggcgtcaaccgcatcatcaccctcgacctgcaccagggccagatccagggcttctttgatatcccggttaaccacctgtccgcgctgccgctgtttggccagtactacaacaacatgcacttcgacaccgacaacctggttgtcgtctcccccgacgtgggtcgtgccaaggccgccaagaagctgtccgacatgctcggctgcgacctggccatcgcccacaagggccgtccgcgccacaacgccgccgaggtcatgggcatcatcggtgacatcaagggcaagacctgcatcatcaacgacgacatgatcgacaccgctggcaccctgtgcgccaacgtcaaggagctcaaggctatgggcgctggcgacatctacgtctgcgccacccacggcatcttctccggtccggccatcgagcgtctgaacgacgccccgatcgtcgagtgcctcgtcaccgacgccattcccgtcgaggtcggcggtaagatcaagaccatctcggtcgccgaggagttcgctcaggccatctccgccgtttaccacgaggagcccgtctccacgctcgtcggcggcgacttcgcgctgtagtcgctcgaccctcgcatccctccggaagccccggtcacgcctgcggggttatcacgcgaacgtcctcgccgctttgcggctgcgggatgttcgctttgataacccctcccggcgtgtccggggcttcctgctgtctaggggcagctgttttctgaaatgactttgctgcaacctttcctcgccttcggcgggcgtggtagcctttgtcgttgattgaactatttgtgtaacgaagggacaaatatggcagctgcacagccgcttaaaattcgcatggttgccggacttggcaaccctggcgaggaatatgccgagacccgccacaacgctggcttcaaagcaatcgacgagttggcccgtcaggccggtgtcacgtactggaaaaaccaggcaggcgccgaggtcgcgctcatcaacatcaacgatcccgaggaagagggcgggaagcgccagattgtgctggtcaagccgcagtcgtatatgaatacctcgggtggccccatctccaagctctgccgcgagtacaagatcaaggccgaggagctgctcgtgatccatgatgagctcgacattcccgccggcgacgtacgcgttaaggtgggcggcggccacgccggccacaacggcctgcgctccatcatcgacaagatgggcagccgcgactttagtcgcatccgcaccggcatcggcaaccctcccggcaagatggccgtggccgactacgtgctcaagcggctgcgcacccgcgaggccgaggacttccaggacacctgcacccgcgcggccgacgccgcgggtctcgccatcgtgcacggcgtggtctatgcccgcgaccatgtcaacggcgccgcctctgccaacggcaagcactaaaacctgccaaaaagggacaggtttattttggcgggttttatctacggaaacgccccggtgtccgcatcgcaatagacgccgcaccgccatgcatacacaacgctccaaagggggccggcctcaccgatgcgcgaggccggccccctttgccgttttgcctgataaaacctgccaaaataaacctgtccctaaatggcaggtcacttttcccgcctgccaaagacacacgtaagcgacatgtccatgagggtataatttgcaccgtatgtctgcacaacgcctgtgcgcgtacggttttattcgggctaccgtccatttccgtggaggcacggttcggcggccctaacaagagaggggttctatgtataagatcctggagaagacgcagttctcggagaaggtgttcaagttccgcatcgaggcgcctgcaatcgccaagcatgcgcacgctggacagttcctcatggtccgcgccaacgagacgggcgagcgcgtcccgtttaccctggccggctggaacggtgacgagggctgggtcgagttcatcttcatggtgatcggaaagaccaccgagatgctgtccacctacgaggccggcgagtcgctgcgcgacgtcgtgggcccgctgggcgttcctaccgagatggccgagggcccctgcgctgtcattggcggcggcgtcggcctggcaattgccttcccggtcgccaagcacctggtcgagaccggtcacgaggtgcacgccatcatgggcgcccgcaccaaggacctcctgctcatggaggaccagttccgcgagctcctcgacgaggaccacatccacatcactaccgatgacggttcctacggcgagcagggcgttgtcaccgctccgctggagcgcctgctgcaggacaaggccgtgagccaggtcttctgcgtcggccccgttccgatgatgaagttctcaaccctcaccgcccagaagtacgacacccccatcaccgcgtcgctcaaccccatcatggttgacggcaccggcatgtgcggctgctgccgcgtcgaggtgggcggcgtgaccaagttcgcttgcgtcgacggccccgacttcgatgccaccctggtcgactgggatgaccttcgtgcccgccaggccgcttaccgttccgaagagggcgagtccctcaaggcctatgaggaaaagagctgcgcatgccactagttaacggtcgtttcgttgccgatatgaagtcgccccgcacccccgataacgaggagccggctgccgagcgcgcctgcgacttccgccccgtcgacaagggcttcaccgaggagatggcgctggccgaggccgagcgctgcctcaactgcaagaagccgttctgtgttgagggctgccccgtcaacatcaacattccccgctttatcgagcagatccgcgcgaaggacttcggcggcgctctcgataccatccgcgaggactccatgcttcccgccatctgcggccgcgtctgcccgcaggagaaccagtgcgagggcaagtgcatccgtggtaagaagtccgagcccgtggccatcggccagctcgagcgcttcctgggtgaccgccccgaactcgcctccacgcccaagatggcccccaccaacgccaagaaggtcgccgtcgtcggctccggcccgtccggcatcacctgcgccggcgagctcgcccgtaacggctttgacgttaccgtcttcgaggcattcttcaccggtggcggcgtgctggtctacggcatccccgagttccgtctgcccaaggcagtcgtcaagcgcgagattgacggcttggaggacatgggcgtcaagtttgagtacaactccgtcgtgggcaacatggccacggccgaggagctgttcgagcagggcttcgacgccatctacgtggcgaccggcgctggcctgcccaagttcctcaacgtccccggcgagaacctgcccaacgtcttcttcgcaaacgagtacctcacccgcgtgaacctgatgaaggccaacaagttccccgagtacgacacccccaccaagcacggcaagaacgtcgtcgtctttggtggcggcaacgtggctatggacgccgtccgtaccgccaagcgcctgggcgccgagcacgccatcatcgcctaccgccgtaccgaggacgagatgccctgccgtcgcgccgagctgcatcacgccaaggccgagggcgtcgaggttctgccgctcgtctccccgctcgagtttgtcgctggcgaggacggcaccgtgtgcgccgtcaaggtccagaagatggagctcggcgagcccgacgagtccggccgccgtcgtccggttgccatcgagggcgccatcgaggagatcccctgcgacgtcgcgatctcggctatcggcaccaacgccaaccccttcgccgccaagatcggcggcaagatggagctcaacaagtggggctacatcgtcgccgacgaggagaccggccagaccaccgatcctcgcatctgggccggcggcgacatcgtcaccggtgccgctacggtcattctggcgatgggcgccggcaagaaggccgccgcttccatcaccaagagcctgctgggcgagtaatcacccgcagcgctagccatcaaacggcaaagtccccgtcgagcacacgcccggcggggactttttctataccgctcgcccaaaccaccacaaaggggacaggcacctttgtggtggttttagactcggccgaccgttttgtctcgatctgtaacaggtagaccctgctgatccccgtagatgttacagatcgagacattatgtcggcgcttcgcccgttcatcttgatctataacagtaagaggccaaatctcccgccacgtgttacagatcgagacgttgttccgacactcgccagcttgtctcaatctgtaacatctggaacccaaattactcgtttggtgttacagatcgagacattaggttggcagtcagacggttcatctcaatctgtaacatctaggaccgttttgagcagctacgtgttatagattgagattttgctgaggacgaggccgagggcagccaccaaaatctagcgcttgcggcgcttggacgcgacgaagccggcgccaatgacggacgcaccggcgataccaagggcggctgcggccgtcgcggcgttgtcgcccgtggcggccagaacaccggaagcgcttttggcgccggcagcagtcttggtcgcaacggtcatggtggtctttgcgtccttatctacgggcttgaggtcaggcttctgctcgggattgggcatgggatcggggtccggagtcggctcggggtccggcgctggttccggctcctgcccgtccccaaaattaatcaccacatcatgggcaacctcggcagaaccgacgatatccgaaatcgcagacgaaccggcaacaccgatgacctgcccgttctgggaactcagccattgccctgtatcgacaacctttttcacatcgcgaacggcaccatccgtcggagtcgtaatcgtcgcatttcctcgcaaatcaatcatcgcggcatggaacagtgtcgcattcacgacgttgcggttgatcgcatagattcccgcagtcgcacccgaagcctcgatcttcgagttgaaaatctggatacgaggcgtttccgacctggtgtttgcctctgccatgattccaaaactttgattgcgggcggcatcgatgctgcttgcggcagatagacttcgagacgtaagattcgacttctcgacaagcatccacaccgcaccgtcttgcgagcgtgcgccgatgcccgccgagaacgaggccgcactaccggcggaaagcacgacatcggctccgttaacgattttcatgaaggtattcttcttgataccgaccgtataaatgcacgcggaagcccacggggcatcggcagtcttaatcgacagattggcgtcatcgatggtgacatcggcaccgcgctcgtaagaggaatccggctcttcctgctcgccttcctgagcagtgtgtctgttgggaatgttatcggcaaagataccgtagatgctctgcattggacgccaagatccttccgccgatttcgcctcgattttgacatcggcgcccttatcgatcgtcacgctgccggccgtcgcgcgaatgcccgtcacatgatccgatgtacccgaagccgtcacgttgacgctggtgccgctgatggtcacatcgccgccgacattgccgtcgccttccgccgcaataacatcgttctgagccgtcgcattaagggtgccgtcgccggtaatggcgaggttgccgtttttaacagcaatagcgttctgaccggcatcggccgtgatggtgttattgcccgtcacgccgatattgaggttgccctgagcactgatgccggcgccgtcgtagccgttgagcttcatgtcgtcgccaccgtcccaggaccaggttcccgcctcgtcgccggcggccgtgcccctgttgtactgcgtgccgcccacgttgacccactcggcggcgagcgccacactcggcagtagcagctgaccggccatgagcacgcaggcccctgcacaggcgagcttggcgcccacgcgacgccacgttccgtgggagagcgagcatgcgcggccgcggttgattgaactgtcatggatttgcttttgcatgtgaacctccttgtcgaaaggggtgcttctgtaacaccatgttacgaaaagttatccgggtcccggggtacaaattcgcatgcgggccatctgccggcgcaaaaggcagccccaggcaatcgccaccgctgccgtccccatcgccatcttgggattgacccagattcagttccccgcgggcacgcttgcgctcgagattctggggtgcacgtcattcctcggactcggcctgctgggtgccgcggcacatcataccttcgcgatgacgttccaagacgaccccaagctcgctaccggcgcaggagcggcctatgccgccggcatcctgatgcagtttgccactaacctgattgattgcggcggcatcgtcgagctcatcattcttggcgcggcgacaattgtcatcgccgccctcagcgccgctccccaaaaggccgccaagagctccggcgaccttgccaatccctttaccgagccctcgcacgccctcgccaagcaggcatgctggagcattgcgctcgtcatgattctcgcctgcctgttctcgacgctcgataacgtcgtcacgttttccaacgcccacggcaccattgcggtgcagacctggccacgcctctttttggcagcgagcggtctcgtcgccggcatcgtctttgaccttgccgagcgccgctacatgggactcgtcatgctcggtgtcacggtgctctccaccatttcgattttggctgtggaagccggcgccgacctcaacttaggcctcgtcgtcttttacctgagctcgggctttttcgtcacgttctttaccgccacgtttacacagctggcaccgcgcatgcatgcacccgccctgtgggccggcatgggtcgcgcagccaacaacgtgtgcgcgttcactacgtcgggcgtctcgctggcactggttgcctcgggcaatgttgccctcatcatgatcggcgcgctcatgctgcttgtggcggcgagtgttgcgttcgttgccgccggcctgttccgcctgccccaaaccgagcaggagcgcgaacaccagcaacgagccgaggaggcactcgcagcacccagcatcgaggaacagcgccgagccttcatcaccgatcacgctctcaccccacgcgaggtcgacgtgctgttcgccgtaacccaagacgagcgcccgctcaaacagatcgccgaggagctcggcatctcgatgcgcatggtgcagcgccacctgagctccatctaccaaaagaccgacacgcaaacgcgcgccggcctcaccaaagcctttccctcagcctaaaacaaaaaccaccacaaaggtgcctgtcccctttgtggtggtttcggtcgactagccttcgagccgcgccagcttgtagcggtaggctgcggcgatgacatctttgcagccctcgcggcccagcttggcgcggttgacgacgatgtccttgccgctcgtcatcttccacttgccggcgctgtagcgcttgtaaaacgcctcacgcgccttctgctgttgcttgaccagcttggcacccttctttttgttgaggccacgcttcttgcgaacgatctcgacgcggtcctcaaagggggcagtcaccagcacggcaatgtggttggggttgttgcgcagcagataatcggacaggcgaccctcgataatgcagctctcggtctcgcccaggtccaaaatcacctggctcattttttggaaaagtttgtccgagtacgaacgggcatcgtaacggtcgggcagaaacgccatgttctccacggccaggcgctcgtcgtaggccgccatcttatcgagcgactcacccgcgcgcagcgacgcgcgcaccagcagctcgttgtcgtacagcggaatccccagctcgttggcgaggatacggccaatctcgtggccctcggcaccaaagtcatgcgcgatggtaatgaccacagggctcttcttgttcaccagatcgctcatcgcgaatcctttctaacaaatgagaaaaaggctgtcctcgtttctcattttgtcacttacgaccgtcctggtttcccaagtgcggcagattgtcccgaaagaggagcgccgcgtactaaatgtacgcaagcgacgattgaggggcaaggtgccgtgcttggggaagcaggactatgcggctacgactcgacgttgatacgcacggaccagcagcgaaatgccaaagttgagtgcaaagtacatcgcaaacaccaggccgtagagcataagcacctgcgacaggtcgatcgcatgcgccatcacgacgtttgccgtgtacatgagctcggccacgttaatgcccgaaagatacgagctgtccttgatgacggtcgtgcattggctaaacagcgccggaatgatcgtcttaaacgtctgcggcagaatgatgtagcgcatggtggcaaagaagccgaagccctggctctgcgctgcctcaaactggccgcgcggaatcgagttgaggccgccgcgcacaatctcggccataacagcgctggtaaacagcgtaaaggcgatggtcgaaatcacaatgtccaaaccctgcaccgtaaagtagataaacaggatccacagcaggttcggcgtgcaacggaacagctcgatataggcgctcaccaaaatacggaacgggcggggcgcatagctcttaacgagcgccaacaccgtgccaaagatgagcgagaaaaagatcgacagcgccgagatctcgattgtcttaacaaagccgccccaaatgtagagcaggttggtcgcgttaaagatttccatgcgctaggcctcctctacgttgtcgagccccagctcggccaggctcacgccgcgcggacgctccttggagcggcgctcgagccactgcaccagcatggcgagcggaaagcagatgatgaagtacataaggcagcagacgatgtatccctgcaggtaaccgtacagactcacaaagttgtcggaacggtacataaggtcgccgccggccacgagcgccagcaccgacgtgttcttgaccaggttgagcgcctggttacacagcggcggcagaatgatcttgaatgtctggggcagcacgatgtaccagtatgcctgcgcacgggtgaagccctggctctgggccgcctccatctgaccgcgcggaaccgcctcgataccggtgcggatgacctccgaaatgtaggctgcgtgatacagacccacacccaagaagcccagcacgaacggcgcaatgcgcaccggctggtcggcaccggttatggcctgcaaaaactgcggaccggccatgtacataaagagcacctgcacgggcaacggggtgttctggtaaaactccacgtacacgcggcttatggcgcgcagcacgcgcgagcgagtggtagagaacacgcccagcagcgtgcccagcaccagcgacagcagcagaccggcaacgaccacctgcagcgtcacgccaaagccctcccagaagggccccatgttttgaaatgtcgtcgaccaacggtcggcgtcaaataatccttcgagcatttgattccttccttggacgatgcgcctatacaagaccccaggtcttgacctcttggtcgagccagccatcggccaggcgatcgcaaatcacctgatcgaccacggccgaaaggtcgcagcccttcttggtcgccacaccgtagccctgctcgccaaacttgacctcgggctgcagcagctcaacggtctcgttcatgtaaccggccagcgtggagcggtccatggcaaagacatcgatattgccggcgtcgagcgaactcttgatgatggggtagccactaaaggccctaaactcgggcttgcagctaaagccgttgtccttgatcatctgctcgatcaggccctgcgtggtagcaccctggctcacgccaatgaccttgccgtccagatcctcaatcgaggtaaagcccgaacgcttcttaaccatgagtcccacgtagtcggtgcggtacggcgtcgagaaatcccagctcttcttgcgctcgtcggtgatggtgtaggtcgctgcgaccacgtcgagctggccgttatcgatcagcggaccgcgcgtcttgggcgttacgtcggtaaactcgacaagctcctgagcacgggcctccttgtagctcacgccaaagacggcagcggcgatctggtagcacaaatcgacttccatgccctcaaagcggcccttggcggtgtcgtaatagccatagccgggaacgtccttcttaacgccggcattcagatggccacgcgacttgatggccgcaagcttggagcccttgtcggagccctcgccgctggtggagttgccgcaaccggtaagcgcggtccccgtcagcgcaagcatgccggcgcccgccagctgcaaaaagtgacggcgcgacacggccgccctcgtcatatccgtcatgtccatcaccgcgcctagtgcagaatcttggacaggaactcgcggcagcgcgggttctcggggttatcgaagaagtgctcgggcgtgccctcctccagaatgcggccgtcctccataaagatgacgcggtcggccacctggcgcgcaaagcccatctcgtgcgtcacgcagatcatggtaatgtcctcctgcgcgagctcaatcataacgtccagaacctcctggaccatctcggggtcgagcgccgaggtcggctcgtcaaacaggatgatgggctgcttggtgcacagggcacgggcgatggcgatgcgctgctgctgaccgcccgagagattctgcggatactcgccggccttatgcgccatgccaacacgcttgagcgcggcaacagcgatctcggtcgcctcctccttgctcttcttttgaagcttgatgggcgcgagcgtcaggttgccgagcaccgtcatgttgggatacaggttgaactgctgaaacaccatggaactatacttgcgagccatctccaggtgattctttttggtgagcggcgtaccgtcgatgacgacctcgcccgacgtgggctcctccagataatcgacgcaacggatgagcgtcgacttacccgaaccggaaggcccgatcattacgagcttctcgccgcgtttgacggtgaggttgatatctttgagcacatgcaggtcgccaaagtacttgttgagatgcttgatctcgatcatgtctgccatgaatgtcccttccctgcgtttacacgagttgaactattgtacggaaagaatcacgtttccgcagcccacactacattcccgtaaagaacccgcaaccttccacctagtcattggggacagacttaaatgagtacctgctcattgggcactcatttaagcctgtccccaatgagtgcccagcccagcaaaaaggggcgcgaccatgacggccacgcccccctaaacatcaactatgtaccgctcggcccctacgcgagtttggctccgacgatctttgccgcggccggcttatcgaagttgccaccggtggccttgccgagtgcgcccataacctggcccatctgcttcttggacgtggcgcccagctcggcgataacctgctcgatcagggcctcgagctcctcgcccgaaacctgcgcgggcagcaggctctccagaatcttgacctgctcggtcaggttgtcggtacgctcctggtcggtgccggccttgatggacatctccagcgtctcgctcgtctgcttgatcagacgcttgatcatgctgttgacgtcttcctcggtcacatcgcggcgctcattgacctcgatattcttcacctcggccttaacctggcgaatgatggacaggcgaaccttgtccttggccttcatggccgcaatcatttccttctgcagctcttcgttggtcatctgcaaatcctcctcaatagtgtgggcggcactcgcgcgagcaccgccccatgattactcagtcgtcgacgaatcgtcggtcgaactcttggtgacacccttcagactcacgttatagggtacgtctttgggcatggggttgacggtgatgtcggcatccttcttgtactgctccagccactcgctgtacgcggtgctggccgcttgcgtcttcaccacgttggagacgtactttttgatgtccttgggcacctggttgatgtcatcaacctgattatcgacatggaagtagtcggtgcacttgatgatgtggtagccataggtcgactcgacgacttcgctcacgtcgcccttgttgagtccctcgagcgccgtctggtagctgtcgacaaaggtggtgagcttatcccagcccacatcgcccttcttctccttggaaccggtgtcctcggagtactgctcaacggcgtcctcaaagctcagctcaccggagttgatcttgtccaggcactcctgcgccttggccttggcggcagccttgtcctcgtcggaagcgtcggaatcaaccttgatcaggatgttcgacgagcggcgggcgtcgttgtagctggacagattttcgttgatgtaatcgacaatctcgctgtccttgggcttgctcgtgggcgcgacggcatccttgagtttctgttgcgccagactctccttgagcgagtccttgtaggtgtcctcggtatagccgtaggtcttgagggtcttcttaaaggccttggctccgcccgcgctcttgcacgcgtccttccaagccttctcgacctcctcgtccgacaccgtcacgccgttctccttctgtgcctgttgaagcagaatctgctgcatgtaggagtcgatgagttgcttgcggtacttcttgggcgtgaggtcgttgtcaaccagatactgcgcccaatcctcatccttggtgtagccgtaggacgtgcgcatgctcatgatctgcttggtcacggtgtcctcggtaaggttggtgccgttgatagtggcagcaacaccgccggtcagcttgtagcccgaggtgtcctcagcctgcgacataaggccggagcacgccatcgccgagacggaaagcagcatcgccagcacgccgatgaccaccagaacgatcttgacggtcttagacacgtacgtcttgcgctgcttcttgcgagagctggaggcagcgcgggcctgctgctcgggcgtcggcgcggcctcggagttctttttcttatttgccatagttggcctttcgcataacgaatcgaacaaacgccattgtgtcacaacgcagcccccgcggcacgcttggtgcattggggacagattaatctgcaccattttggtgcaaaggggacagctctggcagccggcagttagggacagtccccaagtgccgactcagccccaccttagaagtggcggcggatggcgtcgaccatgccctggggcgtggtctggccgagcacgtcggctgcggcatcggcgcccataaagatgttcatgagtgcctgcagggcctcgacctggccgcccggctcggcgatgcccagattgatgacgatctgcgccggcaccggagcgcccatgccagccatagcgttaaatgtcacgggcgcggcgggcttcaccaccgcgatatagggcttggccacaaatcccggatcggtatgtgggatggcaatgttggccgccggcatggcaaggcccgtgggataggcatcctcacgtgtgcgaacggcgtcgagccaaccgggcgcaatgtagccacgcggagcgagctcgtcctcgagttgcgcaaacacctcatccggcgtcgcacactcccaatcaaaaaacaccagctcaggcgtaaacaatgcttcgttatccgccatactgtcctccaaagttgcatgaggttcacaatgccccatatgatagcgaaacgaaacagacaaggttagccgaggatcccgatcatctcgagcgcacgagccggtgtcaagcacacctcgggcatcgcctccagcatgcgtcggtcgctcgtgaccacgtagtcgacatctgccgtctcgcccgaagcgatgatgaggttgtcttcaagatccggcatgcgcttgccaagcatgcgcgccatttcgcactctgccaacgaaagcggagaggccgtcgccacctgcatcatgtgctcgatgcaggcccatgacgccgaggcaaacggcacgttcatcccattcgcattccgccgggctaggcgccgcggcaaaatgtagaacacatcctttgccgtcgtcggcgcgtacagaaggtcaatctttcccgcctcggcaagttccaccaggcgcttcgcttcgtcgaatgccccctcttgcaggtaataatcaagccacacattcgtatccacaagcaggtgctttgcctcgatcatcggcaattcgcctccatgtcggcaatcatcgcgtcatacatatcatcgcgtacggcatcccagtcttccgcagacgattcagctggcgcaaaatccgaagcgcttagccccaacgaggaaaaagctaggccacacccctgctcggccaggctctccgcacggggcgcctcgcgcttatccgccaccataaatcccggcagcgcttgatgctcgacaagatagacccaaagcgcgcgaatggcatcgctcggccccaacccattgcgagttaggaccgcatcgccaccagctttgagcataggatcaattcgcgtgttgagctgcaccattgccgttcccatagcggctcctttctacgtgctagcagtatagcagacataaaaggccacgcaaaagggccccgtccacacgcggacgaggccctgtcagattggtagtctcgagaaagttagtgtagcgcccgatccgaagcgagtcggcctggcatccaagaacctagaatacggttgatgccctatgccgccgaccggcatatgaaagacagcgggccaaaagccccatggcttctagcccgcagaaacatcgatgtttccaaatgatcgcagcttgtgtttcaagcgcttttctacgctaccggcggatgcaaatcccaatcgggaaagcagtttgcaaagcctgagagattttgagtcaaaacattgttctcagcttgcttcagtcgctcgtcctcttcaaacagactatcgagctcgctcaatgcatcgaagtcctgcatcgcggcatcgttatggtcgaaatcagtcacttcatcagtcatctatttcactccattcatggttatcgagtcaatcctatcggctaggcaaccttatcgagcttaagcaggtcgctgcgctcggccgccgcttccttcgcgctcttccactgattaagcgccagatcgatctcggaacagccttcctggatgcgtttggagtatttggcctcaatctcttctgcctccgcagcgcgctgcttgctcgagaggcccgtctttactagacaatagccagcccccgcaagaagcagaatgccaataacctggtttacaaacgcaaagcaagctactcccaaaacagcgaggacaacggccgctatcttgtggctcttgttgcccttcgcaaccttgacatcaagctcagcgagctcctttttcttctcttcaccgacatagcgaacataatcgccgcgcagcgcattgccctcatcgccggtgaccgctctgcttgtccatccgtcgaagtcaagggtgatcgcctgcggaaattcggggacatcgctcttgcgataccggttgaaaccaccgttgatataggaacccaaaaactgaatcgcggtcttctttttatgcacatccacagacgcactctggtcgcgcatcgagcgtgtcatctggtcgatgatattcatcgtctgctgacgcttctcatcacggcgacgattgacgagctctcgggcgcgctccacgtctccgccaaacgccttgaccgcaagaagatactcctcctggcggcgcaaatttcgctccttggagtcatcggagttaacgagctccatcagatgcctgtcaacctgctcggcaagcgtcctctcgtcaacatcagaagccttgaggtcggcgaagtcattggagatgctctcgattgcctcgacttttccgagatacttattgatgtagtcaaactccttgaccaccaccttgagtgccggatatctcgagctcatatcctcctcgtagccggtaaagtactccgcccatgactctgactgctcattctcgaactcagggctctgatttctgatctgctcgatccagcccgccatatagtcgtcgcacaggtgcttttcgtcggttccgaagatgccgttgatataagcatcgatgtagaccatcgcatcggcatcgatgcgggcggcgttttgcgtcgagaagtagcgtgctagccattcgtagcacgtagccgtgcggttattacgtctgcagatcagagccatcgcaagcgacgtgtgctcgttgtcacgtttgacagcctcgcgtattgcgcgctctgcaagatctcggttgttgttgatccatgccgcaagggcaaccaggacaggcgccagccagtagtccggggtagaaatcattaactcctcggagaccgtcgaaatcgtcgccttgcgcacgagcgctgcatcggttgcctggagaataccgaccatggtgtttcgaaccaccgagtagttgccgaacttcttgtccatctcctgccggacgctcacgagctccgtagtcgcctgctcaagtgcggcggtacgacgctgttcgagcatcatctcgagaaagtcctttcggagctttttaaggtccttccgcacttcctccatttgggattcgaccttatcgaccttcgtggtcatctggtcaacttttgttccaatagcggcgattctgcgctcgataagggcagtatctaaacccgaatcactcatctgtaccacctttcagtttgaactgtttagatcatccaatagctttaagcgagtaagcacccgccatccgctttattgagaggccatgcttcggtattgctcggacacctgctgataggccacgagaaacttctgtttgtattggcttgccttcatcgaattgacgatgcgcccgacgggctccacatagtgttcgagaaagtacgaggtccttcttcgtaacgcaaacgaaccagttttatagggggacccggggttctctctaatgcccttgagtagtgcgagacacgtcttgggtatgttgcagttggcggcgatatcttgatagaagctctcccgctctgcggtcataaagtcttccgaagcataccgcgctatgcagaacgggcacacagcatcgataaagctctcaagccgagaccgatcctccatgctctgcatattggcgaccacgagcgataccatctgaacctcaaagtcacgcatgttgtagagcgtcgactcaaacaagtcgatcaagtcacgcacttcgtcatattcgagagggatatcttcggcccttttaaagaaaaccgtcatcgaacccgaaagaccttcgcaaaactcatcgcagtacgcaaccataaactgtgctgccgcgttgtcttgcatcatattgagcacgtccgcggcaaatttgcgggcctccggaaagttaccacccttaaaaaacttgatggcattgtccttggcaaacgcgattttgcccgtggcccccagacgcgcccgcgaatagtacatctcgcgaccgcactggttgcaatgaacctttcgagttgcggggtcaaactcgacatcggtgctgccgcagccctcacaagttataccgttgatttccaatagcttcccccacttcaaccatcaaagtgccctggcaaaaagcagcgcgagcccttatttgacagcggtcagcgccgcattgcgctttttccagatattgcgcgcatcatggacaaggccaaccgtaacatctgccggctcatcggcactcatggaattcgagaccgcctcaagcgcggcggagaactgtcgctcgatctcttgaacatggggttgcgacatgttggaactaaaggagatgtcatccttaagcgctttgagttcggctttgacctgagcgtcctgcgccacggcgaggagctgtcccacatacgatccgaactgcgccgtttgaaccgtctttgcggccacggcagcaaccttttggtcaacctggcggccattgaagcccagacccatctgcacaaggacaagcacagcaagaaggacaacgtttacgacgactggaatcgtgctgccgccccacccatatgccgcaaacacaaagtacgtgttggccagaagggcaacgacaaagtaggcacagctggatgcgaccggcaaataatggatttcggtcgtgcttttgaccgtggactgcttatcggacatggcagccgaaatcgaagccgccgcaaaagccaaaaccccaaagccaagcgacatagcaaagacgatagggttcatcagcgcgtttttgcagacaaacatgattacaagccacgccaccaagacgattgcctcgcccaaaatgacacgtttaacagaaccgttcatctttgtttctccttattggatcttagttccacaatcggggcagaatttggtcccttcgggcaactcggctccgcagctcgggcaccttggcgagatcaaccggttcccgcattccaggcagaacttggcaccgaccgggttaagatgcccacacgccaaacacgcaacaccctgctcgagcttttgtccgcattccaggcagaacttagcacccatcggattaacgtttccgcaactgggacacacgggaccgttttgcatacctgcggacgcggaagccgttccaaccatgggagcaacagcgcccatggcctggttggccaagttggagaagccagctccaaatgcaccgcccatgccaacgcccatgccgagtcccatgccggctcccatgaggcccgatgcggcactcccctcattgcccgcagcactctccattacgtccatgccgcgctcctgctgatagttgtagccttcgcgcgcacgcttcctggcaagtgcctcggactcgatgtccatctgggcagcgttaccctgcgcctcgagaatgctccgcttacgctggatcttcatctcgttgatggcagcaagatcctcttcgaagggcttgatgctgttgaacgagaagttatcgagcgtgagaccaaactcatcgaaatagttaacgagcttgccctgcatctgagacgagaagtcgctcagatgcgtcgcaattttaagaacggaaacctcctggtcaacaatcgccttggcaagcaggtcaggaacatactcaaggatttttgcccgcataaaggaagtaagttcttctcgcgtatagcgatctcgcgtgcccacgaccttaacgaggaacttcctcacctgaatgggaaccaggctcgagtcattctgctcgatatgcgcgccaaacaaaccgaaggcgcgaacatgaacgttgacgtcttcctcagggtcttggacaatgatgggctcggtcgtgccccagcgcagctcgttcatgtagttagtattgataaagtacacaacggaatgaaacgccgagctaccgccggtaagcgaatgggcggcattgcggaacggggcgaatcggctgtctcccgtgtcgagcttgatcttgcacggaccgacaaacacgcttacctgagaatcgccggcacccgtagcgtcagtagaactgcccgcccccatattgttggtaaaaacggcaatctgcgattgcgcaacctgaagataggacccgttgggaaaatcctcgtagggatagcggaatgagacaagcgaggcatcttcgtcgttgccaggctcccatttgatattgtcgacagaaaaggcaccgagaattccgctgtgcttttcttccttttcgttatcgctatggaacagtgacatgctgattcctttcgttaatcccaaaccacgcgttccgcgtgtctaataaattgtgaactgccgagtcgacaggcgcatcgaaagcctgtgcgcctcaatctgtccccaacttagcttggctaattatagccctcaagtcatctcatttagccacccccgatgagcggcaataatgtcgcacctttggtcaactgacgaagaaccgggagggttcgaaccccagatgcccttttggggcatacccgctgagcgggcgagcgcgttcggcctctcggtcagctcttcgtaacgtccgttttagccgcaactaaactcgtcggatggaacaaggggaaaggcataagagctgcgcgcgctgtaatgccaaaacggctcggttaaagttaccagctctcgtgataggccataatcgaccgacatgggtacccttcggagccgcattccgcagacgctacgacctttccgtctttataaaactcgacgtaccaaacgtacgttgccgccccctcccaatagtttggcttatcagcgaccttgaacgtaatagaggcgtcatctggcacaatcaactcgcgcttggcgtttgcaatgaacgcatccatgtcggcgatcacgccatcgccgcgcgcagcggcctccccatcgtcgctgctatcggatgccgcttcagatggtgcttgagatgcgccagatcgatcgtccgcagtgccagagccgtccttcaaagagccctccgaaggctccacccctttgaatgccttccacatatcgctgcttgcggacggcatttcaatgtcggcctccggatacttcccggcgagctcgtcaagaattctgcacgcttcctcacgcccctggaccatcgcctcctgcggtttgccaccatcctcaacggtcctcaccaagtaggcgccattctgcctatcgaattccttattttgaatttgcaccgcgtctacgacctcaggaccctttgcagtaagcgaaatatagaaatctgcctggttacaatcctgactacaagtaaatttaacgatgccgtccttacagacagtaatgacttggctctcaccctgagcaataaaaccgtcatactgattcgtcatattgctggagccttctaccatctctgacgaaggcataaccgaaacggcctctccatcaacaaagcagtaggcacccacaatcgccgaaatatcgttctgcgcatcgacaaacccaacaagcagctcgtcaattccgtcgccattcaaatcatcgaaagcatagtagtagcttaaaaagccgggggcagtctggttgttataaacgaatatctgccccagtccagaatcatcaccgcgtccctgggcccagtcgtcgtagctggcagcaccagcccccttccgctcgcaatagctcgcaaagtcctcgtaacgcgcaaccacgccctcgtaagccctgcgtgctttcttgtttgttgccgcgaccttctttttagacgacttctcctcgactgcagccggctgctcctgctgctgcgcttgaggcagcacaaaggcttcgtaagctttgaccagggcgtaagcgacaccagcggtaaagatgattgctgcaagaatggtgacaaacgtaggcacagcaaaacggccgatctgccgacgctgcatcataaaggccgcaaaggacatatgatcagagggcgccagagaagggccctctgcgcgagatacagcaggatcgcttgtcgcttttctatcagcagacgcctttggtgtacctgaaggaagcggctgctgagcattcgccggcgcatcatccacatccaacggttttccgcatgcagaacagaatcgcgccccgtctttgatctttgccccgcagcttgcacagtacataaatccccctagaacttcagcatatcgaaacgatagcccacagcctgcaaacagaaaaggcccaggagcaatttgctcgactgtaaaccttttctttcacctttcaaattcgcctgaccccacgcggaaggcatgcgacgggctacttgctaggcgcgagccatgtgcagcttgattgccttgaagatgatgttggcaaccgaggcaataggccagagcgccacgatcgtcatcggaaccgattcgggaataacaggaaccgccccgtgaatcacgctgcccaaccagtaaaaaagcatcagaaccacgacaggaaggcccacgagaaccacaagctcgattagcataatcgtgataccgataatgccgctaccatagacaaggggaagccttacaccgctgcggtacagcgagataatcaccttccagggaccaatcagaagcagcgccagcggaatcatattgttaagtcccagcgagccacctcccagcacgtaattgaaaaagagcacatagagcaatgaaatcaccgctgctcgcccaagcgacccgatggactcgtgaagcgaatcctgcaggcaagcagcggcctctgcatcctccgccgcttgaaactgagcctcgacagactggctctcaatcggctgggcctcgacgtaaatcgcgtcccccaccgcgctggccgcagccgcgaccgtaggcgttccgcacacgccgcagaacttggcgccgtcgttaatctctgctccacactgtttgcaatgcataatcgggtcctttctcgttaccccttttcttgacgatcacaagatacgatttgtcgtttatccgatatagagattttgaccgggtaattttcctaaacgtgctacgctattaaacctgcagctagagacaggggtaacaatgtttgagttctcccaaacacgcaccgttgaaggttcgattccgtttaagaaagtcaacctcatagagaacgaacccaataggcccgttggcgaggcccagcttgtctttgaactctacatgcccaccgagctggccggcaacaaaagcaacgaagggcccgcacacagcgagcgccatgccgatctgatcaggctggcatcatgcatcgaacccaccgccgttaaagagcagcccttccgcgcaaacctctttaacgtacttgattacgccgaacagaccgggccgctttttggcaagcacgcaatagaatccgtacgcgattgggccaatgccgcgatggcagcacttattgccatgcgcatccaggaatacctcaacgggagctgcaccatcgcaaaggtctccgcattggaaagaatcgagaaatcagtggtgacctgcgcggcaaacgggtcatccttcaagatctacaccactatcctgagggcgggcggtgattataccgactcattcaaaagcctgcccatcgtgcgcaaaatcgaatccgatgcgggatatttctacgcctttatgtttatgatcgacgaggaagaatccctcgttgcactcaacgtgctctcttttgaacacgagctcaccgccaatgacttcagtgttttgcaggcgatgttctacatggacgaagactccagctcggagatttcagcgcgactcaaggtcagcaatagcgaggagagcttctatgtaatcgaccctcaagcagatatccaggagcgccgcgaagaacttgaaaatgatgaccgcgatgcactcactgctttggtgcaggcgctcgtgatctcgcatctctcgggcgcgcacgtggatgtgttccagggtaacgagtccacagggttcctctcctttgacagctatctctcgtggctctggtttgatttttcacgcaagctgagcaccgtcaaaattggttattgcgagcagtgcggacgcgcctattcacttgccgggcatcgtggcgtcaaacggcactactgcagcgatcgatgcaagaccgatgccaaaaatgagcgcacgcgcaaggagacggcaaagatacgcgagctgtttggaacgggcaccagtgtacgcgacatcgccaacgagatagaacgtcccgcggcctacgtgcgctcgcagctcaataaatggaccaagctcaagcacgatctggatgaagacattgagtcaaacggctttgatagctccgcgctactcaaacgctgcaccgctgagaagctcgacctcaacaacctcctcaacgccaagcgcaaaaagcaaattcaggactatgccaagctcaagcgcctcgttaagtagaaacgctgtcatttccttgccatccgattgacgggtggaaagttgctcatatacgtgttagtaatatatatgttagtaatacgtatatgagcgaggcgcatcatgtttgttggacgtcgggaagagcttgaatccctggaaaccgcctatcaaaagagttcttttcagtttgctgtagtctatggaaggcgtcgcgtaggtaaaaccagcctgcttcacgcctttacacagggcaaaccccatgtgatcttctttactgggcagcaaaccgttgcaagcgaaaatctcgcgctgctcagccgcgagatacttggcgatagcgccgcaggagcagcgttcccctctatccaggttgcactcgaatccgtcttcgaacacgccaagacagagcgaatcgttctgattattgacgagtatccctacctcgccgagagcgatccgggcatctcttcgtgcttgcaaacgcttatcgatcgacataaagacacgagcaagctgttcctcgtactctgcgggtcgtccatgagctttatggaacaccaggtactaggacaccaaagccctctttatggacgccgcaccatgcagctgcgcattgaccccttcaccatcttcgacgcggcgctcatgcttcccgatgcacccatcgaaagggtcatcgagctgtattccgttgttggcgggatgccgctctatctatcacagctcgatggcacgcgtttcactcaatggaaccttgagcatgcgctgttgcgtcaagatgcgtttttgtatgccgaaccccagaactatctgctgcaagaggtccgcagcccggctatctacaatgccgtcataaccgccattgccaacggctatgtacgctccaaagagattgccgatgttacccacctcgcaacgccacaggtcgcgcgactgctcgacgcattgatcgagctgcgaatcgttgagcgcgtcacgcctgttgtaaaggcaacaaaacgccaggtagtctatcggatctgcgataacctgtttaggttttggtatcgttttgttccacagtacgcaggaacaattgaggaggggctcggagccgctgtggccgcgcgtatcgccaagcatgatttgtccacctttgtaggtcctgcatttgaagaagtgtgccgccagtggttgatgcggcaggttgttgagagcgagctggatgtgctgcccaaggcaatcggctcttggtggggcacgaacccgaacacgcgccggcaagaagagattgacgttgtgttagagggcgccgatggggagctcatcgttggcgagtgcaaatggagaaacgagcccgtagataccgatgttcttgaaacactcgagcggcgcagcgcgctgctgggtcggccgatcgaacagtattacttgtttagcaagagtggatttaccaaagcgtgtcaaaatagagcggctcaagcaagcagcgcgaggcttgttggactcgagcaactactataagaaaggggcttggaaacagttttccaagcccctttcagtttttattcgattcccacctttttgagcgtatctttggtgacttccgcaacttgattgggatcgacgtgggattcccccgaaatagagccgtaacctgaggttgaaaaatcaaagaagtagtatgtccggtaattgtgcccatagccaaattgctgatatagggcattatagtccgtctcggaaatgtccttgccctccgacgcataatagtattcgtagccattgccctcgctcggcgcaactccccaggactcgcagttgcttacaagcgaaaaaacatcgcctttcttgccgtataccgaagtattgtccccagccaaagcctgcctgccagcaagcaatgccgtaatcgcattgctcatctcatatgtactttggcttacgaggatgctgccgtcatccgctttaatcagcggaagaaacatcgttcctccgttgctgttatcaagccaattttgactgtaaagcctcttgacgccaccatcagctgccgaccaaacctctacggtgtaggacttctgaagtccctctatatctccattccaagcgctctttaattcgtcatcgctcataccgttcacaacggtcaagagctcaggctggccatcctgatcaaaatcaacgaggtcgacaagacaaagcccccgcatcgcatagacagaatcagtcgcctcaacaattcgtggctctccatagcacgcgagatattcctggcacttttgcttgtaagcggcatacgcagcggtattgtccgcagcggcgcctccatccttcttgtcgccttcgcctgtctttgtatcgtcctcgttggccttaggcacctcgagggaaacctcttttacggcatcagtggatttagagttatcgacgactttgacgggaatgctccactcgacttttgacttggagtccctaacggtgagggtatattttcccggtttgatatcgggaaactggcttaccgtgaagccctcgtcacccttaacctcagcattggtgctgtagccgttgtcgccgttcagggtcaccgagtacttcttgatcttctcgccctttgcgtcggtcggggtaatcttggattcttgggccaccacgatggccttgtcctggccgtaatgggcaacgtcgccggacttgctaaagaacagcagatagctaaagatggcaatgactgccagaccaacgacgataccaacgatatagagcgccttgggctcctttttctgtgcggatacattcgccgcaggcgcaggggctggcgccgcgacgggcttggcgaccggattgatcggctttggccggtcggcgcgcacggctggaatcgaaggcgttgcatcggacgacacgtcgtccttgggccggtcgtcttcttcgtccgctacgggcccgctctccacgggcgacttttcctcccccgcctcggcaccggcggaaggctccttctccgtttcgtcactagcgaaaatctcttccgcagcctcattgataacggaaggctcttctgccacttcgttgctggcagagttcagcaccgcctttgcatcttcgagtgcatagccacactcggtgcagtatcgcaaatcgccatcaagctcaaatccacagttgggacagaacatgttagtcctccttatcgactttcaccgttgtaccgtccttgacctcatcaggggttacttcggaccccacttgagactcatcatcccaggacgcaaccaaaatctcgcaattgccgtccgcaaaagtaccgagctcatagtcttcggtgtgatacaccagtcccttggatgtcacacacaagcacgttgagcccttgattgaatagtccgaagaattactccgcatgagcatcgaattgtaatcagacggatgttctctgcccatttccgtaagatacggccaaactgccgaactcatggaactggcaagatcctcggtatcaatgccaaacatgtcctgaggactaacagtatcacccgtatgcaaatcaaaaataacaccagtcacaaccgtgccgccatgcggaccccatcccgtcgaatagcgctcgtcacggatacagaaaaagttctcatccatgtacgttaccgtcacgtttctcgatatgcagggaaattcgccgtcggggtacaactcagcatctgattgctcattatctgatgctcgatttgttcgctccgcgtcaatttgaaggggctcgagaatcgccttgttaattttgtctgcaacgtcgtctttggtggagctcttaagttgcggataggaccattccatgtccctccgctcgccctgttcgagcatagggtcgaccggagcagacaccgtcaatgactttgcctccaacgtatagacaacttcttcgaccgctctctcgtccttcttgggcctttcggtcgcttgctcctgttgcacggattgctgctggagattgggctcgatgacgttcttgtagagcatgaaagcagcgtaagcgatgcctgcagcggcgataaatgcggcgatcatgatagcaaactgcggcactaggcggttaccgacctgacagcgttgcataaagaagttgtacatctgggagtgaccgctacccgcggtcttcgagaccggctcggggctcggttctgctgtggactcggcattcgcggatcctatcgcagagtccgtttcggtatctgtgggttccattatgacttcagcggacgatgattctcgctccgacggctcggccttgggcccctcctcggccgcagtcttgcccgagagcccgcccaagggcagaccgcattcggtacagaaccgcgcatcatcaccaatcttgctgccacatttggggcaaaacatgaaccttcttctcctattccttttactctcgctgagtcgtgagttacccacgtgccgtttgtttcgtagtttaactatttcttaaacaaatcgatgggtgacttgaacagacgcatacccactcaagtgaccctataccggctagttatcctggctcatggcatgagtgtcagtgtaagaattttcgctgaacaggtccgccccctcgaagtccgagccgatgctcaacttgaagccattttttgccgagatggagaaatcgccgctgatatccatatcatgctcgcggccaaccgccctcattttccgaagtcccacccgtcacgttatcaggagcccgaagtcaaagagatagtaaaagccgattggggcacatgtgattccatatgccccaatcggctttatagtcgtttacgcctcagagaaacctaggtgacccgtttacacgcgctagcgcggcgcatcaattgcgaccttgccgctctccagcacgtgaacgcgaccgtcggcgagcatctgcacgacctcgggatacagcacatgctcgatcgcgtggatgtgctcctcgagcacgtcgacgtcccagccctcctcgacagccagcgcacgctgggcgatgatggggccgttgtcgtagatctcgttggcaaagtgcacggtcacgccggtcaccttgacgccgcgagcaaacgcatcgtcaatcgcatgggcaccggtaaagctcggcagcagcgccggatgcaggttgaccacgcgattggggaacgccgccagcagcggcgtgtgcaccatgcgcatgtaaccggccatcaccacgtactcgcagccgcgctcgagcagctcatgcgcgatgatctcgtcagccgcgatggggtcggcatagacgtccttggacagcgtgagcgtctggatacccgcacgctcggcgcgctgcaagcccttagccgatggacggctcgacaccacaagctcaatcgaggcgttgagcttgccggcggcgatcaggtcgatcagcgcctgcaggttggtacccgaaccgctgataagcacgccgatcttgagcggctcggccgtatcggtgccggtcggacgggtgtagggcacaaagcccaggccctcggcggcagccatctgctcgttagcgctcatcggagtacacgaccttaccggaaccctcgacgcactcgcccacgcggaacggcttctcgcccagcgcgaccagagcctcggtcacggcagcctcgtcctcgggggcgacgatcaggcacaggccgacgcccatgttgaaggtcttgcatgcctcattgggcgcgagctcggcctgacgcgacacgtaggtgatgacgggcggaacatcccagcccatctcggcgccgttgcgggtgaccacggcatcgacgtcgtcggcgagcgcgcggttgaggttctcggtaataccgccgccagtgatgtgggcaatggcgtgcaccggagcgccgccgcgcagcagctccagaatcggcttgacgtagatgcgcgtgggagccagcagggcgtctgccagcgaagcaccgccgagctcctcgagcggacggctcagctcctccgccttagcggcggcctcgggcgtgcccggcttaatgccgtcgacgccgatgaccttgcgcacgagcgagtagccgttggagtgcacgccggtggaaggcaggcccaggatcacatcgcccgggcggacgtttgcggggtcgagcatcttgggacggtcgacgacgcccacggtaaagccggcaaggtcgtagtcggccggagccatgacgccggggtgctcggccatctcaccgcccacgagcgcgcagcccgcgagcttacagccatcggccacgcccttgatgatctttgccatgtgctcggcctcgatgtggccgatggcaacgtagtccaggaagaacagcggctcggcgcccgaagccagaatgtcgttgacgcacatagcgaccaggtcctggcccaccgtctcgtggcgatccatgatctgggcgagcacgagcttggtgcccacgccgtcggtaccgctaatcagaatcgggtcttccatatccttaagcgcggcggccgagaacaggccaccgaagccgccgaggccgccgataacctcggggcgattggtgtccttgaccatctgcttaatcgcgtcgacggcgcggccgccctcggcggtatcgacgccggcatcctcatacgtcacatgcttgctgtcgctcatctgagccttcctctcccactaccgtttgacgcacagacgccaaacggtgctcatagttgcgttcatttcggcgcgcgccataacaacgcgcgccgtcatatcaacaaaacagcaggtaaaacctaccaaaataaacctgtccctacatggcaggttttaggcctcgccgtgttcctcttcccagctgcggtcgtcgtatttctcgaccacggcgtcgtcatcaaagtgcagcggcttgtccaggttgcggggcttaaagccctccatgaacttgtcgcgaccaaaactctcgggaatcgccacggggtagcggccggtaaagcacgcatcgcagtaaccgcccttgggcatgaccttaagcaggccctcgaccgaaaggaaggccagcgaatcggcgccgatatactcgcaaatctcgtcgaccgtcttgttggcgctgataagctgcgactgcacgtcggtatcgataccgtagaagcacggccagataacctcgggtgagttgatgcggatatgaatctccttggcgccggcgttgcgtagcatcttgacgagctgcaccatggtggtgccgcgcacgatggagtcgtcgatgacgaccaggcgcttgccctcgatgttgtcgcgcagcgggttgagtttcatacgcacgcccatggcgcgcagctcctgcgtgggttcgataaacgtacggcccacgtagcggttcttgataaggccctcgccaaagggaataccgctctcgtgcgaataaccctccgcgggcggcaggccggaatcgggcacgccgatgaccaggtcggcctcgacgggctcctcgtgtgccagctgacgacccatgtcataacggcaggcgtagacgctcttgccgttcatgatggagtcggggcgagcgaagtagacctgctcaaagatgcagttagcaggctcttcggcggcaggcacgccctgctcggacacaaggccctcggcgctgatgcgcaagatctcgccgggacggacgtcacgaacatactcggcgcccacaatgtcgagcgcgcacgtctcggaagcaacgacccagccgccggcgcgggtgacatgggtggtggcgtcgaccgtcgcggcgccgtcctgcgacggcagctgcgaaacggatgcggcatcggcttggtccagaccctcgtccaccagcttgcccagcacaagcgggcgaatgccgtgcggatcgcggaatgcgtagagcgcctgctcgttgatgagcgtcatggcatagccgccgcgcacgagctccatggtcttgcgaatgccctcgcgtagatggcctgtacgctgagtaaagtaaccgataagcttagtcgcgacctcggaatccgaattggaaaggaacggcacgcccagctcgatcagctggcggcgcagctcgtcggtgttgacgagggtaccgttgtgcgcgagcgcgataatgacgctattgatggtagagaggtgcggctgagaggcctcccagctcttggcaccggcagtgccatagcgcacgtggcccacggccagctggccggagagtgtcgacaggtcggcgttggagaacacgcggtcgagcaggcccaggtccttgcgaaccataaccgtgccgccatcacccacggcgattcccgccgattcctggccgcgatgctgtagcgcgcgcagaccaaagtacgtcagtcgagccacatcgcgatcgggtgcccacacaccaaaaatgccgcattcctcatgcagctggtcggagtccggatcatacgtcgacatggtcttcacctgtcccgcggcacgctcggccgcgcggatggtttcttgagacatggcatcccctcagagcctcgttatttggcgttacctgccctattatacgcacggcaagacaagcactcccgcgcatgaacagcgctttttaaaagcccaccgagcttataatccgttttgcagccaaacattttattgggcaaccgcctcggggccgacgatcccgcatgcttccgtcgcgacgcgtctcgtccaccgctagggcttacattgctgcaattgggtcgtttgtcctgtcttttagcaggtcggcggcgtatccttgtacctacagcaaaacgagaaaggttatgtatggatcgaaacgaactcgaccccagcgtccccagcgccacggaggtcaagaagatccccctcatcattaaggtgtatgccgtcctgtgcatcctgtccggtgttggtacgctcccgtcggtcggcgcctttatgtggcaggtcatcaccgcgctcatcaacggcaacgccgccgccaacctcggcgacaacacgctcgtcgcagtcggccttatcgtcgccggcatcatgctctcggctgccagtgccgtcatcttgatcatctttggcctggacctcatcaagaaccagcgccgcaacgccgcccgtctttcctacatccttatcgcgtttaccgtcgtcgagcttttagttgacgtgatgctccagggcatcggacccttcctgctgcgccccgccgtccagcttgtcatcctcattgcgctgtcggccaccgtcgaccccacgctacgccaggagcgcgaactgcagcgccgtctgcaagagatgctcgaccgcgatgccgccgccgaggggatgctcggccgcgacgaaaccggcgagggctacatcaagctcaactacttcaacctgttctgggtattcttcgtctgcagcgtgttaggtctcattctcgaggaagtctggcatatggtcgtcgtcgatcccggcgtctatcaggaccgtgccggtatgctatttggcccctttagccccatctacggatttggcgcggtgctcatgaccatggcgctcaaccgcttctataaaaagaatcctctgatcattttcctggtaagtgccctgatcggcggcgctttcgaggtgtttgtaggctggtttatgcagacctcatttggcgtggtgtcgtggagctattcacacattaggctattcggcatgcccgatcccatcgcggtattgaccgggggacgcacatgcacgccgtttgcctgcatgtggggcctgggtggcctcatctggatcaaggtcttgctgccgcacctgcttaagctcatcaatatgattccatggaaacgccgctactctgctaccgtcatcctgaccgccgtcatgttgatcgacggcgtcatgacgttgcaatcgctcgactattggtatcagcgcgtcaacggaaccgttcgaaatattcccgtcgcacagttctatgacaagcatttcgataacgaatatatggagaaccgttttcagagtatgaccatgagccccaaggacgccacacgcgtgtagcaaacgccagagcaaaatagctccaacacatcaaagcccgctggcagatctacatgaactgccggcgggctttcgctatagacagactcggattgccgacgaggccttacgcctcgcgctcgacctcgctcacgcactcgttcttgatggtgccgacgagcgactgcagcgcatcgaccacatgcgggcgaatgtctccgccaatgagcacgagcatgatgtcgtcgcccacggtaagctcgccgctcgccagccacacgcgcacatagccgatacccggcatcgtgcgcgtcgcctcgatagcggcctgcaccttttcggcatcgaagccaaacaccatgccgcccaccttgtggcctggcgccacgccatcggtctcgactccgcgcacttcggccttgggcgtcgcgcgcaccacgccgttgtgtgtcaggtacatcccacaatcagccgccgaaacatcggccttggcttcgcgcagccaagcatcaaccgaaggcatcgatttgccgttctcaagcatcatttctccttttgatttccagggtagtctttttgggacggggcccggacactttattcctcgaccggcgtgagcaccatgacggcgcgcgtattgctaaatgacagcgaacggcaggtcacaagcgttacgaccttggttgccgaagcggcacgatcggtggcatcgctcgccacggcagaggcaccgtcgagcatctcggacagataattcttcagtccgtcatcgccctcaaagttgggcgtgcgcgccttggcatacgtgtcctcgaccaccttggtcgccagcggacgcagcttatacgtcgcgtcacgtgtgatgtagtacacgtagtccatgctgtcgaacgtcgcttgatcggtcgtatccgaaatcacgttgaacatcgaaccgtcgttcatgtgatgaccgtaaatcgtggtctgctgatccaccatgcccggcgcggtgtcgtcgctatccaggaagatggcacccgacgcattggcggtgccgtcgaacagcgtgttgaggtacttggagttgttgttggtctgcaccacggggtagttgatgttggtgccgggcgcgtaaatccaacccacaacctcgggatttgtctgggcaagcgcattgaagtcgataattggcacgccactggcgtccttgtcgctcacatattgcttttcgattttttgatacgactcgctcgcctgcttgtagccaatctgcgcgttgataaagatagcggccgcagcaacgatcaggccaataccgatgatgatgagcagaatgggaatgacggagcggcgatttttgcgcggcggctcggtatagctcgatggcgcggcatgcgccgaagagcgaggtgacttcttggccgtactgtatgacgaagggcgatatgcagcaggtgtatcctgacggcgatgcttcgccggcgtcacggggcgcggcgcacgtgactgctgaggagaggatgtccgaccccgctgcggcgcgcgggccgctcccgacttggctggatcgggaatccgagaagccgaaaaacgctttccctgatagtcggacatggctctccttatgctgcaaatggactggcagagcgcttaagcgtcagccatctcctgcttcatcttctcgacaaccttgcggtactcggggtcgcaggcgcccagaatctgcgtggcgtaaatggcagcgttcttggcaccgttgatggccacacaggcaacgggcacgcccgaaggcatctgcaccatcgacagcagcgagtccataccacccagatcgctcgtcttcataggcacaccgatgaccggcagcggcgtaaacgcagcaacgacaccgcccaggtgagcagccttgccggcagcagcgataatcaccttgatgccgcggtcggcagcggtcgaggcccactcatggaccttcgccggcgtgcggtgtgcgcttgcaatcacgagctcatagggcacgcccagtgcctcgagctcggcggtgcaaccttccataacgcccagatcggacttggagcccatgatgatcccgacaaccggcttctgatctgccataaacaaagacctcctgttgagagcggtgacgcggcggatccgcgacccttaactactgagagtagtatagctgctcccgtccctgcggtctctgtggcgcttcgcgggcgggccaggctttatcttcactccggttgcttcgcaaagtcgttcagatagagcctggcccgcccgcccgcgaagcgccctgcgacctaccggatattgccatgacgtacgttggctgaaataataaagcaatgcccgccgtccttgacggagcggcgggcacgtttgcttagttgtcgctgggactacttagccttgctgcgacgatggaagaaagcgccgatcgcggcgatgatggcgccaagaccaccgacggccgcgacggtcgccgccgtctggtcgccggtattggggatcgccgaaccgctcttcttgctgccctgggccttgtcgcctgcgggcttgcccgcctggttgccgccgtttgagccattgccggaaccctggttgcccgagccgccctggttgccggaatcggcatccttgaggctctcaatggccagcttgagctggtcataggccgcctggagctggatgtcggaagcattctcatcacccaagacgtcctcggcgtaggtaatggcatccgtcagggccttgacagactcgtccgtcttgcccctggtgtcagtctccttcgcctgcttgaccaaggccttgagctgcttcttggtcgggttctcgaccggggtcaccggagtcttctcaagcgcgtcgcgagcactctcgagtgccttgagtgcctggtcgacctcgtcctgcgtggcgttctcgtcgttcaggatggcgcgggcgctcgccaaggcgttctggaacgcggtccaggaagcctcggtgtagtcgctggccttaaggtcgccggctgcaacctcggcatcaaccttttcaatcgcggcagtgaggtcgtccttcgccaccggattgggaacggccgtaccgtagaacttgagctccgccatgctgcagtaggcgtcaacgctgccaccgccggcgtggagcaccttgacggtcacgtagcgaccgcgcgcggcaccaaagctcatctgcttccagtcgccacggtcggtgagcacgcggccgtcgttgtcgaaggtaaacgtacccatcgacgtggcggtgcccatctcataaccgtcggcggtgtcggaaaccagcacctcggcctcaaagatatcgccgttcgtgccgccgtcctggcgcggcaggaacgtgacgtcggtgagatcgtagtcgcggcccaggtcgacggtcaggtactggggcataccggccttataggcccagtcgctgtgccagagcgtctgctcatcgccgtcaagagcgttgacggcgttgctgccctcatagtcggcctcgctcgagaagccggtcaccttgacgttctcgcggttctcgggcgtgttgatgaggctcttctcatcgacggggcgcatcttgaggccgtcgattgccttctcgatcttggccgtggcgtctgcgacatccttcttgctatagctgccctggccgccatcgaggagcttctgagccgcctcgaccgcagcggtgagggctgcataggaatccttggtgtagacggactcgctgtagcccgcggccttggaaagcgctgccatgagcgcagaggtgtcgacaccagccttgacctcgacctcataggatgcggtcttggagggatcgagcaccgacgccaccgtgatcgttgccttgccggccttgttggcgcgcaggtagtagctcacgctatcgccggcctggacagcggagacgctcaccacagaaggatcggagctctcgaccgtcacataggggtagccggcgctctcgggcgtggccttggcgtcgacgagcgtcacatcgccctcgaagaactcggtctggttcttgcccagttcgacaccctcgatggcctcgacaccctgtgtgtagttgaagttgatctcgcgcagcgtgagcatctggtcacccgatgcctcaagcggcgtgatctcgaccttggtcgccttcttgcccttgttctcggcagagaggccaaaggcgtagcgagcctgataggaatcaaagcttccgcccgagaactcctgggtcgagccgtcctcgaacgtcacgacggacttaatcttctgcacggtgccgttgccaccgttgcggttaacgacctcgacgctatcgagtttcgacggcgtcttgaaggcgaacgtcatcgtggcgggcagcttgacgtaggtcggcatcttgccgtcgatccagttgggcccatagttccacaggaactcgaagtcgttgccgccctcattgttgtcgaacagtccgtcatagctcttctgctggatgagcttctcgacgttggtgccgtcgtcggtggggagctcgtcgttggtcatcgtgatgtcaaaggcgtcgcggccgtactcggacttggtgggctgcgggacaccgggcatcgtcacggtgccatcactcacgaactcgagcgcgtcgcacgccgggccgacgagccaagacgtcgagggcagctcgaccttgccggccgtcttagccttgagtttaaagctcgcgaccacaccagtactgttgaagagcttggcgtcgccgcggttggcgaaggccaggttgatggtctggtggccatccgtgaactgcactttctcgcgcgagaggttctccatgcccgccgtcgacgcatcctgcgcgatgctctcggagacatactcgaactggtcgctgttgaagttgacgagcgcaccgagcgcgttgatgttctcggcgtcggtggcgtagacgtcgaccgtgatctcgtcgccggcctcgacctccatcttgctcgggatcaccgcgagggtgccagcagccttgcccttttgcttggtgccgccgtcgagcgccgccatggtgaaggagtagtcgtacacgtcgtagacgccgttgccgttgaggtcggcgaagtgggcgcggatctgggagtcgaacgtcgaggtgtcgggctcgcggttctcaagacccaggtaattcttcatgttggagtagtcgccgtcggagaccgtggccttgttgaggttggagcccacagcgaagccgtccgtgccgtcggtcttgtagatggcgatctcggaggcggagaagaagttgcccacggacgcgagcggcgtcatacgcacgtagcgcgcggccacggcgccgtcgaacgccaccgtcttgcaagcggcggagcgctcccagtcgacctcctgcgtcgtccaatgcacgccgtcgaggctcgtctcgatgcgcatcttggtcacagtgccgttaccggcatcatcgcgcggatagtactcgagcttgtcgagcttgtaagcgcgaccgtagtcaacggtaagcgccttgcccagatcgttgccaccggagtggaaaccgccgtcgcccgactggaactcatggtcgaaggcgagttcggccttatggctaccgtagagcgagccctcccaagtgatttcctcggcctcaggcacgttccgccacgggtcgagcgcagagttcgcctcaagcacgtcgctccatgcggagtagccatcggcgttgcgcgaacgaatctggtaggtatgcttgctgttgtaggcaagatcggtatgcgtgaattctgccgcatcgcccacggcgaacacagtgccgtctaccttaaggtcgtaggaggtagcaccatcgaccttcccccaggtgagcttaatgctcgtgggggtcgtggcgtcctcgggggcagcaaggttcgcgggtgcggagaggttctcgttgaagcggtcggccgcgagcgtggcatcggcgttcacgaaatcgcccagttcgagcgtctgcgctgccgtggcgacatcggtcttcgcgaacttgacgtagaccttgggattcgtggtgatcttggtgttgttgaagctctcgccctgctcggcctcggtgctgcctgcgtcgctaccgtagtggttgaggttgggggtctcgttgtagaagtagaccgcctggccggcctcgggggtcgcggcgtcaaaggcctcctgcgagtcgacctcaaccacgttgagcgcggatccgccgttcttggcggagacgctcgtgggcttggcggagacgttggccacaaaggtcgtggtgcggttggagtcgtagccgctgtagccgccctgcgatgcctcggcggtaaaggtcgccgtgccgcccaccacgctcgacttatagacggtgctcacatgctcaccgtaggaaatattgtcgattgtgccgtaggaatcgtcctcggtcgtgttgttctcgatggaggagccgtcatcctcgtactgcgtaaagctgccctcaccctcggtggcgaagaactcgacgatacgctggctgcgattggtgcccttggtgttggtctcggtcacagcctcggggttgttgttctcggcgtacatcggcacgatggcgttggccttaacaaagagtggcagcttccaaagcggagcctcgtagttgttgaggacctgaccgccgcggtactgcttgcccgagaagtagtcaatccagatggcgggattctcgtcggtaccgtagttgggcaggtagataccgttgcggacatcgttgccgttctcatctgcctgggtatcctgatacaccggtgccaccaggaagttctcaccgaacatgtactggtactgcgtcgaggtgcttgcggcgtactcggagttgtcggaaagcagcatggcgcggatcatgggaaggccggtatcgccgttgcccgtgtcgatgttggccgccgaggccgcgctcgtgtagatatagggcatgagttgtgctttgagcttgagatagaagcgcgagatgcccgtgtatggatcgccgtgcgtcatgggcgacttgcggtaggtgccccaaccgtccatgtcaagcatagagggcgtgaatgtcttccactggtagtcgcgagcggagatgatgggatcgccaccaaagatgccgtccatatcggagccgatgttggggttgcccgagaggctctggccgatatacgtggggatatggaagcgaatgtactcccagttaccgccgtactggtcgccggtccagatgccgccaaagcgctgcgtgccggcccagccgtcaagcgtgatgatgttggggcgcttgttggcgccggtggtcacggtgtcataggccgtcttgatgccgttgaggccaaaggagtagccagagcccacccaagcgacgtcggtcttgagcgtggtgatgccaccagtcttaacctcagaatcgaaatcgcgcagcagatgccacggggtctcggagttgctatcgggctcgaggttcgactgggtccagagaccggtgctcacgcccttggagttggcatactcggtgaacttcttaagattgtcgacgttggcgcgcacggcgttgaggcgctcggcagaactcgttccgtcggagttgacgccgccggtcttgtagtaaccgttctggccgtagccagcaccgtaaccgtcgttcggcaggaaccagccgagcggcatgtcgttgtcctcgtagtcatcgataacctgccgggcggagaactggcggtcgaaatcggtcgccttcatgttctcggtatcaaccgtagggccctcaccgttgagcgtctcggccgcaagcgtgccgtcgagcttgtagcccgtcgacatgccggactcgtatttaacgtcgcccttctcactcgaggacttgctgcccttggtctcccacttcttttgacccgaggtcgttgaccagccatcacggttataggcattaagatgacccaggtagaaaccgtactcgggcagcagcaccggattgccggtcaccttgtagtagtcctgcagcatctcggttgccacgttcgaggcgccctcgttggtcgccacgaagtaataggcatcaaactcattctcgctgtgcaaagtcgtgaccgtcgatgagtccgtggaaccgaagtcgtaggaaccctctgcaaacgtgtttcggagcacgccgtagccgtcgctcgtccaatagaacgggttgggcgaggcaacgccgccatcggtccagttgttagtgttggagatggcgatggtctggttggtgtgcaggaagcggccgttctgggtgccgccgccaaagaagttctcggacttctccttggcgagcgtctggacggtacccttcttatcaaggtcgaggggcgcagactcagaaaccacgccacggtcgcctgacttgatactcatcttgccagtcgccttgtccaggatcacggtcgcctttccgccggtgatctcgatagtgtcgcccttgtcggcaaccgtcgcactcggcttgctgtaggtgtccgaggtatcgggctgagcctggatcttagccgtgtgggacttactgcgcggcgtggcgtactcggaaaactcacccttggggtcgacgttataacggaaaataccgtcctcgaggaacgtaatacggcccttgatgccgtcagcgaaatcgatgtcgacgacgttcgaggcagactgagacacggtcgctgagtcgacacccttgagtggcgtggcaatcgcctgctggggattggcaaacacaagcgtcgctgcagtggcaacgaggaccgcgcttcccttcacccaccgtttcgtaaaaatggaattcctacgcacctggactccttccctccgacatgcggaagtgtcgcggacgcgcgccccgcagcatgggcgaacgcatcaaacgggggggggtgttcggtacattccgtacaattggcccacccgttaccaaggggtcaactggtagtaaccagatagccacctataaggttggaccagtatacgtgagcagttgcgcaaattaagtttggaattctcccagcggtataaaaatgaacgtagatggcgaagtgggtctaatcaaccataccaattggttctccagccagataccacttaagcatagttttactgtttaactggtattacataaccaatacctttcctcggaaaacgggcttcgcgaattatcctgagggaaagtcgtagccgccaccccgcgacccaccgggaatatccatgacgcacggtggctgatttgatttgaaataggaggttgttggagggtggtggacagttagttcagatacgtatattttggcggtgctaattggcgctaacaaactggttttaagtcgctttagatctaataataggtctttctcgctattgcccgcgcggccttgtcggtccagactatcaaaaatagctcaattgtgcccaaattggcctccacacgtcctctgaaaaatacgtatctgaactaactgtccaagaggaatgtccacagatagaaaaaggctctggcggacctccgaatcaccagagcctttcaaaactcgcacacctgaagcacatcgctgcattcctgttttcgcccatgaagttagagagcctcttccgcccacttctcgaaatcaatcgcacgcctttgggcggttcggtacgcttccatgtcttcacgagcgcctaccactacgatggccatttttcctttgattttaatgaggcggtacacaatccgaatgccacttcccctgagcttgattttcatgaagcccgtcaaatccgtgcctgccttgtttccaagaggcttgccgaatccgccttcgttctgcggcaatgggttcgttctgattctttctatagccttaaacacgtgttttcgctgggaaccatcgagacgcttgagatccttgagagtatccgggtagaaagcgacttcgtacccgctcattcaaactcgacctcatccatctgatcgagttcgtcctggcccacacccaactctgccataacatcagatagggaaacgagttcatcatcgcttgtcgcagccgtcctcttaagggccaacgtcaacaaggcgaggtcctcctccgcctgcttagcctctcggtattcatcgggcgtcacgataacgaacgccggcttgttgtgtttcaaaactacaaccgggttgtcgttgctcactctcgaaaacgcagcgggacccttaccgtgactgaaatcgctgatgggaacaagattgtcgagcatctttaaagcaggcatcgagacctccaaatataaagtcttttatgcattcattttagcatgcagaaaataccagcaatcacggaatagtggcacggacgaggcatcgctttccaccaaccgttgatcatcgaccgagcaaaatgtcccgccaagagatcgagcgaggattccgtccctcgaagagggccgtattggcctcctcgcgggacggaatcctcgctcgttcgttccagcccgcgtcatcgcgtgctagacggccagctcgcctgattcacccataagccatcgtgccaggtcgacgaccttgatgccatcccaatcagtcgtttcgtgccctgttcgggcgatgacgcacttgggataggcgtctcgaatccgtcgcagcggatcaagctcacgctcaagcgtcgcttcttgggaaatgtcgtcactcacctggatatagacacggcggtcacgcctgatggcgacaaagtctacttccttttggtagagaacgcccacgtagacttcccatccgcggcgcataagctcgattgccaccatattctcgtaaacatggccaaaatcgagctttttcgtaccaagcgcggcgtagcgaaacgagtggtcggccaggtagtatttatctcccgtcgacaggtatttctttcctgagacgtcaaagcgacgaaaccggtagaacgcaaacgcatcacacaggtagtcgatatacacagccagcgtcttgtcgcttatcttaaggttcgctcgtgacagctcagccgccatccccttgagagaagagatgtttccgacgttatccatcaggaactcgcaggaacgtttaagctgctccgcattacgtatacgatatttttgtctgatgtcgcgcaggataagagtttcaagcacatccgagatgtatgagaaacgcatcctttcgtcctggtagatataggaacccggcattcctccctcgcggacatagcgagcaagggcctcggctggagaagtgatctcgtgatacgccgagaactccgcaagtgaaaacggaaagacctcgatctccaccgttcttcccgtgaacaacgtcgagaggtcgcttgagagaagaaaggcattcgaccccgtgatgtaaatgtcatatttctctgacgcatgaagactgttgatagcccgctcgaacccttcacacatctggacctcgtcgatcatgacgatattccggcaaccctcgatataatgcttttccacatatgtatgcagcgcatggtattccgccaacggctcgaactcaagtagattgaagttgacgtgtatgacgttggccgaggggtcgtttgaacgaagttggctggcaaacgcctcaagcaatttcgattttccgcatcgcctgattccggtaatcaccttgatgtctggcgaacccgccaccttggagagcttatccatatagaacggtcgattaataagtctcatggcaatccacttcgcaaaattaagattaactgaaaaacgcgaagtacaatatatcatctacttcgcgtttttgagaaatcctagatttcgcgtaattatattcgccaagctatcgcaaacccgacacgggtgagatctccgcctgattgaccctgcgcagcagtccgaagcgaaagacgcgagtcctcagaccgctccggtaaagtgagggccgcgacggttaccgcggccctcttgggaaacgtgtgcgattgtcaatcgctcgcgctagtcttccttgcggcggaaacgagcaaggaagactccgattgcggcgatcgcggcacccaggccgccgatcgcggcgacggtcgccaccgtttgatcaccggtgctcgcaagtgagttagcggacttgccaccctgagccttgtcaccagcgggctttcccgcctgggcgccatcgttcgaaccgccggatgtctgcccaccgttgccggaaccctgattgccaccggacgcacaaagccccttctgcagcacacggcacaaccaagtcaccgcaggccggggcgggggagccgagtttcccactgagcgactctgcttgcagccggagcgaagggggaaactcggcccccgccccggccggacaggtcaccccacaccgtgtgctgcggcaggtcctgcagggcgatgacgtccatgcccatgtcgttggcgctgccgtgaccctgctggtcctcgcgcacggcctcgatggcactcacgtacgtgttggcggcagacatcgcggtcacgcaggtcacgccgcggcgcacggcctcggtgcgcagcagataaccgtcgccacgcgagcccgggccgtatggcgtattgatgatcaccgcaatcttgccatcggcgatgaggtcgccgatgttgggacgctcgccgtcgtgcgggccgctgatcttctccacaacctcgcaggtcacgttgccgccgcgcagcacgcgcgccgtgccctcggtggagcagatgtcaaagcccaggtaacgcaggatacgcgcgaccgaaaggatatgacgcttgtcgcggtcgcacacgctaatgaacaccttgccggcgctcgggtcgggcagcttgtagtcaatcgccagctgcgtcttggcatatgcctcgggatagctcttggcgatacccatgacctcgcccgtagacttcatctcgggccccaggataacgtcggcgcccgggaaacggccccagggcataacggcttccttcatgcagaaccagtccagctgacgctcgtcgctcggcaggcccaggctcgcgatggaatcgcctgccatgatacgcgccgcgcacttggccagcggcacgccggtggccttggagataaacggcacggtacggctggcacgcgggttggcctcgatcacatagacggtctcgcccttaatggcgtactgcacgttgaccaggccgcgtacgcccagcgccatcgcgatgcggcgcgtagtctcgcgaagctttgcctgcaggctctcgctaaagctgaacggcggaatgcaggtcgcagagtcgccggagtgaataccggcctcctcgatatgctccagaatgccgccgatgtagacctcttcgccatcgcacagggcgtcgacatcggactcgatcgcgccctccaagaagcggtccagatacaccgggtagtcggggctaatgcgcgcagcctcggccatgtaatcgcgcagatgctcggcatcgtaggcgatcatcatgccgcggccgcccagcacgtagctcggacgcaccagcagcgggtagccaatatgcgcggccacggcctcggcctcctcaaacgaggttgcctggcccgccggcggatacataatgcccagcttgtcgagcagggcggcaaagcgctcgcggtcctcggcaaagtcgatggcatcgggcttggtgcccatgatgttcacgccgctctcctcgagcatgcgcgccagcttaagcggagtctggccgccgagcgtcaccacgacgccgtcgggtcgctcaacatcgatgacatccatgacgtcctcgtaggtgagcggctcaaagtacagacggtcggacgtgtcgtagtcggtcgaaacggtctcgggattgcagttgaccatgatggtctcgaagccgcgggccgccagcgcatagctcgcgtgcacgcagcagtaatcgaactcgataccctggccaatgcggttggggccggcgcccaggatcatcgccttgggcttgtccgccggcgtggtctcgtcgggagccacgcacttcttggcatccgggctcgtgcggtagatgttctcgtacgtcttgtagtggtactccgtggcgctcgagaactccgcagcgcaggtatcgaccgtcttcatgctgggaaccacgcccagacccttgcgataggcgcgcacaaagcgctcgtccgagccggtcagcgcagcgatctcggcatcgctcgtgccgtactgcttgagcaggcgcatcgcgtcggcgtcgatatcctccacacgcaggccgcggatgctctcctgaacctgcaccatgtcgttgatgcggttgaggtaccacgggtcgatgccgcagatggcatggatgcgagcgatgtcccagccacggcgcagggcctcgaccacaaagaagatgcggtgctcggtcggcgtggccacggcttgagcgagctcatcgtcgctcagcttatcggcaccctccttgccaccggcgcagataccctggtgaccgtcctccagcgagcgcatggctttgccgaaggcctcctcaaaggtgcggccaatcgccatgatctcgcccacggccttcatgcgcgtggtgagcgtggggtcggtacccttgaacttctcgaaggcaaagcgcggcaccttgaccacacagtagtcgattgtgggctcaaaacaggcgggcgtagccttggtgatgtcgttaacgatctcgtcgagcgtatagcccacggccaggcgcgcggcagccttggcgatggggaaacctgtggccttggaagcgagggcggacgagcggctcacgcgcgggttcatctcgatgacgatcaggcggccggtgttggggttcacggcaaactgtacgttggaaccaccggtctcgacaccgatcttctccaagatggcgagcgaggccacgcgcatgcgctgatactcaaggtcggagagcgtctgcgccggcgccacggtgatggagtcgccggtatgcacacccatggggtcgaggttctcgatggagcacacgatgatgccgttgccggcgtggtcacgcatgacctccatctcatactctttccagccctcgatggactcctcgaccagcacctcgtgggcgggcgagagttcaaggccctggctcacgatggagacgagctcctcgtgggtatgcgcgatgccgccgccggcgccaccgagggtaaagctcggacgcagcacgcagggatagcccacgcgctcggcgatggcctcggcgtcggccacgctgtaggcatagcccgagcgcgcgacctccaggccgatctcggccatggcctcgttaaagagcttgcggtcctcgccgcgctcgatggcggcaaggtcacagccgatcatctcgacgccgtacttgtcgagcgtaccgtctttcgccagctcgacggcggcgttcagaccggtctggccgcccagcgtgggcagcagcgcgtccgggcgctctttcttgattacgcgctcgataaactcggcggtgatgggctcgacataggtacgatcggcaagacccgggtcggtcatgatggtcgccgggttggagttgaccaggatgacctcaaagccatcctccttgagcaccttgcaggcctgggcgccggagtagtcgaactcgcaggcctggccgataacgatggggcccgaaccaatgacgaggatgcgcttgatgtcagtacgtttaggcatattagttctcctcggtctcagcggtctcggactcagcaaagttccagccggcaaggcggtccttcgcggtgtcgatgtccaggtagttctcctcgccgtccatgagtcgcgtaaaggcggtaaagagatagtgggcatcggtggggccaggcgaggcctcggggtggtactggaccgagaagcacggggcgtcgagcagctggataccctcggcggtgccgtcgttgaggttcacatgtgttaggcgaatgcggccaaagcgctcgttcatcacgaccggcgcgattccgcggcgcacccagacgcgcagatctccatcggccgcatgctcggtctcgccgccggaaagctcggggacaagcttgcccaggctggggaacagcaggccaaagccatggttttgcgcggtaatctccacgcgacggcttaccaggttcatgaccggctggttgccaccgcggtgaccgaatttaagcttttccatctgggcgccgcaggccaggctgatcatctgatggcccaggcaaatgccaaagaccggcaccttgccgatcagctgctgcacctgctcgtaggtctccaccacggcgtcggggtcgccggggccattggacaaaaagacgccgtcgggattcatgtcgagcacctcactcgcgggcgtgtcccacggcacgacggtaaggtcgcagccggcgcggaccagcccctccagaatgccgcgcttcacaccgcagtcgtaggcgaccactttgtgacgggcaggagcggcagtcgaaagcgcaaagtcatgcgtggcaggcaggtcgacggcggcaaactcgtgaggcgcggggcaacttacggtcttgaccaggttctcgcctaccagcgcgggcgctgcggccagacgctcggcaagctcgtcgacatcgaagatctcggtcgagataatgcccatcttggagccgttgtcgcgcaggtggcgcaccagggcgcgggtgtcgacgccctcgatagcgacgatgccgtgtgcacgcaggtactccggcacgctgacggccgagcgccagttagaaggcgtggcgcacatgtcgcgaacgatcatgccgcgcatagccggagcgctcgcagggcgcacggcgtcgccggggaaggccgactggacgtcggtctcgtcgataccgtagttgccgatctgcggataggtcatggttacgatttggccggcataactcgggtcggtcatgacctcaaagtagccctcgagcgaggtgttgaagcagacttcgccggtcgcggtgccctcggcgccgcatgcacgtccataaaaaatggtcccatcctcaagatacaggatgcagggaccgcaggtgcccttgctggttttggccagcatgcgctggcaaagctcgctgggcgcgaaggtgcgggcggcagcgcccgcggtatggttgttcgccataattctccttcccggtctcacaggaccggcttaaaggtgtgtagttaggcctcgcggtattgtaaccgcaagcatgcctcatggcgttaatttcatcgaaatgtttacgaaatgataattatgactttctatgcataatgatttttctgggacggggattaaaaaatcattctgagagcagagctttgtcgccaactgcatacatgacagaatgattttttaatccccgtcccagaaaaatcatcccgcgaggcttgtggctcacgcgggatgatgacgtcttactttctcttgtcctgctccagcagttcggacggtgtgcgatcgggcttgccgccgcggaaaatctcgcggccatgcagacgatgttccaggtcacgctcggccttttcctcgtcaatcttggtctggctcaccaccgggtcctcaatcaacgacgacaccgagttcacctgcttctgaatgcgctcggcgatggtgtcatccatactcacgatgcgcatcttccagtcgatactcgtggcgttggatgagctcttggtccacacgaacgtcaaaatggcgctctggtggccccgcgcggggaacatgccaaagaaggaatcgtgctgaatgttgctatcctcgtcgatataggcgtgaacgttatacaccacgcggtcgatcttgtcgttgagcagcgcgttggtcgcaagcgccgcggcctggatctgcccgttggacagcagctcgagctcgttggcagacgatgtgtccaacaccgtcacctcgaccgtgcccgtacgctcatcggcttcatcgacggtaaagtcgagcgggaactgcgtaaagccgttgccccactcgagtccacccttgagtgctgtagaaacggtatcaaccgaaacgctctcggacaggttggcggtattcagacggcgcatcacgccgtagccgatctgcatgcccacgatcagcaccaaaataccgatgaccacggccatcgcggtcttcgtaatggtatggctcacctgcgagcccgaaggatcgtcctcggacagcgggtcgatatgttttgcctggctcgcgcggtcctcgctgcgcagctgtgctagcgccgctttgtcaccgcgcttggccgcagcctccttctcacgcatgcgctcggtacgctttttggcgagcgtgggatccaagacgccggatgcatcgatttcggagaataactccgtcacttcttccggagtcaaagggttcttgtcagccataaacttcctgtcatatcaatcagtcgagctcgtgcgcacgcgcaccttcgaactgcattcgatagtaacgggcataggtgccgccacgggcgagaagctcctcgtgcgtgccacgctccacaacgcgaccatgctcaacggtcgcaatctcatcggcatgcttaatggtcgaaagacggtgggcgataataatcgtggtgcggccgcgtgccagctcttcgagtgactcctgcaccgcctcctcgctctcgttatccaaagcactcgtcgcctcgtccaaaatcaggatcttggggttcttgagaaacacgcgcgcgatggcaacgcgctgcttctgtccgcccgaaagacggctgccgcgctcgcccaccacggtgtcgtagccctgcggaagcgactcgataaaggcatcgatgttggcgcgacgggcggcctcggcgatctcttctgccgtggcgcccggcttgccgtaggcgatgttctcgccaatcgtaccgtcaaatagatagacatcctgctgcaccaggccgatggcgcggcgcaggctctgctgcgtcacatcgcgcacgtcctggccgtcgatgctaatggatccggcagccacgtcataaaagcgcggcagcagcgaacaggtcgtggacttgccaccgcccgaagggccaaccagcgcgatggtctgcccgggcttgatggacagattcatatggtcgataacgggacgctcgtcggcatagccctcgcccagctcgacatcctcgtagttaaagcacacgtcgtgatactccacggcgccggcagtcacctgcagatccgtagcgcccggcttgtcctggatatccggcgcggtcgagagcacctcgtccatacgtttaaagccggcgatagccttctgatacgtttcggccgaattgacgagcgtctcgagcggcgtgcagaacagcgaaatatagagtgcaaaggtcgccatatcgaccgcctgcagctgtccctgggcgaccagccagccgcccagcagcaccacgatcacatagagcacacccgagagcaggccatacgtcgcggtatagacgcccatggcgtgatacatgttctccttggacgaaaggtagcgatcgttagaggcacggaacttggcgcgctcggtctcctcgttggcaaagctcttgactacgcgcatgcccgcaagcgaatcctgcagctgcgcattgatgccgctgatctttttgcggttgtcgctaaaaacctcgcgcatacgcatgttctgccaaaacatgatgaccgcaaacgccgccgtcaccacggccatggcgagcgccagcaccggggcaatggtaaagaggatcacaaacgagccgatgatctcgatgccgcagatgatgatccactcgggcacgtggtgcgccgcctcgcagatatcgaacaggtcgttgaccacgcggctcatcatgtcgcccgagctgttgcggtcgaagtatgcaaagctaaagcgctcatactggtcaaacaggtcctcgcgcattttggactccatacgcgcgcccatcacgtgaccccaatagctcacaaaatagcggcaggcgcagcggacggcatacatcagcaccaagcccaccgcgatcatgccgagcgcctgcataatagcagcctgaccctgagtaaacagcccaccggtcaaattgcgcaggataatggggaacgccaggtcaatggcggcaagcaccagagcacaaacagtatcagcaacaaaaagccccatctggggctcgtaatacgaaagaaacctcttaaacatgtgatcctcaaagaaatatcagcaacataaggccctgggacaaagtaatcagtagttcttgtcccagggctattcccgctcgttacagctcggccccacccaagcggtgcgcgatgctatcgcaggccaaggcgcccacgacggtcttggcgtcttcgatcttgccgtcgagcacggcgtcgatcagctcgtgcagcggcacgaggtccacgttgacaaactcgtcatcatcggggttgggtgcatcgaactcgagcttggtggccaggtagatgtgaatgatctcgtcgcagaagccgcaggacgtgacaatcgacgtcaaaaagcgaatgcgaccggccctaaagcccgtctcctcatgcagctcgcgcttggcgcaatcgagcgggtcctcgcctggatcgagcttgccggcgggaatctcgaccgtcacgcggtcgatggcggtgcggtactggcgcaccagtacgatcttgccgctctcggtcagtgccacaacagccgccgcacccggatggcgaacgatatcgcgggcgctacggcgaccgttgggcagctcaacctcaagacggtggacgtcgaggatcttgcccttccaggcgcactcctccgaaagaatcttctcgtgcagctcggcatcgtgcgggtcgtcatcgcccagcaccagcgccggctcgtcagcgacctcgccaccaggctcgccctcggcgtgcccatacacgcggctgtcctcttcgacgatctgcgcgtccacgagctcttcgttcttctcgtccatccgtctcattcctctcggattttaggcatcccaggcgtcgcggccgcgcagcgcgcgcaggccgatgtcgtgacgcagggtcttgccctcaaaatcaatcttctcgcaggcctcgtaggcaaggttgcgagcgttctcgaacgtgtcgcccagagcggtcacggcaagcacgcggccgccattggtcacgagctgaccgtccaccacggcagttcccgcatggtacacggtcacgttctccatggcctcggcatcctcaataccggtgatgacctttcctttctcgtagctgccggggtagcccgcgctcgtcaggacaacggccacggcccactcgtcacgccagtcgagctcaatctgatcgagctcgcagttggcacaagccagcatgacctcgaccaggtcgttcttaaggcgcggcagcacgacctgcgtctcggggtcgccaaagcgggcattgaactccagcaccttgggaccggcgggggtgagcataaagccgccgtacaggcagccgcggtagtcgataccctcggcagcgagctcggccacggtctgctccatgaccgccaccatggtggcgtgctcctcgtcagtcacgatgggcaccgggctgtagacgcccatgccgccggtgttgggaccaaggtcgccctcaagcgcgcgcttgtggtcctgcgaggtagccatggggcgcacggtcttgccgtcggtaaaggccagcagcgagcactcggggccggtcagcatctcctcgatgaccacggtgttgccggcatcgccaaaggtgccgccaaagcactcgcgcacggcttcctcggcctgctcaagttcggtcgccacgataacgcccttgccggcggcaaggccgtcagccttcacgaccagcggggcgccctgctcgcgtacgtaggcgagagccgaagcctcgtcggtaaacgaaccataggctgccgtcggaataccggcgcgctccatgagctgcttggagaacagcttggagccctccatctgggcaccctcggcacccgggccaaagcagggaatacccgccgcgcgcacggcgtcggccacgcccgccacaagcggagcctcggggccaattaccacgagtccgcatccgtggctctgcgcaaacgccgccacggccgcaggatcgcagtcgtcgagaacaacgttctcgccgcagctcgcggtgccgccgttgcccggcgcgatgtagagcttgccggcgcgcggtgatgctgcgagcttagctgccaaagcatgctcacggccgccgctgcccaacaacaggatgtcgatggtttgagtgtccgccttcaagggtgcctcctctatggatgaatggcccgctccgcgcgagccctttgcaagcaaatatacccctcggccgcccgtccgggctgcaaaggggtatatcgcaataaccaaatagtcccgattacttccagaatcggttgatgatctgctcgcgaccagcgccaacgccaatgaacgtcacgcgggtgtgtgccagatcctcgataaacgccacgtagtcctgagcctcctgcggcagctcctcaaagctgcggcagccggtgatatcgcacttccagccaggaagctcctcgtagatgggcttggcgtgctcaaagcgaacctgatgctcgggcacgctggtatagcgctcgccatcgacgtcgtaggccacgcacaccttgatggtgtcgaaagccgaaagcacgtcgagcttggtcatggcgatatcggtgaggccgttgacgcgcgaggcgtagttggcgatggggccgtcgaaccagccgcagcgacgacggcgaccggtggtcacgccgtactcgtagccctcctcggtcagcgtgtgaccggcctcggactcataggaaagctcggtgggcatggggcccgaaccgacgcgggtgatataggccttcatgacgcccagcacgcggtcgacattcttcataccgacgccggatccggtgatggcaccgccggcggtgcagttggaggacgtcacgtacggataggtgccgtggtcgatgtcgagcagcgtcgcctgggcgccctcaaacagcaggtccttgccctcgtcgatcatgttgttgagcagcaggctcgtctcggtgatgtagggacgcaggcgctcggccatcggcaggtactcgtcgcaaatctggtccacggtgtaggtgggcaggttgtagatgagctcgagctcggggttcacgcgggcgagagcggtctccagcttgtcgcggaacagtgcctcgtccagcatgtcctgcatgcgcaggccgatgcgagccatcttgtcctgatagcacggaccgatgccgcgcttggtggtaccgatgttcttcttgccgagcttctgctcaaaggcgccatccagatcgatgtggtacggcatgatgacatgcgcgttgccgctaatcttgaggttcttggtggtgatgccgtcggcctcgaacatatcgatctcctcaaggacaaccttggggttgacgacgcagccgttaccgatcaccgacacgtggtcggaatacatgatgccggagggcacctggtgcaggccgtacttcttgccgttgacgacgatggtgtgaccggcgttgttgccgcccgagtagcgcacgacggcatcgaagtcgccggcgaccaggtcgcaaatcttacccttgccctcatcgccccactgggcaccgaccaaaacggttgacggcatgtttactccttacattcatggactgtctacgcgccacgccggcacgcagaagcacaaaacattcccagtatacccgtgcaacgggcgcctgtcctactcctcggcatgtgccccatcaagctcatagaacttggtggatgccggcaggaacatcaggtcgacgtcgccgatcgggcccgaacggttcttggccacgacgatacgcgtaacgccctcgtcgggtcgatcgtcacgcgaggcttcggcctcgtcggcggagcggtccaagaacataacgatatcggcgtcctgctcgatggagcccgattcacgaaggtcggaaagctgcgggcgcttgccggtacgggattcgacctgacgcgagagctgcgacagcgcgatgagcgggatcttgagctccttggccatgatcttcagaccacgcgacatctccgaaacctcgacggtacggctctcggaacgacggcccggcggaggactcaccagctgcaggtagtccaggatgataattgccttctccttgttatggagcatacggcggctcttggcgcgaatctcggtcactgtggtgccgggcgtatcgtcaatcagaatatcgagcttagacaaggtctgcgtggcctcgttgatattggcccactgctcggggctaatgcggcccatgcggaagtcactgatcgagatcatggcgtaggcgcaaatcagacgctgggcaatttccttgcccgacatctccagcgagaagaagccgacggtataaccagcagcggcagcgttgagcgccaggttcagagcgaacgacgtcttacctacagcaggacgggcgccgatgatgatgagctggccctcgcgaaaacccatgagcatgcggtcgagtgacggaaagcccgtgggcacgcccgcagcctggccaccggcctggcacacttcctcggcctcgttataggcctcgaccataaactcggtcaacgtcttgtagctcgacttgacctcgcgcgccgtaaccttgagcagcttgctctcggccagctcgacaacctctttggtgtcggtgggggcgttatatgccagcgcgttgatctcgttagtggcgccgatcagctcgcgcagcatcgagtcgcggcgaacgatggcggcatggtgctgccagttgacgagcgacagggtctgacccatcaactccaaaatgtacgcctcgccgcccacggcatcgagcttgttgatgctgcgcaggtaatcgatcagcgagatggagtcgatgggaatgcggctgttgtacatatcgaccatcgcagtatagatggtcttatgaatgggccggtagaagtcatcgggctgcagctcgacctgggcctcttcgaccacctcgggcgatagcagcatagcggccagtacattggcctctgcatcttggttttggggaagacccaactttgagccgcggtcctcgaccgtcagcccgatctccctatcgtcatatgccatgagcatcctcattcatatcgcttgcgagcatccatagtatcagccacggtcccaaaacgcgccgcgcgcggccaatcatcaccgaaccaaacggatgaacggtcccacgaatagacctcaccgcaacgccctctatggcgctcgcatcgcgctaaaaagcaaaaagggcgccctggtttcccagagcgcccttcttagaacaagattgttgcgttgcagcaaatgctactcggcagcagcctcagtctcgacctcggcggtctcggcctcggcgacctcagcggcctcctcgacctcagcctcggcagcgagctcctcggcggtaacgccgacgagaacgacaacctcggccttgatctcgcggtacagcgagatggcaacggtgtgggcaccggcaaccttgatgggcttaccgagctcgacgcgcttgcggtcgatgtccataccgagctgagccttgatggcatcagcgatcatagcggcggtaacggagccaaagaggatgccctcgtcgccgaccttgacgtcaacggtgaccgtcttgccctcgaaggcagccttggtctcgttggcggtagccagacggacggcctcgcgcttggcgatgttgttgcgacgctcgtcaagctgcttgaggttgcccttggtggcggcaacagcgagcttcttggggaacaggaagttctcagcgtaaccctgagcgacctctacgacgtcaccctcgccgcccttgcccttgatctcatcgagaagaataaccttcatgatgcgtctcccttcttagccgcggtcgcggttgccacgagaggaaaccacggggacggtgtacggcaggagagccatctcgcgggcgcgcttgatggcgttggcgatgtcatgctgatgctgcgtgcaagcgccagtgacgcgacggggcttgatcttgccacggtcggtcatgtacttacggagaagctgagtgtccttatagtcaatgaactcagtgttctccttgcagaactggcagtacttacgacgcggctgacgtgcagaaaaatcattagccatgtcaaaatacctttcatttggcaacttcggcgaaccgaagccgcctctcactcaaaaataggtgaacaacccttagaacgggatgtcctcatcgtagacgtcgaccgcgggcggcgtggccaccggtgcggcaggacgtgctgcgggcgcgggagctgcgggggcgtaaccgccctgatcgtagccaccctggccaccacgggagctcataaactcgatctcatcgacgatgacctcaagtttgctccggcgctggccgtcgcgctcccaagagctgtagcgcagcttgccctcgatcgcgaccttgtttccctttgccaggaaacggctcacggcctcggcgcgggtgccgaacatggtgcagtcgacaaagttgggatagtcctcccactcgccagtctgcgcgttgcggcgacgatcgttcacggcgacgccaaaggacagaacctgggttccgccggcggtggcgcgcagctcgggatcgcgggtgaggttaccggtgatgttcactcgattgatgctcataactcactacttcctcttggggcacaagcccagtccaaaacgacagtcttactcctggtcgtcgcgacggacgatcatgtggcggaccacagcgtcggtgatgcgcaggacgcgatcaagctcggcgatctgggtaggatctgcgtggaagttgatgagggtgtagtcaccatcggtgaggtcgttgatctcgtaggcgagcttgcgcttgccccactcgtcaacggagtcgaccttgccagcgccctcagcgatcgtggtatcgatacgcttcataacagcgagacgagtctcggggtcgagcgacgggtcaacaaagaacagcagttcataagccttcatattgtcacctcctctgggcaaatgtggcttcaggtcgtgaaggtgcgcctgaagcaggaaaagacttggtaataatatctttcaacctcctaggctgcaagaatttgcagctacaacctcatgacctccacatatgcccatactcgcacgacgtttcatgcgcattccaaccaaatgcttaccaaaagcttgacgaatctgtggacacgatacggtgccgtggggacgagctgagccaagccgcaggtcaacgggcacaaggctgtggtcgcaaaatgcataccagcggtccacagcaccaccaaaagatttttaaattcattgccaagtcgcttatgaataccccttttgaacaattgagttgatcaaccacgctggtcggaagccgtttttttggcacctcaaaccccactgcaacgccaagcgcggccgagcgttttaaaaaatgccaacttttctgtttgcactttgcgattcctcgtgtatactgactttcgcatttaacggagagttgtccgagtggccgaaggagcacgattggaaatcgtgtaggcgtcaaaagcgtctccagggttcaaatccctgactctccgccagttaattccaaagcaggccttcgagcctgctttgtttttaccccacgcggaggggtggcagagtggttgaatgcggcggtctcgaaaaccgtttggcctgtataaggtcacgagggttcgaatccctcctcctccgccatttagattgagaaagctcccggtattgggggcttttttgttatcgaatcctctcttggccgcacgtcccaaccaaccatgtacatcaccctccaaaaacgacatttttcgacatctttggaggctgatgtacacctttgcatatcgcgctcggcgcacgattggccattttgccagcattcggtatatttcctcacttcaacggacataaggactgcatatcggcataaagcgagaggtccctaatggatactcctgttctcatttcgcataaaacggcatggctcgtccatcatgcaccgcggaacctggttcaagccgtcgcacaacgcgactaccagataggcgtgcggggcctctctacccagcaacgcatcgcgcgcattcggcaggcacttaccgactgcggcattccgtccaccatgctcaagactatcgacatctccgtagtatttgctttcgagcgaattcgcaccaacggtgtcacttgccacgttctcggccaaaacctaccctacgaccatattgacgagcttacgcccggcatctttatcaccgacgaagccttcaccttcgtgctcgctgccgagtggatggataggatcgaatacctcgagtatggttacgaagtttgcggcgactatcgcatggggctcaatccctctgacccttacaccgagcaaccagccaccacctccaaggacgaaattgtcgagctactcgatcggcaccctggcaaacccggcgccacacgcgccagactcgcgctcagacacatctacgaccactcagcctcgcccatggagaccgcatcgtccatcgccctctcgctcccaacaagcgaaggcggcgttggcatccgaggtatcgaactcaacaaaccgctcgaaatccctcaacgtctctggcattgcacaaaagcccgatcgctcaaaatcgacgctcttgttacttatcagcgcagagaactcggcatcgaatataagggcggttttcacgacgagaccgagcgcaagggcgcagatgcggaacgagaggccgtactcgtccaaatgggatatcgaatcgttacgctcacctcggcacagttcgcaagtcaacttgcctttcatcgcgccatgaacagcattcgcgaagcactcggtatgccccgctgcacggacgccgagtaccagcgaaagcaaaacgaactgcgcaaggcacttatccgcaactggaagagcgcgcagggcgaagacacaccttccgagtagcgtcttcccagcacaccccaaccaaaacatgtacaccaccctccaaaaccgacattatttgacatctttggaggctgatgtacacgtttggtgcctacgcccgcatccagtcccgaccgtttaccgagcaatagggtcgccaggcccgccaaccatgtactatgtacgggcattgtctaaacccgtaactcaaaggaccccatcttgcccgttgccgccgctatgatcgttaccgcacacgcctcggatgccatggttgccatcccgttttggctcgagatgttcgctgttgtcgctgcatcgatctcgggtgtgctggttgcgcgcgagcacaagctcgacctggtgggcgcggtcgcgctcgcggtggtctgcggtctgggcggcggtcttttgcgcgatatgacgctccaggtcggcaacgtctacatcctcaaccagccgatggcgctgccgctttccattgccacggcagccatcatctatattttcccggcaatcgtcgacaagcccgaaaaactcattcccctgctcgatatcatctcggtcggcatctacgccgccaccggagcggacaaggcgcttgtctacggctttgcgccggcggtgtgcatcatgatgggctttttcaccgcggtgggcggcggcatgctgcgcgacggctttatgggcgtggttccgggtattttccaacgtactaacttttatgccatcgccgccatcgccggatcgacaagctatgtgtgtctcgttatgagcggcatcatgagcaatgtcgccgcgctggtcgtatgcgttgtcgtgaccatgggtctgcgctggctctcgctgcgctttgacatcaaaagccccaccgaagaagatatcgcgcgcttcttgcaccgtaaaaagtagacagcacggcacgacccttcgaaatgcaaccgagaggttcttttagagcgcccacgcgttgggtaccctgttagatatatgccgagtatctaacgaaggattcactatgccctgcaatcaattcccgttgacccagcgccgtaaagcatggggccgcatcaccatcctattcgcgctcatcgcgctggcgatcaccgtgcttcccacggcgtcgttcgccggcacggacaccgcaggcaacgtacttgcgaccgacaatgacgccaatccgtccggcgttgagggtgacctgtactgggccggtcaggccctcaacttggatgatgtgtccatcgaccgcgatatcatcgccgcgggcgataccctctctatccgcgactgcacggtgggtggcgccgtccgcttggcggcacgcactatcgatatcgccaagaccacggttgacggcagcgttacggttgccggccagcacatcatcctcaacaccgatagcactgccagttgcttctacgcagtgggcgagacggtcgccctgcgcggttccgtcaagtcggcagcgctcgcgggcgacacggtgactatcgacggcacggtcaatggcgatgtcgaggtttgggccgacaagctcatcctgggcaagaacgcccacatcaccggcaccgtgaacgcgcacgtctccgaggaccccgagcgtgccgcaggcgccgaggtaggcgcgctcaagatcgagcgcaccgagaacgaggatacttccaccgttaacgatgtcatcggcggtatcgtcgccgcggcactctcgacctgctttgtcgccctgctgctcgagctcgtctttccgcgcgcgaccgccagcgccgccggcatgctccaccagcgccccatgcccctgtgggtgagcggtcttctgagcacgattgctatcgtccccgccgtcctactgctgattatctctatcgctggtctgtcgcttgccggagccctcttgtgcggcgttatcggcatcgcgttggtgtcgagtgcctttgcggggtgtgcgatcgcccgcatggtcggacacagccaaaaccgctacgccatggcagccgtgggcggcgtaatcgcaggcgccctcacggggcttcccctcgtaggtgacttcatcagcggcgtagcctttgtctttatgctcggctacgttatccagatcatctggcgcaacgcccacctcaagccgcagcagccggctaacatgccaggactccccaccgcttagccaccaaccaccacaaagggaccaggcacctttgtggtggtgcagaccagctcagtccctatgcacaaaaagggcgccgaccattacggtcgacgccctttcttgttagacgctataaagtccagcgcttatttgttgacctggccggcgcggacggcggccttcttgcggtcggtggcgttgagcaggcgcttgcgcaggcggatgttcttgggggtaatctcaaccagctcgtcgtcggcgatgtactccagcgcctcctccagcgagaaggtgcggggcggcaccagctgaacggagatatcggaggtcgaggaacgctggttgcccaggttcttggtacgggcgatgttgacgaccatgtcgccagccttgctgcgctcgcccacgatcatgccctcgtagcactcggtgcccggctcaacaaaaagctggccgcgctcctgcagcgtacccagagcataggcaacggccttctcggtggtcatggagatcattgcgccgttctgacggttgccgatctcgccggcgtagggaccgtactccaggaaggtgtggtagaacacgccctcgccgtgggtgacgttcatgatgcggttcttaaggcccatgatgccgcgggtcgggatcttaaactcgaggtgcgtcacgatacccgaggtatccatgctcgtcatgatgccaccggaggtaccgaagacctcaacgaccttgcccgagtactcgtccgggcactcaacgacggcctgctcgacaggctccatcttgttgccgttctcgtccttcttaaacagaacgcggggacggccgacctggaactcaaagccctcgcggcgcatggactccatcagaacagacaggtgcagaatgccgcggcccgagacctcgacgccgctcttgtcctcgagctcctcgatcttcatggtcacgttgttctcggcctcgttgaacaggcgctccttaagctgacgggcgcccacgatgtctccgtcacggccgacgagcggggaggtcgaagcctcaaagacgatggacagggtcggcgggtcgatctcgatgggctcgagctcgacggggttctcgggatcggtgtagacatcgccgatatcggtgcggtcaatacccacgacagcagcgatatcgccggcgccgacttcctggcactcggtgcggcccaggtagtcgaaggtaaagagctgcttgacggtagcggtggcgctggagccgtcgttcttgacgaccagaatctggtcgccctggtggatggtgccagagtacacgcggccgataccgatgcgaccgacgaagttggagtggtcgatggtcacgcactgcatggccagcggggcgttctcgtcaacctcgggcgcaggcatgtcgtcgatgatcatgtcgagcagcgggtacatgtccatgttgccgtcgttggggtcaaggcgggcaaagccgttcatggcgctggcgtagaccacgtgctccatggcgaactcaagctggtcgtcggtggcgcccaggtcggccatgaggtccaggcagtcgttgtaggccttctcggggttggcgcccggacggtcgatcttgttgatgacgatcatgatcttaaggccggtgtcgatagcgtgacgcagcacgaagcgggtctggggcatggggccctcaaaggcgtcgaccagcagcagggcgccgtcggccatacgcagcacgcgctcgacctcgccgccaaagtcggcgtggcccggggtgtcgatgacgttgatcttgacgtccttgtactcgatagagatgttcttggcgagaatcgtaatgccgcgctcgcgctcctggtcgttggaatccaggacgcggtcctcgacctgctggttggcacggaaggcgtccgtggcacgcaggagcttgtcgaccatcgtcgtcttgccgtggtcgacgtgagcgatgatggcgatgttcctcagattgtctacgcgcatgtagttcccctatcttctatctatatacaaccggcacgcgtatgcgacccacccagcaatgcaacgctcggcgggaatattgagccttttaccgaaaactcgtttattttagcgattttagatgagaggggtttcctcacctgcaggttcagggtcgctccacataaaaccatcgccggcgcccatgccctcatacagcacatatgccgaaaaaccgctctcgagcgtggtttcgaagaagctcacgagcagagcatcgtgatagccgccgtcaatctcgacgcagccggtgtagccgatggcatagcgagcgatacggcccaggccctcgtccttaagacccatcttgtgctcggagataaagttggtggccgcctcgaggcacgcctcttcgccgtcctcgtcgagcgccgccagataacggttggaagcggcgtcctcaattgccacgaccacgccagggttttcaccggcggcaaggtcgtccaagaacgcgccgatcagatcgcacaccatggcgtcgagctcggcggagacgttaccggcgtcctgcatatcctgtgccatctttagaccttcccatcgagtctggcgtcattacagttcttgtgcctcggcggcgatcttagcggcagcgtcgcgggtgcgcatcatatccatcgcgcgcttgtcgagcaccttgatctgactggtcagcatgaccgcatcgaccacaccccagatcacgaggcccgtagagatcgaaaacccaagcgcaccaactgtaccacgaaggcgcgagcagattgccgcgacaagggcggagacgacaaccatcttgataaacgagccgcggcgttcgcgaagcgtgcgggcctgcgtcacataggcaatgcgcgccgcctcagaagcctccgagcgcatctgggcctcgcgcgcaatggccgccgcctcagccgacataccgccggccatcagcgaacgctccgcagcctggccgccccacatttagaagtcatcgggggagagcgtatggacgaactcgtcgaacttctcgaactcccgctcgtcgtcaacttcctcggcatgggcagaaacggtgcccaggcgattcatgatgtcgtcctccacaaacatgggggcattgctgcgcacggcaagggcaatggcatcactgggacgcgcatcgatcttatgctcgttgccatcggccaacacgacaaccgtcgcgtaaaacacgggcggctcggcgcgaacgatttcgatgcgttcgagcttggcacccagggcgccaacagtatcgagcaacaggtcatgggtaatcgggcgctcggcgcggccgctatcgatgccgcggctgatggcagcggcttcaaacgaaccagtctgaatggaaagggaacgcagtggcgcgggcgagtccgatttgctgcagcgctcgcgaagcacgataagcgatggcacgggaccggcggccatgacgatggtctctatgtcgacacgaaccatggaacacctccggtacgtagcggttaacacgcggcagtccgccgcattgaatagctatactacccaaactttcgcacagcacacaaaaccaaaatgagatttatcgcagacaagaaaaaagccccgaggcaatgccccagggctcttcacagttttgatggtggacctgacaagattcgaacttgtgacctcccggttatcagccggacgctctaaccaactgagctacaggtccatcatggtggaggttagggggatcgaacccctgacctcaggcttgcaaagcccgcgctctcccagctgagctaaacccccacggagacagtaataaacaccccagcggcgactcggctctcgctggggtgtttattgcgaaagaaagtggtggacctgacaagattcgaacttgtgacctcccggttatcagccggacgctctaaccaactgagctacaggtccatcgcgcaagggatatattagacgagtcgttacgcgcgcgtcaacaactttttttgaaaatctttgaagggtgttcgccccggtcgcacggcggcatgtgaagtcgcctactcggacagtcctgactcgcacagagagcacattaagtgctctctggctcgtgcggaactcgcgatcgacttcacatgtcgccgtgcgaccggggcgaacacgagtcccaaggttttcaaaaaagcggtcggcgcgcagtgcgccgaccgccgatatatggggtctgataattttaaccagctagagtctcttactcgtctaggagatcttctggcatgtcgttgccgtcgcctagatcgacaggggtttcttcgggggcggagccgttttccgtggcttcgccttcgggcttctctttggcggccgtcatgcgggccacggcgcagatgcggtcgttgtcgtcgacggtcatcatcttgacgccctgggtggcgcggccggtctggctgatctcgtcggtcttgacgcgaatgaccgtcgcgccctccgtcacgataaacagctcgtgctgcgggcccaccgtcttcatggccgcgaggttacccttacgctcggtcatttgaatggtgtagacgccctgaccgccgcgattctgctccgggtagtccgcgaccggcgtgcgcttgccgtagccgcgctcggtgatgacgaacagatcgccgttgccgttagtgacttccatgcccagaacgctcacgccttccttcatgccaatgccgcggacgccgctggtatcgcgaccggtggcgcgcacctggtcctcggggaacataatcgccttgcccgcggtggttgccatgataatcttgtcaccctcgcgcacgcgacgtacagcgagcagcgcgtcgtcgtccctcaggttgatggcgatcaggccgtcgcggcgactacggtcgtaggcgctcatcacggtcttcttgaccatgccgctcttggtggcaaacatcaggtactcgtcggcggggaactcgcggcagctgatgacgctcgcgatcttctcgccttcctcgaaaggaagcaggttgacgatcgcggtgccgcgcgcctggcgcgtgccaaccggcagctcgtgcaccttcaggcgatagaccttgcccttgctcgagaagaacagcacgtactcgtgcgtggacgcgataaacatctcgtcgataacgtcatcctctttgaggttgacgcccgacacgcccttgccgccgcgcttctgggcacggtaggcggccaccgggatgcgcttaacgtagccggtgtgggtgatggtcacgaccatgtcctcgtcggcgatgaggtcctcgacatccaggtccttctcaacctgactgatctcggtgcggcgcttgtcgccgaacttcttggagatctcgcgcatctcctccttgatgacgcccaggatcttctcctcatgcgccagcagatcctcatagtaggcgatggcgcgacgcaggccgtccaactcttcctggatcttgtcgcgctccaggccggtcaggcggcgcagcttcatttcgaggatggccgtggtctgctcgggcgtaaagccaaagcgctcgatcaggcggctgctggcctcggagtcggtctgcgaggagcggatgatgctaatgacctcgtcgatatggtcgagggccatcaggtagccctcgaggatatgcgcacgcgcctgggccttcttgaggtcaaaacgagtgcggcgggtgacgacgtcgacctggtggtcgatatagtgctgcagcatctcgcgcaggctcaggcatttgggcacgccgttgacgagcgccaggttgttggcgccaaaggtcgtctgcagcgaggtgtacttgtacaggttgttgagcacgacctgcgggataacacccttcttgagctcgatgaccaggcggatgcccttctggttggactcatcgcgcatgtccgagatgccctcgatgcgcttgtcgttgacgagctgggcgatcttctcctgcagggtgcccttgttgaccatgtaggggatctcggtaaagaccaggcggctgcggccggtcttggtggactccacatgagccttggcacgcacggtgatggagccgcgtccggtctcgtagctctgcttgatgccggcactgcccatgatgatggcgccggtggggaagtccgggccgggcatgatctgcatgagctcgtcgacggtggcatcgggattatcgatcaggtagcaggtggcctcgatcgcctcggtgaggttgtgcggagcgatgttggtggccatgccgacggcgatgccctggctgccgttgaccagcaggttggggaagcgcgcgggcagcgccacgggctcggcgagcgactcgtcgtagttgggctgccagtcgacggtatccttctgcaggtcacgcagtagctccatggcgggctttgccaggcggctctcggtgtaacgcatggcggcggcgccgtcgccatcgatgttgccgaagttgccgtgaccgtcgatgagcggcgtgcgcatggagaaccactgcgccaggcggaccatggcctcgtagaccgcagagtcaccgtgcgggtggtacttaccgataacttcgccgaccgtccaggccgactttttgtgtgggcggttggggtagatgccgctctcgttcatcgcgtacaggatgcggcggtgtaccggctttaagccgtcgcgcacgtccggcagggcacgcgctgtgataaccgacatcgaatactcgatgaacgactgcttcatctcgcgaccgaactccgaaatctggagctggccgccgttgatgtcctcgccggccgaggcgccacgatcgacttcgccaaagctctcctcgagctcaccgtcgtcgtcctcttcctcatcatcatcggcatcggggttataggcgtccggatcgccgtcctcgccctgctcagcacgggcaagcaggcgcttcagatcatcgggcataccggcatcgccggcctcgtccataccctcgttattgttgatatcgtctgccacgttacctcctcttaagcgtcaaggaatcgtgcatcatgtgcatgcttctcgatgtactcgcggcgatagccgacctcggaacccatcagctcgcgcacggcgcggtccgccaccacggcgtcctcgatcgacacacgctgcagaatgcgggtctttgggtccatcgtcgtcgaggcaagctgtttggggtccatctcgcccaggcccttgtagcgctggacggtatagcccttgcgctttttggtgatcttgccgtccttggccttgccgtcctcgtcgttatcgtcggggttcaggcccagactctggatggtgtcgcgcaggatctcgtcttcgggctggcggccgttgggatacacgtagtgaatcttgttgcgcaccttaatgccaaagatgggcgggcaggcaacatagacgtagccggcatcgatcagcggacgcatgtacttgtagaagaacgtcagtagcaggatgcggatatgcgcaccgtcgacgtctgcatcggtcatgatgatgatcttgtggtagcgcgccttggtgatatcgaagtcgccgccgtcgccggcactcgtcgtgacgccgcaaccgatcgcggtaatcagcgactggatggtgtcactcgagaacgcgcgatggtcaccaacgcgttcgacgttcaaaatcttgccgcgcaggggcaaaatcgcctggatgtctcggcgacggccgtccttggccgaaccgcctgccgagtcgccctctacgatgaagagctcggtcagctcggcatcgcgcaccgagcagtcggcgagcttaccgggcagggacgccgtctcgagcaggctcttgcggcgggtcgcctcgcgcgccttgcgggcggcattgcgcgccttgcaggcctgttgcgccttcttgacgatctcgcgagcgggcttgggatgctcctcgaggtaatcggcaaggccgtcggtcacaatcttgagtgtgagcgcgcgcatataggagctgccgagcttggccttggtctggccctcaaactgcggatcgggcagcttgaccgagataacggccgaaaggccctcgcgcacatcgtcgccggtcaggttggcgtctttttccttgagcaggttctgcttgcgcgcgtaatcgttgatcacgcgggtgagcgcggtgcggaagccctcaaggtgcatgccaccctcgggggtgtagatgtcgttggcaaacgacatgacgttctcgccgtaaccgctattccactgcagagaaacctcgacctcgcccatcttggtcacaggcgcgtccgggtccgatttgccctcgatgtagatgggctccttaaaggcctcggggacgtccttgccctcgttgaggaacttgacgaagtcgatgatgccgccctcgtagcaaaactcctccacgtggggagtcgcctcgcgctcgtcggtcagcacgattttgaggttcttattgaggaacgccgtctcctgcagacggttgtgcagcgtatcgaaatcgtagatgcaggtctcgaagatctcgtcgtcgggccagaaggtgacggtggtgcccgtcgaatccgaggtgcccacgacctccatcttcttgacggtcttgccgcgcgagaactccatctcgtaggtgttgccgtcgcgacgaacctgaacgaccacgcgcttggacagtgcgttgacgacggagatgccaacgccgtgcaggccgcccgagaccttataggccgagttatcgaacttaccgccggcgtgcaagatcgtcatgacgacctcgagcgtcgggatctttttaacagggtgctcgtcgacggggatgccgcgcccgttgtcgacgaccgtgatggagttgtcggcgtggaccgtcacctggatctcggtgcagaaaccggccatggcctcgtcgacggagttgtcaacgatctcccacaccaggtgatgcagaccgctggcgctcgtcgagccgatatacatgcccgggcgcttacgaacggcctcgagaccttcgagaatcttaatctcgccgccatcgtaatcgttttcgtttgccacacgtcctccttcagtcaagaaaatgtgtacagccttactagtttatcgtaaaaaaataccctcgggaacgagggtatttggctctacaaggccaccagatgcgatttaaggctcttttttgctttgcacgcccttggcccactcggcactggctctcatggcattctcgagggcctcgcgcagtttttggtcttcgatgggcgccacttggcgctcaatctcggtgcgctcggcctcacttaggtcggcgtgcggagccggcgggcgctcggtcgtcgccggacgcaggcgctccttggcggcgggcggcgtgtgaccgggcgcggtggttttgaacaccaggccgtccacatgcgcaccggcgcgctccatgcgcgcgcggatgatctcgcgcaacagcgtcatttcctgcgtccacgagggcgagtcgagatataccagcagctcattggactcgggcaggtagcgcaggcccgtcacatggcgcccctcgcgcgtgcccgagcacaccgcattccaggcgcgatagaccgcacgagattcctctgcagcctccatctgcacgcggcgctcaggcgtcgcggccgccaggatgcgctggcgctctgcgtttaaaaatccactgaaggcgaccgtttcgctctcgcgctcgtaattagcacgtctcacccatgctcaccaccttggctcgatcaagcaggtcatcggtaaaataccccaggttggtcgtggttatgaccgtctggatatcatcgccgatcagccgcagaaaagcgccgcgacgctcgccgtcgagctcgctcatcacgtcgtccaaaagcagcagtggggcggtgcccaggacatcgcgagccacggccacctccgccaccttccaggccaaaaccaacgtccgctgctgaccttggctggcaaatgaacgggcggatcgacccgccacggcaaactcaatctcatcgcgatgcggtcccaccaacgtcacgccgcggcgaatttcctcgtcggcgtgctcatcaagggcagccagcatgcgctcgtacgcccagtccttcagctcttcgcgatcctcgacctggggcaaatcccccagcgtggacgtataggtcacgttggcggcctcgccggacgccacttgcccgtaggcagtgtgcacatggcccgccagccggtcgagcagggccaaccggtgcacgagcagggccgagcccgcgcgggcaatcgaatcgttccacgcgccgagcatctcgcggcagcaccaggcctccttgagcaaggcgttacgctgggtcacgcagcgcccataggtgctcgcaagatcggcatagcgtgcgctcagttgcatgccaaagtcatcgagggcggcacggcgcacactggcgcctcgcttaaccatgtccagatggtcggggcaaaacagcacgctcggcaggaccccgcgcacaccggcggcagagcatctcttgccgttgcggctaaacgagcgcttaccgtcctccgcgctcaatcccatatcaagcacgcggccgtcgccctcgagcctcagctcaaccttgcacgagtccgcgccgtcatggacgagctcggcggcggtcggatgcctaaacgaggcgccgctcgtcagcagttgcagcgcctctatgagattggtctttcccgccgcgttgggtcccgcaagtatcgtcacgccctcgtccagggcaaggcgatagctatcgaagctgcggtagtgcgcgacggaaagatcgcgggcgaacatggtcatagggcagttgctagatgcggaccggcatgaccaggtacaggtagttgatcttgtcgtaggacttgaagatgcccgcctgcgagtagctcttgagctccagcgtgatctccttctccttggacagggcattgaggcacccgaagatgtagtggtagttgaaggcgatggtgcccgactcgccctcggcctcgacatcgatcgtctcctgcgcaaggtcctggtcattggaaatggaggacaggcccatctgcccgttctcgacatcgatctcgaacttgacggcggggttggcgctcgcgataacggccacgcgcttgagggcggcgttaaaggcggcgacgtcgatcttgacgctcgtcacgcacgaatcggggatgagctgcttgtagttggggtacacgccctcgatgcggcgcgacacgtaggtggtgttgccggcctcaaagacgacctgggtgtcggtagccccgatcatgatggtcgcctggctggccatgatgttcagcgcgtcgttaaaggcatcggccggaacgttgagttcaaaggagccctcgagggttgaggtctcgacctgcgtatcgcacacggccaagcggaaggaatcggtcgccaccaggcgcacggtgttgttctcgaccttcatgtgcacgccacccaggatggggcgggccttgtcagtcgaggtgacgcgccacacgcggccgaccatttcggacaagatatcggtcggcagttccacggcgctctcgatggcataggccggaaactcggggaagtcattggcatcgagcgtgttcaggcggaaagagctcttctcacaaccaatcagcacctggcgctcggacagctcaaaggtgaccggggcatcggggagggtcttggtgatattggagagcatcttacaagggataaccatctcgccctcttcttcgacatgtgccgcgatgcgatgacggatcgagatggtgtagttagaggtctggaattccaagatgccgtcttgcgccttgacgagcacgcccgacaggatgggaagggtggatgccgaagcgacgcccttcataacgacgccgatggcttgtgtaagcgagctctggctgacggtgaacttcatcttttaatacctttctatagatataaatatcttaataatagtaatagcactgacgaaactgttgattactcccaaagacgcaggtcagacccagaaagagaatcgacagcaacctgtgtgcaacgggggtggttttccacgttcaaaacctgcgcaaaacttttcatcaccgcgggttgggttttaaacaccttatgcccgtggtttcgacaagttttcaacaggtgtctctatttccctacgagcgcagtgtaattttatcgcgcagtgacttgaggtcttcggtgacggtgcggtcttcctggatcatcttctggacctttttgtagctcgtgctgacggtcgagtggttgcggttgccaaattcggcgcccaccgccgtggtcgtcatttcgcacatctcgatggccaggtagatagcgatatggcgcgctttggcgatattggcgttgcgacgcgggccgatgagctcctcgtgtgtcacgccgtactgctcttcgatgacggactgaaccgtctggacgttgatctttttggccgatgtgtcgaagtactggctggcgatggcgtcgatatcgtcaaaggtgagctccccgccctcgcgctcgcggtcacccgcctcgccggcgcagcgctcgcaaaagctctcgagttcgcggatgttggtgcccgagacctcggccatgtgtttaaagtgttcgtcggtcaggtgcccgccgtcgcccccataggccgccagcagcgagtcgtcgcctgcctcgggggcggcgacgatggtgttctcgtaatagcgctgcaagatcttgtatttcatctcgtagctgggctctgcaaccaggcagagcatgccggcgttgaagcggctggtcagacgctcgtccatgcttaggtccttgggggcgcggtctgccgcgatgacgaccttcttgttgttgcggatgaactcgtccatgagctggaaaaagtagtccacgctcgcgcgcttgccgatgatgttttggatgtcatcgatgatgagcacgtccacgccgtggtacgcctgcatgatgggagcgttgctcttcttttgacggtcgaactcggtcatcaggtcgtccagatatgcctgggagttggcatacttgaccttgatctcgggcgacttctcggcgagctcgtttttgatggcaagcagcaggtgcgtcttgcccaggcccgatttgccgtagatgaatagtgatgtgcatgtgccgcgctcgtccgcgagggcggcaaacttgagtgccgagcgataggcatggctgttttcggggccgtagacaaagttctcaaaggtaaattttgagttcgcggcgagcggggctccatccgtattctgctcggccggcacggtcggtgctggcatgggtgaggtgggggtcgcggcttgcgtggatttagtcggcgccccgcccttcatctggttcatcatgcgacgaaaatcgtcggccgagagcgtgtttttgattgcaatgcccgaatccgcgcccgccgctgcgtcgtgagcgatgggcatgtgcgtgacgggcgcgttcgttggcgtcgccgccgcggtcggcaacggtgccatggtttcacgggaaacatcgctgtgctggtgctcgaccgtcgacgcgtcgcctgcggaggccggcaccgccggggaagcagcgggagccgtggcgggcgccgtggcggcagcggattccgtcgcggcgccttgcggtgccacgatgtcgagcgcgatcggtgcaaaggcgatttcttccagataggcctcaatagtcggctgatgctttttgagctgcgcgatggcaaagcgcgagggggcctcgatcgtgagcgtatcttcggtcaggcttatggcccgcgattgccccagcatgttgatgaggcgtgcatcttggccgtcgcgctggcaaaaggcgatggcatcccccaggatgatgcttgcttcctcgtccactgtctctcccgttctttagctctgagctcgcacgcgagcggcgccgagttcggtcagatggtatttctggccatgcttgatgaccaagccggcctgcgccaagtcattgagcgtgcgtgaccaagtgggggccgagtttccaaacgccctcgccagatcggttgcaccgcacgcttgattttgcgccagatagcccagcgcggcgttgccgcgatcgcttacgaacacgtccggttgtggctgcgcatactgatttgctgcattaggatacatcatttgagctgctggttgttgagaactctgcatcggcggcatttgctgttgaaaactttgaggccactgttggtaaggctgcagaggcatctgttgggcccaggggttgtactgctgctgcggcatctgctggtacggctgctgatatccctgctggtactgctgcgggaactgctggccataccccagtggcggcatctgctgatatggatatccccgttggtacggctgatagcccatttgctggccacccggtgcccccgtcgcctgctgcattgctgctgcatcctgatctgccagcggcatggcctctggcatgtttggcgtcatcgacatagatgccgcctggggctcttgtgtgggaagcattccgggctgctgcatctgccccacggggggctgcatctgctgcgttgccatgggctgctgcgcaaaagctcccggcaggggatatgtgggctgctccgtctcgggccgcacggcagcaccgcgtccgccggcacgctcgatttcctgcacgcgtttagggttcaggcttaccgtaaccacggtgccgttgcccatgttgtcctcgatggatacggcaccgccggcgttttccaaatactcctgcaccatgggaaaccctgctccggttccacggatatagcgcttcatcttgctgtttgcgctggtaacgccaaagtcgaaagcgcgttccttgtcgtcgatgccgggtccttggtcagcaaagcggatggtgtctccgccgtccagaatcgagatgatgggctctgcaaagtgtgcgtggataaagttttcgacaatctcgcggatgaccatgagcgagatatggccaccttgttctttcatgcactggtagacggtgttggtcgtctcttccaaatacgtgcggacatcttgcggatcgatgacgatcacacgcggtgtcgacagcatgtcgtcatagacggcgatgcgcgcggcgtacatggcttttggcgcctgcgttgtcgtctgttcaccttcgtcacgctcttcgcgcacgccggtgatgtgctcgttgtcgggtgccgggtctccggaatcgaccatggtgtaaaagtcgtcagacatgccgctcgcaatcttccaaaaggtttcgaacaaatagtagctcaccgtgcaatgtttctcatctttcgacaaactttcaaaacctgttgaaaactttggaaaacggacgaaaagttctcaacattgccaacatgacctgttgaaaactcgatgaaatatcgtgaaaagttgccatgcaccgctaaatcgagcttggcttatgggggaaccgtgtgaactgcgcaaccttttacctttgatttcttgacatttgaacattgatttccctacaatcttcaagctcacgtgtctatatctgcgtccgcgtccccgcggacactcgaaatgcagcaggaggaacttaagatgaagcgtacgtatcagcctaataagcgtaagcgtgccaagacccatggcttccgtgcccgtatggccactaagggtggtcgtgccgtgctcgcccgtcgtcgcgccaagggccgcaagcgtctcactgtctagcagcgatacacacatctcgcatgaagactattaagtctcggcaagatttcgagcatgtgttcagtcaggggcgtcgtttcaatcaccctctgattcgaatgaccatatgtgaatcggttggcgaaggcgactccggaagggtcgccttcgttggtgctaagcgactcggttgtgccgtcgtgcgcaaccgatctaagcgtgtgatgcgcgaggccgcccgtagctgcggatttcccgttgcgggttatgacatcatcttgtttgcaactcccaagacgagggtttcctcgccgcaggagatggacaaggcgttgcgttcgcttatgaagcgcgccggcgttgccggggaggagcgatgagcaatcacgttttgcgacgtgttgccatcgctcctattcgcatatataaacaggttatttcgcccttattgcctgacgcctgcatttattacccaacgtgctcgcaatacgccatccaggcgattgagaagcacggtgttttgagaggctgctggcttgccgtgaggcgcatcgctcgctgcaatcccctgcacgtcggcggttatgaccctgtgccctagcgggcactcgctatcggaggaaaacttacatgtgggattggatcgttaacatccttttcgagctgctcaagctcatccagacctttgcggtcgactggggcctgtccatcatcatcctggtggtcatcatccgtctgctgctgacgccgcttatgctcaagtcgaccaagtcgacggctcgcatgcaggtgctgcagcccaagatgctcgagatccaggagcgctatgccgacgatccccagcgtcaggccgaggagatgcagaagttctacagcgagaacaagttcaaccccatggctggctgtctgccgctgctgattcagatgcctatcctgttcgccctgtttacattgctgcgcaacctgccgcagtactttaacaacggcacgttctcgttcttcaacatcctgcccgacctgaccaccacgccgagcgcttcctttgccgatggctttatggttgcactgcctgcgctggtttgcctgatcctgtttgccgtcctgaccctgattccgcagctctatatgtcgcgcaaccagaccggccagcaggctcagagcatgcgtatgatggccgttgtcatgacggtcatgatgctttggatgggctggagccttcccgttggtgttctgctgtactacgacgtctcgtctgcttggcaggttatccagcagatttttgtgacgcagaaggtcatcgacaaggcgaaggccgatgaggaggagcgtcttaagaacgctccgctgcaggttgaggtcactcgtcgcgagaagaagccgcgcccgcacaagaagaagtagtgggatatcaatcttatttaggtacctaacttttggagtacgttatgtctgaagagatcatcgaggatatgcttgaggaggttgccccgcaggtcgcgggcgattatcccgagattgcacagcgctacaaggctggtgaagagctgaccgatgaggagctcgacaccattgccgatgttgcgatttccatcctgcgttccatcctttcgcacttcgatgccgccaactctcctatcgatgagtatgagggcgacgagggtgagctgattttggatgtaacggctcccgaccttgctgttctcattggccgtcatggtcgcactcttgatgctcttcaggttatgttctctttgctggtgagccgcaagcttggctttaggtatccggttgtagtggacgtcgagggatacaagagtcgccgtcaggataaggtcgcctccatggctcagtctgctgccgagcgtgccatccgcactcataagagtgtttcgcttccgcccatgaatgcctacgagcgccgactggttcacattgcacttcgtggcaacgatgcagtcgatactcattctgagggttctgaccctgatcgccatgtggtgattgttgctcgataatctactcgagcttatgctagggggacgtggtttccacgtcccctttttttgtcaaaagttctcgatacgctgatttttgtcagaaaggagcttctgttgtttgtacttaccgatcagcaggatgacgagatgttgagtcgcctaacttcctattgcaaagaatattccttgagcgtaactgatattgagctgaggaaatgtatccagcatttggatttggttctagaaacaaataagacaaccaatctcacccgtattcttaacgtagaagatgctgccgtacttcatatcctcgactcacttgttttgctcccctatatcaataaggctcctgagggagctttgctcgatatgggaacaggtgcgggcttccctggtattccattaaccataaccacgcatcgtaaagctacttatattgactctgttggcaagaaggttgatgcggttaattcctttgtccatgctcttggattgaaacatgctcatgcggttcatgatcgtcttgaagaatatgctcgaagccataagaagcagttctccgttgtaaccgcccgcgcactggcccctctaccgattcttgttgagtatgcggctccgtacctgaaggatggagggctatttgttatcaccaagggcaatccttcggatgaggagcttgcttccggcatgtcagcagctaagatttgcggcttcactttgcttctgaatgacgcaattgatttgcctgaaggcttgggtcacagggagttcattgttcttaagaagagtcattcagcatccgtttcattgcctcgtgcaaatggcatggcaaagaagaatccgcttgcctagatgtttcacgtgaaacataatggttactaacagcttgcagtgtttcacgtgaaacatagcagttgctatcgattcggaatgtttcacgtgaaacatcctccgtttgacagctttaatacacaccaggagggaccgtgggatttcgcgacgttaagcgttctaagagcgcaaaagacacgcgtatcattgcaatcatcaatcaaaaaggcggcgtcggtaagtcaacgacggctgtaaaccttgcagcagcactgggtgagcagggtcgtaagacactgattgttgattttgatccgcagggaaacagcaccagtggattcggaattgaaaaagaagaccttgatcactgcatctatgatgcattgctgaatgatgtgccggcagaatcgcttgttcttgatacaaattgcaaaaaggtattcgtaattccagctacaattcagcttgcaggcgccgaaattgagctcgtaagcgcaattgcacgtgaaacccgcctcaaagatttgcttgagccgattcaggacgagttcgattttattttcattgactgtcctccttcgctcggcctgcttactatcaacgctttgaccgcagcagacagcgttttgattccgatccagtgcgaatattacgcactcgagggcgttacgaagctgcttgagtcaatgaagatggtcaaatcaagactgaacaagggcttagacacctatggtgtgcttatgaccatgtatgactcgcgtacttcactatcgaatcaggttgttgaggaggttcaatcgtactttggtgataaggcgtttaagacgctaatcccccgtacggttaaaatctccgaagctccgtcttttggagaaccagtaattacctatgcacctcaaaataagggtgcaaaagcatatatgaaccttgcaaaagaggtgatcaagcgtgcctagtgtaaagaaacgtggcggattgggacgtggactgaatgctttggtttcagaggccgagtatgagaccggcggttcggctgcatcggcttctaatgctgcatctgaaacaaaactacctattgaggatatcgttcccaaccctaatcagccgcgaattcactttaacgaaactgaacttcgcgagttgagcgagtcaatccaagaacatggcgttttgcagccgcttttggttcgcaagcatggaaacggctatgagatcatcgctggtgagcgtcgttaccaggcgtcaaagcttgctggccttgaagaattgccagtcatcattaaagaggtaaatgatgaagagatgctggctcttgctcttatcgaaaaccttcaacgttcagatctgaatcccgtcgaagaggctaagggctatcgacagctcatcgatgccagcggtatgacccaggaggcattgtcgaaggcagtaagcaagtcacgctctgcaattacaaactcactgcgtcttctcgatctccccgaagtagttcagcagatgatttttgagggtaaacttactgctggtcatgcacgtgcgattcttgcagttccctatgaggatgctcgaattcgacttgcagagaaggttgttgcagagggcctttccgtaagagcgacagaaaatcttgctccgttgttttctgccggagagacacctaagacgccgaggcctgcaacccctcagtcttttaaaaaggcagcccgcgtgcttcgtcaggtttttaataccaacgtgcgtgtgaagagctcgcgtggaaagaataagattgagattgagtttaaagacgatgaagagctctctcgtattcttggcgaaatgattcagtttgatcaaggaggccaagatgaggaatagaattttaactgcgattgcattggcgacgactgtcgcggctggtgcctttgctggctataagatcgcgacagacgatgaacttcgaggtcgtttgcttcgtagtgcgcaagatattatcgatacatccaagaagaaaatggatgttatgacagaagatgttgcaatgcgtactgctcaggtaacgaagaatcccaagattaatcagggttgggtcagcaaccaatgggaaaatgtaggctattaggtacctaataattacttagcatattgtgatgggtccttgtctgattcacgagacaaggaccccttattttggccgtaaaaatgggaccagtagcagctgattcaaaattaaggtcaataaatgaaacgaccccggttggatatcctgcaaccggggtcgttcgatgtttcacatgaaacgttttgggtgcgactcccctatgcgttcttctgaactttgaagcgctgcttcagctgtccgcaagcggcgtcaatatcgttaccacgggagttgcgaatcgttgtctcgatgccacgggactcaaggcgacgctgaagatcctcaaccttatgaatcggcgacggcttgagcgggctaccctcgatgtcgttaagctgaatgaggttaacgtggcacagcgttccctcgcagaagtcgcagagcgcctgcatttccggattcgtatcgttgacgccttcgatcatggcatactcataggttggacggcggccggtcttcacggtgtagagctgaagcgcttcgtgaaggcgaagcagcgtgtacttcttaacaccgggcatgagcttattgcgcgtcgactggatggcggaatgcagtgaaacagcaagcgtgaactgctcggggatgtcggcaaatttgcgaataccgggaataacgccactggtagagacggtgaggtgacgagcgccgataccgatgccatcggggtcgttgaggattcgcagcgccttgagaacctcgtcgtagttggcaaacggctcgccctggcccatgaagacaacgctcgtggcgcgctcgccaaagtcgttggatacatgaagtacctggtcgacgatctcttgagcggtcagagagcgcttgaggccgttgagaccggtagcgcaaaaggcacagcccatgccgcagcctgcctgggtggaaacgcagacggaaagcttgttacgacggggcatgccgacagtctcgacggaaacgccgtcgtggtattcgagcagatacttgcgcgagccatctttggaaacctgcttggtgagttcagtgggcgtgtcaaaggcaaaagcctctttaagctgctcgcggaaagccttgggaatgttggtcatatcgtcaaacgaacaaacgttcttctcgaagacccattcaatgagctgcttcgcgcggaacgcgggctggccaagttcggccacgagctcgcgaatatcgttttggctcaagtcgcgaatgtcctgagatttagtcctgggattcatggaagcctttcgattttggggaaacgtagagggtatcgctacaatatggtatcagctgcagaaattatagaggaggagtctgcccatgccgggtaaaagcctagagaacatgcacgtagcggtcttggcgggcggtcattccgctgagcgcgagatctcgctcaattcgggaaagaacgttgtggtggcactgaaggaagccggctacacctcggtggagctgctcgatacggccgctgatgactttatggtaaccatggcaaccggcggctttgacgtggcgtttatcgccatgcacggtgccggcggcgaggatggtgccatgcagggcgccatggagaccctgggtatcccctacacggcctcgggcgtgcttgctagcgcctgcggtgccgacaaagaggtctctaagctcctgtacgccaaggcgggcattcccattgcccccggccttgcgctcgaggtgggcgatgaagtcgatatcgatcatatcgtcgaggtttgtggcgagcgcagctttgtgaagccggccgtcaacggttccagctatggcatttccctggtccatgagccctccgagctgcccgcggcaattgccaaggcgtttgagtacggcgacaaagtgctggtcgagaagtgcatcgagggtaccgagatcaccgtcggcgtgtacggcgaggacgacgtgcgcgccctgccgattgtcgagattcgcaagcccgaggactgtgagttctacgatctggacgtgaagtatgtcgaccctacggacatccatcgtattccggcgcagatttcacccgagaattacgctcgcgctcaggagcttgcctgtgctgctcacaaggccctcggttgcctgggcatctcgcgcagcgattttatcgtgagcgaggacggccccgtcatcctcgagaccaacaccattcccggcatgaccgatacgtcgctgtatccggatgagattcgccacacagacgacatgacgttcccgcaggtctgtgacagcctgatccgtatgggccttcgtcgagcgggcattgcatgctaatcgaggacgcggtttcgtcaggaacgccgcagtttgtcatcgactcctatgccacgcttgccgaacgcgccaaaacgcagtcctttggtcttatcgaggaagatgtgattgtcctcgataccgagaccacaggtctttcggtgcaggacaatgaactgatcgagatctcggcggcccgtctttcgggccgcgagatcgtcgaccgtttcgataccttcgtgcatcccaagcagctgattcccgccgagattaccgagctcacgagcattacaaatgccgatgtggcagatgccccgtcggccgttgaggccgtcgccgctctcgccgattttgtcggtggttgcccggtgatcgcacataacgccacgttcgaccgctcgtttatcgagtcggtcaaaggcggcgtcaacgtgagcgatatttggatcgattcgctggcgctgtcgcgaatcgcgcttccgcgcctggcctcgcacaagctgtcttttatggctgatctgtttggctgtgactcggtatcacaccgtgccaatgccgacgtcgacgccctgtgtggcgtatggcgcgtgttgctcgtggcgctcaccgacttgccccagggcctcatggcgcgcctagccgacatgcatccggatgtgccttggtcctatcgtcctatcttctcattcttggcagggcagaaccctggttctatcttctctctcagcgccgctcgtgctgacgttctcaaggccgatcgcgccgacgatcgggtggacgccgacgaactgccggtcctcaagatgccgagtcgtgaggagattgaggcagactatgcgccaggtggcctggtcaatcgcatgtaccccacctacgagccgcgtgatgagcagattgcgatggcgctcgaggtccgcgatgcgctggtcacgggcactcatcgtgtaattgaggcgggcacgggcgtcggcaaatcgatggcctatctggtgccttttgccgaggcagcacgccgtaacaacatcacggttggtattgcgaccaaatcgaacaatctcgccgaccagctcatgtaccatgagctgccaaaacttgccgagcaactggacggtggtctgtcattttgcgctctcaaggggtatgaccactatccgtgcctgcgcaagcttgagcgcatgagccgcggccaggccgagattaccaccaagcgcgatccggcggacacgctcacggcggtcgcggtcattatggcgtacgtctgccaatcagccgatggcgacctcgactcacttggcattcggtggcgcagcgtcaaccgccccgactttacgacggcctcgcgcgagtgtgctcgtcgcctctgcccgtttttccctgataaatgtttggtccacggcgctcgccgtcgtgcggcgcatgccgatgtggtggtcaccaaccattccctgctgttccgcaacgttgcggccgagggcaggattttgcctccgattcgtcattgggtaatcgacgaggcccattccatcgagcgcgaggcgcgccgccagtgggcgcgcgtggtgtcggcggacgagtcacgcgttctgtttgagcgcctgggtggctcgagcaccggcgcgctaagccaggtttcccgtgatttggcaacctccgagggctctacgctctatctgggccttactgccaaggcgacgtcgacggttgcgcgcgcgagcatggcaatcgccgacgtgttcgatggcgttcgcgagctcggccgccgtgcccgtgggggttatgacaatgccaatctatggattggccccgaactgcgcgaatctgacgactggcatgatttcttacagtcggcctacactggcatcgacgcattggaacaggctgacaagagcgtcgacgcgctggtgcaagccgtcgccgccgacaagcccgaggttgttgttgacctgggtgatatctcgcgtcgcctgcacgagctggtcgagaacctcaaactcatcattgatggcaccgatgaacactacgtgtattcgctgcaggtcaatcgcaggctgcgtgccggcggagagtcgatgaccgcagagcgcatcgacattggcgaggccttggcaaccgagtggctgcccgaggttcacacggctatctttgcctcggcgactatgacggtgtccaaaagctttgaacactttaaccatgcggtcggcctcgatcgcatcggtgcttcaacatcctcatcgctgcacttggactcgagctacgacttcgattcgaacatggctgtagtcgttgcgggcgatatccccgatccgcgcgatcgcgagagctatcttacggcgctcgagcgcgtgctggtcgacgcccatcttgccatgggcggatcggtgctcacactgttcaccaatcggcacgacatggaagacctgtacgcccgcgttgagcccaagatggcccgtgcgggtctggagctcgactgccagcagcgcaactcatctcctcgtcgcctgcgcgaccggtttatcaacgagccgacctcgtcgctttttgcgcttaaggccttctgggaggggtttgacgccagcggcgagacgctgcgttgcgtcatcattcccaagctgccgttctcgagccccacggacccgctctcgtgcgagcgcaacctgcgcgaagaccgcgcttgggcgcgctattcgctgcccgaggcggtgctcgaggttaagcaggcggccggccgccttatccgctcgtcgaccgattgcggcgtgctgattctggccgacccgcgcctggtgacgaagggctacggaaagaagttcttaacgtcgctgcccacgagctcctaccagcgcatcgaatcggcgcagatcggtcactatctgcaactgtggcgcgcacgtcacgagcggcggcgctaaagcggacagacgagggtttttgccatatcgcacagacgctttgacagggcggggtcatccaagatgcggatggctccgcccgctgcgattacctggctcagtagccaacgctcggagccgtaatgcacggttaccgttgccatgtctgccccgctgcgctcgattagggtgatgccggcccagtccagatgctccgccatatcgaatggcatcaagagctttgcgctacgctgcgtccgggcaagggaatcgtggagggatgcgacgcccggtgtgtgaggcacgacggagtcttccgtcaaggtgagtccctcgattttatccatgcgataggtgcgctgctcatcgatcgcgatgtcccaggcaatcaggtatgtttggtcgccgtttgccgtaatgcgcaaggggtcgaccagacgctcgcgtggccgcgcatcgtccatcgagcgatacgagatgcggcaacgaacaccgtcctgaatggcgcagctcagctgctgccagtgcgacccgtggttgacggtgtcaaagacgcgctggttatagccgagctcttcgggcagaagggcatgtcgaatccgagctgccgtctgcggctcgatccccaacgattcaagttcatggttgagcacggcgccctcggcggcactcaggcgcaacggtagcacgcgcccggcgtcaccagtgagggccacgcgctcgccgcggcattcgcagatgatgcgcgcgcccgattctcggtccgcgagcgtcgagacgatctcgagaatctcgtcgagcgacgcccccgtgatgtcaaagcgactgcaaatctcggttcgtgtcatgccgccatcgccggcggcgtagagggcctccatgatgtcgatggcgcgcgagagtctctgctcgctggtgagtttacgcacgggcatgctcgtgcaccgtcctttctatgaggtggttccacgcctgcttgagcgatttgggggccatgggcctcatgccgtccatggcgtgggccatgcaaaatgaggcggcggcttcaaggtcgcgcacgtcaacggtccagatccatcccgcatcggtgtgtgtgagctcacctcgcccgcgcgtgaggccgttgatcatatcgatctgcgtctgaggggcgaacgagaacgtggctgcaacgggcggtcggtcggcgaaatcgaattcaaagaacagatagtcgttgagattgaagtccgcggggatgacgtaggccttcgaaggacgccaagcgcgaacgatacggtcgcagcggaatgtcctgatgttgtcggtgacattgtcgaggccgcagaagtacgccacgccctcgcgctcgaacatgccgtagacgcagacggtacgttctttctgctcgccgcgtccgttctgatataaaaatcgcagcgcgcatcgctcggcaaaggcgctccataccgcatcgacggtgggagagcggcgaatcggtgtttcgtccaccgtcgtcctaccggtgagataggcaatcttggagcgaatatcggcaagcggtgcggtaaaggtggatgagccggccgctagcgtctggtcgatggcgttgagcaggatatcggcgtcgtctgcggtaatgaggccgcctgcagcaaacgtgtgctcgcggtcgattgtccacgagctttcctcggtctcctgcgcgccggcggggcgaacctccttgattaagatgccacgctcgagcagtttgtcacgatcgcgccgaaacttgcgcttatccgagtcgatgttgcccgagccatatcccaggtcggaatccaagacgatctgctcggtcgtcagcggttcgggggagctgttgagcacaaagaaaagattgaggatgcgctgagccgttttatcgaaactgggctccgaattcccctttttaattgtcgcggtcgtgtcgcttgccgtcatagagtcctcgcatgagaaggtggtttgctgccatgattttagtccgatatggagattaggctatatccttgtccgctcggggcgttaagatgagccgaattcggtcgtttgcgctcgctcggggtatactttcgactatatacggttctaatgtgcatgcattgggcctatttgtcggattatggatgtggagcgcacatggcgaacacccagaactatattaaccacctgctgcagaacaccggcattacgccggcatgcagcgaagaagagcgcttggctgccgaggatatcgctcagatcttccgcaaccacggctttgaccccgaggttcaggagttcaatgccccggcgcccagtaggttggcatttgccgttaccggtattcttgcgtttgccggcgccctgctgatgggcatcggcggcggtatcggcttggtcggcaccttgctggccattgtcggtgccgtgctctacgtgctcgagcgcacggggcatcccgtggtttcgcgcctgggcaagacgggcgtgagccaaaatgtcatcgcctaccacaaggcctcgggcccgctcgcgtccccgcgtaaccgcccggtggtcgttgtcgcacactacgactctccccgtgccgagctgctcgcccgcgagccttatgcttcgtatcgtgcgctcatcgccaagctgttgcccgttgccacggttgcccccgctgccgttgccatcctgcgtatcctgccgctccccggcgcgctcaaggttctgctgtggattgtcgcgatcctcgcttccctcgttgcacttgccaacgcggcaaacatcatctctaaccgccacattcttccctatacgtccggcgcggtgtgcaacaagtcttctgtcgccgctatgctcggtgttatggacaacgttgctcccttccagggcgagaacgagtttcccgacgatgttccgttcgatacctattttggggagcaaaagcgtcgtgccgaggaaatggcgcgtgcagcggcggagtatgccgcggcccagcagcaaaacgactacggtaacaccatcgagtacgaagagcctacctacgccgaggacgagttcggtcagccgattgctcccgacactcagaccgagcccgaacagggtgaggctttcgacgagcagatcgagggctttgagggtgcgtctgccgacgagacgctgattggcgccatcgtgcccgaggatcagaatcaggctgtccaggctgaagagttcaatgacgaggtttccgctgccgagccggtggaggagcctgtcgcggccgagcccgagcccaagctctatcgcaacgccgccggcaacatccgctttggttcggatgccatccgtgcgctcggaatgcttcccgagtcctgcacgctcgattacaaggagggcgaggagccgacgtttgagcccgagcctgcgcccgttgtcactgcggatgatgagtctgccgcggttaccgctgccgttgccgagtccgaggcggtgtccgcgatcgatcttgcggcaggactggacattttggctcccgccgcgccggcgcaagacgttgcggacgagtctgacgacgattacgttgaacagccgaggcgcgtgtcttacgagagcgatactgatttctcggccgagattcccgcggcaacgccccatgccgatattgcatccgcgttctcttcgattggcgccagcgcttccaacttctttaagggtgcgcttgcaaagggcaagaaatttgtcgacgatttcgaggagaagcgcgctgccgcacgcgaggctgccgagcaggaggctatcgctcagcagcaggcagccgcggcggcacgtgagcacgcggcgcaagagttcgagcaaaacgaggctatgcagtccgcgcccgtcgacgccgccgaagctacaatgtctttcgaggctcagcaaccgacgtcagcggatgttgttgaggcaacaacatctttcgaggctcagcagcacgtcgatagcaccatgtcgtttgatgccgcgcagttcgattccacgataacgtttgaaaagcagggcaccgcgattgccgagccccttcctgtttccgatggacagggcgacgcggcagacgatgacgagcctattgatgctgccgaaatccaagatgccgccgaggacgagtccgttgaggccaactctgacgaagagcaatacgtggcagccgatcaaggtgattcgaccgaggtcgagcaggaggaagtggctgcggtttccgagactcccgagacggatgagtcgaggccttattccacgcagattttcaccatgccgaccccgagtggttccggtgccacggttgccaatgtcgctcccacccaggacgaaacggtcgattcccttatggcccagatttcctcccaggcatcgccgcgtccgcagatgaatgttcccgatccggcgtcggcaccgtcgcctacaccctcctcgtctccgctggcttcggtccccgatccgtcgctgccgtctatgaagcaggcaaacgttgcgtctcgcacgtcgctgttcgaccttcccgatccctctgcccaggtcaacgacccctttgctaccgcccaaggtcccgaacccacatcggcacccaagtctcgtaagcgcggcctgggtggcctgttcggtcgtaaaaagaaaaacgagcaggacagcatgagtgactggctgggcgtcgaagacgattacgatgccaagaagtccggtcgcggtatcggttcgtgggataactttgaggacgataacgatggctggaagggtggcgctacgtcttccgatggcgcttcttccgaagatatgctctcggctgtcgcctctatgggcgatgatgagctgcttggtcacgatatctggtttgtggcaacgggcgcctcggattgtgatggcgccggcatgaaggccttcttggcttcgcatcgcgataagctccgcggcgtatttttcatcaatcttgaatccgtcggcgccggtaggctttcggttgtgacggtcgagggcgaacaacaactgctcaagggcgatcgccgcatcatgaacctggtcagcaaggtctgcaagtcgttccatgtcgattgtggcgcgctcgagatgccctatgccaagaccgatgcctatgccgcgctcgaggcgagccgccgagccctcaccatcgccggcgtggacggcacgcgtctggcttgcgctcgtaccgaggacgacctgccccacaatgtcaacccgacgaacgttgccacggtatccgaggtcgtgaccgaggttatccgccgttcgtagacggagctctaaggagtcaacgtgttttcgtatattaagcgccattggcctgtctacgtgattttgaccttgattgccattgcgttgggatttggggctgcctacatcgtgggtgcgaagggctcgacccccgcctccgcaatcagcgaagaggtggagcaagaacagagcacgggtgccgatgggattcctgagtccgagcaggcaatcgttgatggtggatcttcgtctgcagagtagatacggcgatttacatgattgaaagcgggcgagccaggggactgtctcgcccgctttttcatcgcgctagcgcttctttgggatcgacctaaggcgagcgaaccatagggctgcggcacccgaggtcaggagcgcggtgatgcaagcagcgatgggagctgatcctgttgccggtaggtcctgcggtagggtacagcgttgaatgacgctgtcctcgtcatgtgactcaagtttatcgccgccaccgttgcggcaaagatcgacgcgcgcgctgttgatgagtgcggtttggggcgtataagccgacgttgcctgcatgtgtacgactgcgccccgagcgtctgtgccaaggattgctttggaatcgtcaaggtcgtcgtgctcatctttgagatcatcgcgggtccaagaatccgcatcgcttcgagtcgtaaagtcggcggctaccgcaccgtattcaattcgaatgcccgttacgacggtattggacgcaaggtcgagttctttcgcctcgagtgtggtggattccgtggtcgagacatccgccttccagaggtgccagccgtcgtaatcgacgaggcggcaatcctcacccagactctcccttacttcgtcggactcaagccaaggattttcgtgcccatcgtcaagtgtcgcgtttgccggctcatcgacgtctgtcgagtccaacggcgtcgtgcgataccacacgttgcacagaccattgaggtcgccgatggcgacgggggtttcgattgagatgaatctcgccgtgccgtctttggcgcactcaagatcatcggtaatcgtaaactcatcaacccaagtagcggaatcgtttcgagcatcgatggtataggagaaaagcccatcactattggtttgcgtcgtggcgcggtttttaccatcgccgttagccaacaggcccttttcgataggttggacaagttcctgacgtttgtcgacctgtcccttgatctcgatgggcgcatccttcatcgcgacggattggacttctcccgtatcctttatttcaaacgttatttcctcggcaaggtcataggtccgcggagacatcatttcgcgcaacgagtaggtgccgggtgcaagatgttcgacgcggtgtggcttgtcggatgaggtccaggagtctatttcggttttatcgggaccatataaggtgagttgtgcgccttccacttcctgctcaccgcttgcatcgaccttggagatatcaaccttggtgtaatcgtcggatacgttaagccgtgcttctacaacgggtgttttctggtcggcataagtaaggtcgacaatatgggatgtccgatcgagtaagaagcctgccggcgcttgagtctcgacaacctcgtagcgtgcggtgccagatcccagcgggaggtcgtccgcgcgtgcttctccagtttcatctgtcgtgacggtagcgacagtctcaccgtcgagcgctgcaatgctaccgtcggggcgcacgatatcacccgaggcacggatctcaaagacggcgcccgcgaggctgctgccgtctacggcatcggttttaacgatcctgatgtttccggtcgcggcgtggtcataatacgaggcgattgcaacgggcgttaggttcatgtcggcgggtatgtttacctcgatctccttgccgacaagatagggctctttggccgaggtttcgcgtacataataggtgcccggcacgagcgattcgggcagtgtgacggtcccggtcgcgtcagtcgtaaaggtgtccattacgttatgtgttggataccagcaagtttgtgagacagattcgtgattgctgtcgagtagttggaaggtgaatccggctagtggaacagaagcgcctgtttgggcatcacgttttacaatctggagatgcgtcgacagcgcgtggttgtccacgatatattgaagctcggcgccgttggaaatctgattggcctcgacggtccattcccctgcacgtttaaaaccctcggggacggtttccggaacctcgcgaaccgtgtagccggcgcggtcgtatgggatggctccatggacaccggcgggtcgcttgcctgcgccgaaccatgcttcgggctgatctttggtggaggcaaagccatagacgtttgtggtcagtgtgccaacaacctgctgagagctgttgctgacaacctcaaagacaacaccttccgccggctgctccaggccggattggtcgctattgccgtaatccttgaatttggaaatctcaaggttaaacgcaatggggatatcggaaacgcgagattcgatctcgaccacgcctgaatcgccgagctggtcggctccaacggtataggtccagctgtcgttggatggcaggtagccctcgggggcttttgattcgtagatggtaaaggttcctaaggggacatcggtgagggtggcccgaccgctttcgtcggtcgtgaggatttgtgcccatccaggggttgattgcgacacacacgtgaactctgctcctgcgagtgaagatcccacctgggggccggcattcgtcgcggcatcgagttttacgatacgcaggttgatggtgccgggctgttcatcaatggcgacccgcccgccgtcattccccgtggtaaaggcgatgcgatcacgacgggggacatagccggccggcgccttcgtttcaatcaggtagtatgccgtgttgggtaggagtgttgcttgcgctcgaccgttgctgtccatctggatggtgccaacacgcgcgccgctgccgctctcaaaaatatcgaatgttgccccgtcaaactgataagtattgtttccgctggtaatggcagcgtttgcagactgcttttggaaggaaacagagaccgccggcagtacatagagcatgtcttgacgtctgctgccgcccgatacggttcctagatagcgccgcgcgcggtgcggtgcggctttgatgcttcctgattttgcgctgtcgtggagccaccgcgccgccgccacgacttcattgtcagcggtaaagtgcccactcttggttttgccctgagcggtcgtgtaggagtaggtaccgtcgacatgggtagtgccgttgagcatccatacggcaagctgggttgcggcgcgggcgcgatcgggtgaaagatggtagccgccaaacgacgtggcggtaggatatccgtgacaaacgattgccgcgaactcgtcgtcgagccaaacccagccttgatcaaagttgagccatgggccgcccggcttggtggggccggggcgctcctggttcatgcagtaggcaatcgaggcgtcttgagcttcatacttgccgataaagaagggcccacaatcatcgctaatagtgcggaagccgagctggtcgtagccatcgacggcaaatgcggctcccggtgccaggtagccgaaaagcaggaagaggagcaggagcagcggacctgttgcgattgcgctgtggacagagtgcgtgggtgcgttggacatggctgctccttatccctcgtgcgccgcatggggaggctgcgacgcgtaggatgaggctacccccgaggttcatgcgggtaagtaccggagcctgaccaaaagcttgcccaattcctgataaattgagctcaaatacaacaatcaagcaaaagcgcaggtagaagatagggagaacaggaagtcaaaggtcctcatctccacaattgacgcgattttcaaacgaatctccacagctaaaacaagcatcgccactcttgtatcgaacaagacaaccgcgttatactatcccccacatatgcgggcatcgccaagtggtaaggcatcagcttcccaagctgacactcgcgggttcgagtcccgttgcccgctccagtaaaaagcacaagcacggcagcgttacgttgccgtgctttttactaccaagcgccgggactcgaacccgccagggtgcgagcgttaagcaaacgcgaagcgtttgtagcgagcaggcgaaggcgccgacaggcgccttaagccggtgcggatttgcgaagcaaatacgcagacgtcccgttgtccgctccatggagcacagaagacctcgggacggccaattcaacaaagtcttccccatcgtcaccgtgaatccgaggggatcgaccgcagccggtgcgtatttgcgaagcaaataacgcagacgtcccgttgctcgctccaattccaaaatgttaggttaatgcctgctgcccatacttgcacctgcgcacggtacaatggatgggttacgaccaacgtgccaataaccaaaaaggagccgctatgatcgatcgctatacccgcccggagatgggacacattttctccctcgagaacaagtacgccatttggcaggagatcgaggtcttggcctgcgaggcccaggcggagctcggcaagatcggtatttccaaagacgaggcccagtggatccgcgaccatgccaactttgagaaggcgaaggtcgatgagatcgaggaagtcacgcgccacgacgtcattgccttcctgaccaacatgaaggaatacatcgatgccgatgttcccgagggcgaccccaaacccagccgctgggttcactatggcatgaccagctccgatctgggcgacacggccctgtgctaccagctcacccaggcctgcgacctgatcatcgaggatgtcaagaagctcggcgagatttgcaagcgtcgcgcctttgaggagcgcaacacgctctgcgccggccgtactcatggcatccatgccgagccgatgaccttcggcatgaagtttggctcttgggcctgggagctcaagcgcgatctggaccgtcttgaggatgcccgcaagaacgttgccttcggtgctatctcgggcgctgtcggcacgtacagctccatcgagccgttcgtcgaggagtacgtctgcgagcacctgggcctggtccacgatcctctgtccacgcaggtcatcagccgcgatcaccatgcctatctcgccggcgttctcgccaccaccgcggccacctgtgagcgcatcgctaccgaggttcgcaatctgcagaagaccgatacactcgaggccgaggaaccgttccgtaagggtcaaaagggcagctccgccatgccgcacaagcgcaaccccatcaccatggagaaggtctgtggcctgtcgcgcgtcgtgaaggccaacgcgcaggttgccttcgacaacgtcgccctgtggcacgagcgtgacatttcgcactcctctgccgagcgcgtcgcccaggccgacagcttcatcgccctcgaccacatgttccagtgcctcattcgcgttatcgacggcctgcaactgtatcccgcccgcatgatggccaacctcaataagacccgcggcctcatcttctcttccaaggtactgctcgccctcgtcgacacgggcatcacccgcgaggacgcgtacgccattgtgcaggagaacgctatggcaacctggcacgaggtacaggattgtgtctccggccccacctttaaggagcgtctcgaggccgacccgcgctgcaccgtcagtcaggagaagctcgacgagatctttgatccgtgggacttcctcacccgtatcgacacggtctttgatcgtctggagcagctgagcttcgagtaggttcgggcataacgttagctttttagggcgctttgctggtaatgtgtgttgccggcaaagcgcctcgttgcatttagggaaagacggggataatagtcgtctcgaataacattctgagaggggatcgcatgatttcgtttgattacaagcctcagggcgtgtgtgctcgcaatattcaccttgatctttccgatgacggcaacaaggtgatgggcgttgagtttaccggcggctgcgacggcaatctcaaggctatctccaagctggtcgagggcgctcctgccgatcgcgtaatcgaggttctcgccggtaatacctgcggtatgaaaaagacctcctgcgccgaccagcttacacgcgctatcgaggccgctcgcaccgagatcgcctaatgggtatcgccgatcacatcaagaacggaatatcgcgtcgcggctttgtactcggtggggctgccgcgggcgctgccacggtgcttgccggatgctcgaaaaaaacgggcaccagcgatgatgccgccggcgagccgcaggttatcaaggatgattccaaaatcatctcgattacggatgagtacgaggcagtcgacatcgatcttgagccggcggcgtcgtggacgctgcctctgggtacgctgctgtactactgcgacggcgattacgccgcggcaatgatggcgcccgcatcggcactgcacgccaacacgctcggtgtgctcaacctgggcgatggctcgcttaccacattaatcgaggatcctatcgagggcacgggatatgcattctacgatgtccgtgccggcgacagcgtattcgcgtgggttgagatgaactttgccaattcatcgtggaagctctacggtcaaaatctgtcgggcgcttcgctctctggcgacgtggttgagctcgatcgaggtggcaaggactatgatccgccgctgtttacggcgttcgggtcatcagtcatctggtataaaatgccctcggcaggtggcaataaaacgagtagcgattcgttttgctatcgtcgctcgcttgatgaatccaaggccgagacaatttggaaatcgacgggtcgctttgcatcggccccgcgcgcgagcgacggcattttgaccatctcgccgcgtgtccgcaacgacgagggcgtctactacggcataacggcaatcgatctgaccgacggcaacaacaccaagcgtgcccagttggtccttccttcgtcagtttcgcctttcgaggccgtatatatgggcgataccttcgtgttttctatcgaggcggcctatagtggcgtgggcagcctgggcaatatgggcacgtatatcggtaatgagggagggccgtacctcttcctgtcacgcgagccgctcgcatgtgcggctggcaagaagaataaataccttgttaaggtacaggcgtcgcatttcctgatcgacacctctgccaagacctatggctcgctgctgtcgcccgaccgcgctttggagtatggcgattatccagctacggcgggaaaatcggactcattccttacgtacgccacggtgcgcaacagccagggtataccagagacggtcactgcacgcctattctctctttaagcttagaggggttaaaaaggcgccaacaggggaataaacgcgttgtaattgtgagtaccgcccgccgagctgccgcgtcatagcggcatctggcgggctcaggtgcgttaaaatgggcttgttcttagctaattgagacaggggggccgtgttatggcttcagatgcaaaaaagattctgctggtcgaggatgagaaggcaatccgtgacgccgtcgctgcctatctcgagcgcgaaggctactgggttgtgggcgtcggcgacggtcagtccgcgatcgaggagttcgagaagcatcagttcgacctggtcgtgctcgaccttatgctccccaagattcccggcgagcgcgtttgccgcaccattcgcgatacctcggatgtccccatcatcatgctgacggctaagggcgagatcgaggaccgtattatcggtcttgagctcggcgccgatgactatctgattaagccgttctcgccgcgcgagctcgtcgcccgcgttcgtgctctgttccgccgtgcccatcaggccgacgagcccgccgtcgaggtgctcgacttcggcgatctggtcatcgatatctcgggccacaagatcttggtcgagggcaaggaagtcgatctgacggcttccgagttcaagctgctcaccacgcttgcccgccatcccggccgtgtgtataaccgcatggagctggtcgagaaagtgctcgggtatgactttgagggctatgagcgcaccatcgatagccacgtgaagaatcttcgcgccaagctgggcgatgatcccaagaagcccaagtggctctacaccgtccatggtgtcggctatcgcttcgaggctccggccaagaccgataagtcggacgagaaatagggaaatcacatatgacacctgcgcgctttgaaatcggacaaaagcacaagcaggagagcgaggcgggttccaaggctagttggaacacgcctcgttccgattcacggccaacgatgagctatccctcgcgcatggcacttgcttttgctctgacatcgctcatgacggtattggtgctggtgggcgttgtctctgttgtgtggggcacggtcttttcggattacacacgctccaatatcgtcgaaatcgcaaattccgctgccgagaagttggcaacctcatatgaggaaaacggctcttggaccgcgggagaactgcgcacggtcgcaacgtcgagtttggtttccgacgatctgggcatgcaggtcgtcaataaaaagggcgtgatcgtttatgacgattcctggccctcggcaagcgccaccgccgatgtacgcgaaaaccaggctacgactgacgacacgagcggcaagagggcatcgcatagcccggtctcgtctgctccaaccgactccgatagcgttgctaacgtcgagattgtaacgtcttccggcgagcatgtcggacaggtaaagctgtgggccatcggctccgacgctctgctcaccaaggcggactctgcgtttagggagaagacctttaacgccatggccctcgccgcggttgttgcaatctgcatttcggtcgttatcggatcgctcgtgtcgcgcatgctcaccaagccgattcatcgcatcaccagtaccgcaaagcaaatccgtgacggcgacctgtcggctcgcacgggactgcgcggtgatgacgagatcgatcagctgggtgagaccttcgatgagatggccacttcgctcgagaaggatatgaaacacgagaagcgcctgacctcagacgttgcacacgagcttcgcacgccgcttatggccatgctcgcaacggtcgaggccatgcaggatggcgtgtatcccaccgacgatgagcatttggagaccgttgcttccgagacgcgtcgcctggctcgtctggtgcagcagatgctcgacctgtcgcgcatggaaaacagcacggctccgctcaaccttgagccggtggacatggttcctttcgtgcgttccatcgtcaatgcccaggagcgcctgtttgtcgaccgcgatctgcgcctgcgttttgcggacgagacccagggtcacgacgatgtcgtcgaggccgatcccgacatgatcacgcaatgtgttatcaacctcatgagcaacgccatgcgctacacccccgagggcggttgggtcgtggtgtcggtgctcagtgaccgcaagcacgtcagcattgccgtttctgataccggcatcggtattgccaaggacgatctgtcgcgcatcttcgggcggttttggcgcgccgatgccagccgcgcccgcgaagctggcggcctgggcgttggcctcgccgtgaccaagcagatcgtcgagcgtcaccatggctacatatccgtggagtcggagcttggaaagggtacgacttttacaattcatctgccccgcgagcacacggcggacgcggcatctactacaatggagcactagcttttcgctattcggtgaaggaggggccgcgtccctgccgctccgagtttgcgaaaacatgcgggaaaaaacccgcatttctgtcgtatttaggtaaggagtgactcacgtgacaacgatggagcgtcgtccggattcccgtggcaaggttcgtgatatttacgatgccggtgaaaacctgctgatggtcgccaccgaccgcatttctgcgttcgacttcattcttcccgacgagattccgtttaagggagaggtactcaatcgcatctcggcattctggttcgataagtttgccgacatcgtccccaaccatctcgtttccatcgacccggcggatttccccgaggagtttgctgagtatcgtgactacctcgctggccgcgccatgctggttaagaaggcccagacgattcctatcgagtgcatcgtccgcggctatctgaccggttcgggcaagaagacctacgacgagaacggcaccgtctgcggcatccagctgcctgagggcctgaccgaggcttccaagcttcctgagccgctgttcacgccgtccacgaaggccgagatcggtgaccacgacgagaatatctcgttcgagcgttgctgcgagatcgtgggcgaggacatcgccacgcagattcgtgacctttccctcaagatctacaaggctgccgccgagtacgccgcgacccgtggcatcatcattgccgacaccaagttcgagtttggtgtcatcgatggcaaggtcacgctgatcgacgagtgtctcacgcccgactccagccgtttctggcctgctgccagctacgaggagggcaagatccagcctagctacgacaagcaattcgtccgcaattggctcaaggccaactgggatatgacgggggagaccccgcacctgcccgccgaggtcatcgatggcacgtccgagcgctatcgcgaggccttccagatcatcacgggctcccagttcacaagcatgaaggagaacgcataagtgagtacccgtagcgccacgaacaagcgcacgcaatcccacgaagttaccggggttgcgcgcaagtctgccgcatctgctaagcccgcccgccaagcagcgagctccgttcgcgtcgtgccggcttcgtctaaggcacgccgcaaagagctcgagaagggcgagaacctcgagggcctctctaaagaggagaagcgcgcccgcaaggctaagcagcgcgccaaggaggaccgcatctatacggtgtcgaatatcctcctcaagcaggacgaggactacaccaagcgccgtcgcatctggtggattgtgctcgccattggcatggtgctcgtcgtggcaatttgggcctcgctgtacttcgctcccgctggcatggtgtccagccctgtccagatggtcggcattgttttgtcctacgtcatcattttgggcgactttatctatgacttcgctcgtattcgtcccttgcgcaacatgtaccgcgcgcaggccgagggcatgtccgagaacaagctcaacgctcttattgagcgcgcggctgccgaggaggacaagaaggactccaagaagaagtagcgtttgcatacatacttatcgctaagatataaggcgcgtcgtttttgcggcgcgcctttttactgttctatagatagatggagtggcacatgattcgagctgccctgacggtcgaagaggctctggagggcatgaaggccctggagcccaagattaaaaactacgcgcgcctggtcgtccgcaagggcgtaaacgtcaagcccggccaggaggtcgtcgttcagtctccggtcgagtgcgcgccgtttgcgcgcgtggtggtcgcggaggcctatgctgccggcgccggccacgtgacggtcatttgggccgatgatgccgtgacgaggctcacgtacgagcatgtcgagaaaagctattttgagcagacgtccgagtggaagcgcatgcagctggattccttggcccaggatggtgcctgctttgtctttatcgagggtgcggatcctgcggccctcaagggcatcgatccagccaagccggccgcggcatcaaaggcgaggaatacgcagtgcaaagttttccgccgtggactggattacaacatcaatccgtggtgcatcgccggcgctccggtcgtggcttgggcgcacgaggtgttcccgggagacgccgatgaggttgcaatctataagctgtggaatgcgattctgcacaccgcgcgcgccgatggccaggacccagagagcgactgggaactccatgacgccgcattcgaaaagaacctgcgtttcctgaacgacaatcgtttcgactacctgcattacaccgcggcaaatggaaccgatctgacgattggcatgacgaaaggtcacgagtgggccggcggcaagggcaagacgcccgatgggcaccccttcttccccaacattcccaccgaggaagtcttcacttcgcccgatcgcatgcgcgccgacggtatcgtgtactcggccatgccgctcatccatcacggcaataaggtcgaagatttttggattaagttcgagggcggccgcgtggtggactacgacgcccgcgtgggcaaggcaacgctcgcaagtatcatcgatactgacgagggcgctgctcacctgggagaggtcgcgctcatttccaagaacacgccgatccgcgaaagtggtgttctgttctacaatacgctctatgacgagaacgctagctgccatctcgcgctaggtgtcggtttccccgaatgcatcgagggtgggtatgacatgtccaaggaggagcttctggagcatggcgttaacgtctcgagcacgcacgtcgattttatgatcggcacggacgacatcgatattgtgggcattacgcctgatggacgtgaagttgtgattttccagaacggccaatggagttgggaatagtcccagaccgtggtacaatgccacccgcgggccgttagctcagctggcagagcaggggacttttaatcccaaggtccagggttcgaacccctgacggcccacccaaagattgttgagacggtcaacttcggttggccgtcttttttgtcgccctttcatgggttcgaacccgtcggggcgcggagctgagtaaacgcgtgagcgtttgccagcgcagcgcgcaaggcgcgaaagcgccgcagcggccgcctgcgaagcaggctgaacccctgacggcccacccaaagattgttgagacggtcaacttcggttggccgtcttttttgttgccggtgcacgggttcgaacccgtatctagctatatataagaacgcttggcgaacaaaacccgccttttaccgatgggaaacaaataactgatgcctttggagtaaagtagcgctccagagatgaccgatgtctcaatacacataaaacagctggtcatcgccaatatcagaagccaatgcttcagttttaacctcagtgatgcgactgagggacctattcatttgtgaacaaaatatggagtgcgcgattcccgcccccggcgcccctccggtctggcaatatatctccttgccgcgcggcccggtggaaccgggaaccagcgcaggcgtgcaccttgagaaccggatactgcgaggatggacacaccagttgtgtcgcatccgggcagacatcgaaccatttgaaatggtctaacttggatttgtttttcgcaaggccgccgagaggcggccccgagaaattccttttcctatactagaaccatatgaatcgaacggaaccgatcagctaatagttgtgaggaccggacgggctcgaagcccatttattttggacggagagttcgatcctggctcaggatgaacgctggcggcgcgcctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtcgacacgcataaaaagcctcccatttctcgtgtccaagaaatgggaggcagttcatcttcacgggcgggggcgtcttttttccgaaaactggtacgactcgtttgaaagctcgcaccctcagattcaccttgatgtttggcatcagccaacggctacatgctttgaatcacttgtgcttggcatttcggatgcggccatctcatttgaggaaccaagggacagtgtcctctcttcgaaatacttgggtgaaaaggagctcaaggttctttcgtgcccagcgggtcatcaatctgtgggtgctatgaccgttcgtgagttactgggcggcaggttagctgttcctattaatttgtcgccctgtctcaatgcgatcaatcaatgccccgaagctcagctggttaatttccgcttccgcgacgtcgaatacggaaacagagcgcaggctgagtttcttcaagccgggggattgatattgggtttttctggctcttctctcgcatcagatgggtcggaagtgagcgagtgctctattgaaggctcgcatgacgtagccttgaccatctacttttgctatcgacaaaatgcctggaccgatcgacaccagacggtatttcttcacctattgcgtcatcttgcttcgtgaggccatttggcctcgtgtcgtcaagtgaatgttgacgccttgtaacacatgactgacggctttgccctcatgcttttccaagattccgatttagattgttgactcttggagggcggagcatgaaaaaccgtacggttttgctttatatgacgtttgtttttctgtcgaacttcagcaccattttgtattttctgacggtttaccttgaattcgtcggattctcgatggtggcgatttctagcatgatgattgcatatcaagtgagcaagttcatccttgaagttcccactggctatattgccgataggtttggacgaaagacaagtggtctcgttggcgtcgtggggatgcttggatactacgctgccctactcctcgtccgttctcctctgcttttaatcggcgcgtttgctctcaaaggttttgccgctgcatgtgtgagcggatccatagaagcgatttacattgacagcgtttctcaggaccagctcgtaagacttaatgtcgttgagcgatttgttttctatgcctcttttgccatctccgcttgcgtgggcggtttcatttcgtctgtcggtgcatatctcattggtctttcggcagatatcatcgcaatggtgttgacgttggttgtcgttgtctgcattcctgagatgcgaagagggggcactgcggggacacctgagcgtggaattagcccgaagatgatcggtgccgctattgcgtgtaacggcattcttcgttcagcgttcatcatggactgttctcaagcatttgcttttgtcgcccaggaagactttttctcactgttgcttgcgggtcgcggaatgaatgccgtcgcttcgggtgtgatcattgcggtccagctccttgcctcagcctccatggggcttattgtgcccagtgtgattgctcatgtcgacaagggccgttttgcgcgtatttgcggcatcattcgcttagtattgacagctttgtttctgatcccccttactccggctaatttgctgcccgtgttctatgtgctgcagacggttgcgtactcgttgtttgccccaatcaaatactcagttttccaaaatgctgccgattcttcgatgcgctgttcactgatttcggttcaaagccagatggtggcggtgggtgccgttcttttctatctgctcaacgctgtgttgagtagcgttgcaggcattcgagtcgtattgcttgttgcgctcgggatttcttccttggtgtatatccccgcgctcttttgtcttacaagtcaaaggccgtgagtatttggacatcgataacttatatatcaacgcaataaacccgagcgcgagggcgtttgggtttattattgaagcgtatgtaacctggcggcgccacaccgcctgttagtagggagacacatgaacgttctggtcgtcaacgcaggatcttcgacccttaagtatcaggtcatcgataccaagtcccacaaggtgtccgcaaagggctcctgcgagcgcgtctgctttaccggcggtaccttcacccacgctgccaacggttccaagaaggtgaccgagaacatcgagttccccgaccacaaggtcgccatcgaggtcgttctgaaggacctcgaggccaacggcgtcaagatcgagggcattggtcaccgtatcgttcagggcggctggtactttggcgactcctccctcgtcgacgaggacgttctcgccaagatccgcgaggtcgctccgctggcgccgctgcacaacaaccccgaggccaacgttatcgagtactgcctggagcagtatcccgacctgcccaacgttacggtctacgacaccgctttccacttcaacatgcccgaggttgccaagacctacgcccttcccaaggatgtttgcgacaagctgcacatccgtaagtacggcgctcacggcaccagctatcgctacatctccaagaagatcgccgagatgaccaacggcgaggcccgcaaggtcgtcgtgtgccatatcggctccggcgcttccctgtgcgccatcgaggacggcaagtgcatggacaccaccatgggcttgacgccactcgacggcgtcatgatgggcacccgctgcggctccatcgacccggctaccgtgtgctacctgcagcgcgagggtggctacaccttcgacgaggtcgacgagatgatgaacaagaagtccggccttttggctgtgaccggcggcaagaccaacgactgccgcaacgtcgaggagctcgccgccgctggtgaccccgatgctcagctcgccttcgacatgtttgtctacaagattgccgccaaggttgccgagatggctacttctatgtgcggtatggacaccctggtctttactgccggcatcggcgagcacgctccggctgtccgcgctggcgtggccgaccgtctggcctttatgggcgtcaagatggatcatgcccgcaacgccctgcgtggcgacggcgcttggtgcctgtccgccaaggattccaaggtcaagattttcgtcatccccacggacgaggagttcatgatcgcttccgacgtcgagcgcatcgtcaacggcaagtaattgcaagaggggaggggctggacgaccgagcgccgttcggccccccttttatgctcgttgggcgatatgcctgatagctatttattaagttgtgataacttcttattaaaatgcggccgccttaaggggtctgcgtcgaccgtattgcactgcaaaggagtctcatgaacgtacttgttgtcaacgccggcagctcaagccttaaatatcagcttttggataccgatacccgcgaggttttcgccaagggcaactgcgagcgtatcggatcgggcatgggcatcttcggccactccgagaacggtggcgccaagcagaccgaggaggtccccttccccgatcatcgctctgctatcgctcgcgtgctcgaggagctcgagaagaccgactttacgattgatggcattgggcatcgcatcgttcagggcggctggcacttcgatgattccgcagttgtcgacgacgaggttatggccaagattctcgaggtggccccgctcgccccgctgcacaactacggcgaggccgcggcgattgagtattgccgtgagaagtatccggagctgcccaacgtggcggtcttcgacacctcgttccacatgaccatgcccgaggtcgcctatacctacgcgctgcccaaggacgtgtgcgacaagtaccacgtgcgcaagtacggcgctcacggcacgagccaccgctatgagtggatgatggccaaggagatcctgggttcgcgctgccaccgtctgctttcgtgccatttgggtaacggtgcttcgcttgctgctatcgaggacggcgtgtgccgcgacaccacgatgggcctcacgccgcttgacggtctgatgatgggtacccgttgcggttccatcgacccggccaccgtgtgctatcttcagcgcgagggcggatacagctatcaggaagtcgatgacatgatgaacaagcagtctggtctgcttgccatctcgggcatctccaacgacgcccgcgacatccgtacacgcgcctctgagggcgacgagcgctgcctgctcgccttcgatatgttcgcctacaaggccatgcagcaggccggctccatgatcgcttccatggcgggcgtggacaccatcacctttaccgccggcatcggcgagaacgactggtcgatccgcaaggccttctgcgactgctttgagtggctgggcgtgcgcatcgacaacaataagaaccgcgaggccgtgggcaacggcccgcaggtcatcagcgctgccggctccgccgtcacggtcatggtcatccccaccgacgaggaatacatgatcgcccacgacgtcgagcgtctgaccaagaacaactaacgtgcgcatttgcaagtaaacgaaaggcctccagagcagcagctccggaggcctttttgctagcaggcggacgacggaaactccatcccatttcgagcgcaaatactgggacacgctttccggttgaggcacgttgcggaaagtgcgacccacaataaagcaaaattccgtcccaaagtttcccaaacaggccccaagcggaagccacatcccacaatccgcctccaaactgggatgtagtttccggcacaacaaccgccgaagcccaccggcctttcaatctccaaagtgatcatcatcagcaacgcctgcgctcccagcaacggcacccatccattcagattttcagctccagctcgtagccaagccgccgtccaccccggattccctgattgctacgtggcggcagggaccctacagggtaaagctctgaaaatattccgcactgacgcaagaaacccccgccgcacgaagttcgcagcgggggtttcatgcatatccgaggacgttttcagagctttaccctgtagggtcccgaggggatatgtccgctactcagccatctgagcctggacggcggtgatggccacgacacccacgatgtcgtcggcagagcagccgcgcgacaggtcgttgaccggcttggcgatgccctgcaggatggggccgtaagcgtcggcgccggcgaagcgctggaccagcttgtagccgatgttgccggcctcgagatcggggaacacaagcacgttggccttgccggcaacggaggagccgggggccttgagctgggcgacggtgggaacgatggcggcgtcgagctgcaggtcgccatcgatggcgagctcgggagccttctccttgcagaacttaacggcctcctggaccttcttggcgacctcgccgccggcggagcccatggtggagtaggagagcatggccacgtgcggctcgacgctgcccataaaggtggaccaggagtgagcggaggcgatggcgatctcggagagctcgtcggaggacgggttgatgttgaggccgcagtcggcgaagatcagcgtaccgtcggtgccgaactgcggggtgtcggtgcacatcacgaagaaggccgagaccagcttggtacccggggcggtcttaaggatctgcagcgcggggcgcagggtgtcggcggtggagtggcaggcgccggagaccaggccgtcggcgtcacccatcttgaccatcatggtgccaaagtaggtggcgtccatcacctgggcgcgagcctgctcgatggtgacgcccttcttggcgcggagctcggcaaacttctgcgcgtactcctcgtgcttctcggcattgcgcggatcgatgacggtggcgccgggaacgttgatctcgtcggggttgcccaggatgacgatctttgccaggccctcctcgatgatcttggtggccgcgacgatggtgcgcggatcctcgccctcgggcaggacgatcgtcttaaggtcggccttggcggcagacttcatacggttaaggaaatcgctcatgttactccttacaagcgtttcactaagctccaggcgcccggctgttcacgaataaacccgctgctagcgggtttacctttcaaatttgtacgccgcggtgcttgagctttccttgtgtggcaagctcattataggacgcattagcgctataatcgctctgataaatatgtctcgaagaatgttcgagaaaagcccagctaacgagcccgtggcttttgacaaggagtatcgatgcagattacctcaggcctgcctgaaggctttaacgccggcgcgtacgacatgattgtcgtcggtgctggatatgccggtgccgtttgcgcccgccgtcttgccgagaccatcggctatcgtgttgccgttttggagcgccgtagccacattgcgggcaatgcctatgactgcactgacgaggccggaatcctgatccacgagtacggtccgcatatctatcacacctttaacgagcgcgtgcacaatttcctgtcgcgctttaccaagtggacggattatcagcacaaggtgctcgccaacatcaacggcacccttatgcccgtgcccttcaaccacgcgagtctcaagctcgcctttggtgacgagcgcggcgaggagctgtatcagaagctcgtggagacctttggcaaggatgtcaaggtgcccattatggagctgcgtaagaagaacgaccccgacttggccgaggtcgctgattacgtctacgagaacgtctttttgcattacaccatgaagcagtggggccagacgcccgaccagattgatccctcgatcaccggccgtgttcccgtctttgtgggcgatgatgaccgctacttcccgcaggctcccttccagggcatgccgcaggacggctataccgcgctgtttgagcatatgctcgaccacgatctgattgatgtgttctgcgacgtggacgcccgcgacctcttcgagatcgacgagaccaccgtcaagatcgacggtaaggtctatggcggcgagatcgtctacaccggtccgctcgacgagctgttcaatctcgacctgggcgccctgccgtaccgtacgctcgacatgaagttcgagacgctcgatatggatcagttccagcccgtgggcaccgtcaactacaccacgagcgaggattacacgcgcatcactgagttcaagaatatgactggccaggtcctgcccggcaagaccaccatcatgaaggaatactccaaggcctatacgcccggctcgggtgagacgccgtactacgccattcttgagcccgagaaccgtgagctctatgagcgctatcttgagcgcgtccagaacctgacgaacttccacccggtgggtcgtctggccgagtatcgttactacgatatggacgctgtgaccaattccgccctcgatctttcggatgagattatcgcctgccatgcataaagtcataacattcggtattccctcgtataacgccgccaaggacatggaccattgcatcacctctatcttggaggggagcaattacgccaccgatatcgagattatcgtggtggacgacggctccaaggacgagacggccgccaaggccgacgagtgggaggcccgttaccctggaatcatccgcgcggtgcaccaggagaacggcggtcacggtattgccgtcctttcgggtctgcgcgaggcgcagggcacctactacaaggttgttgattcggacgactggcttgacggtgctgccctttcgaccatgctgtcgattctgcgtggctttgaagagcgcgaccagcgcgttgacctgtttatctcgaactacgtgtacgagaaggtttacgagggcacgcataccgctattggctacaaatttgccctgccgcgcaaaaagatcttttcttgggatcagatcggtcatttccgcctggaccagaacctactcatgcacagcctgtgctatcgcacggatgtgctgcgcgagtccaaccttcccatgccgccgcacacgttctatgtggacaacatctacgcctacgtgccgctgccgcgttgcaagaccatgtactacgccgacatcgacctctaccgctactttatcggtcgcgagggccagagtgtcaacgaggccacgatggtcaagcgtctggaccagcagttccgtgttacgcgtatcatgatggagtcgtaccacctgtacagcgatgtcgagtcgtcacgcctacgttcgtacatgatgggctacttcaccatgatgatggcgatctgctcggtgctcaccaagctttccgaggaagattgcgccgacgagcgcctaaagacgctgtggaatgatttgaaggcctacgacgagcgcatgtatcgtcgtgcccgctacggcgtggtcgggttcttcaccaatctgcgcggacgggccggagacaaaaccacgcttggcctataccgtcttgcctcaaagatcttcaaattcaactagctgctgagtaatcgctgttgataggttgactgggccccttggcctttagtttgctactgcgaacagtcctgctcgcacggaaagcacattaagtgctttccggctcgtgcggaacttgtatcaaactaaaggccaaggggcctctgctataagaatcgattgtcagtttatttgaatttgaagatcttcgacgcgcggtacacaggggcctgggctgaaaagaatctggttggtaggttgcccggtggggcttggttatgtttgtcgcgagttccgcacgagccgaagagcacttaatgtgctcttcgtgcgagccaggactgtagagcagcaaacataaccaagccccaccgggcaaccggtcaggttaggctacttcgcggcgccggggatgccgtgggaggttttggcggttttggctccgtttacgatggcggtctgtagggcccttacggcgagcatgcccagtaggtctaggggaacggcggcgcttgtctgagcgtctagtttgccgctggcgagggtgtagatggtgtcgccgtcgttggtggtgtgcgtgggacggatggcgtgtgcgtaggcgtctgcggccatctgggagaccttggtggcttgtgccttagtgagttcgacgttggtgacgatgcagctgatggtggtgttggtgcggtcgagcggcatctgcatggatccggcggcagcaaaggctgcgagttccatgtcgacgatctggtcgctatcggctgcggcgcgcataccggcgacccactcgccggtgaaggggtcgacaacgttgccgcaggcgttgactgagaccacggcgcccaccttgatggggccgagcgccacggcggcagcgccaaggccggccttcatgcaggtagcggggcccatgagcttacccacggtagcgcccgtgccggcgcccacgttgccctgttcgagcttggtgggggtgttgtcgagtgcttcgcgcacggcggcgatgccggcctcaatgtcggggcgaacggtggggttaccaaaggcgagatcgaagatacagctggagcacacgataggcacctgcgtggggccgacaggcagaccgataccgcggctctcgagttcgcgggccacgccgcttgcggcttcgaggccaaaggccgatccgcccgaaaggcagacggcgtggaccttatcgacggtgttttcgggacgcagcaggtcggtctcgcgcgaagcgggagcgccaccgcgtacgtcaacgccgccggtggcgccctcgggtgccacgattacggtgcagccggtgcctgcctcatcgtccgtatagttgccaaagcaaaagccatcgacatcgcaaacgtcaatggctttgagcagtgtatccatgtttaactcctatcggttttccgccgcgccttgtgcccggtcgggatccgtacggtacgccaaaattgtaggcgccgggggatacccagcgccagatgcaattacgagagtttttgaatcgcgcgcgcgacgcgggcgatgggtaggcccaccacgttatagaagtcgcccgaaatatcgtgcacgagcatgcgtcctcctgtgccctgaatgccgtaggcgccggccttgtccatgggctcacccgaggcgacgtagtgctcgatctgctcgtcggtgagctcgtagaacgtcacgtcggtcacatcgacaaaggacaggctctcggcggcatgcggggcggccgtgtcgcctgccttaacgatgcagacgccggttgcgacctggtgcgtgcggcccgaaagctcacggagcatggtgcgcgcttcgtcctcggttgccggcttgcccagaatcttgccgtcaaaggtgacgatggtgtcggccgcgaccgtcagctcattgggctcggcatgttcggcggcaacggcggcggctttggcgcgtgctaagcgttcaacgagcgtaagcggggcctcgccatcaaacggcgtttcgtcgatatcggcaggaatgatgcgaatgtcatagcccgcctcgcgcatcaactcgatgcggcgcggtgattgcgaagccaaaatcatagctgaatgccctcggcgaccttatcgacggccttgtcgccggcgagcgtgcgcagcagctcaagcgcaaaggggagcgactgggccatgccgctggcggtgatgatgttgccgtcttgcgtgaccttctcgccggtataggcgccttcggggaagcttttctcaaagccagggaagcacgtggcgtggcgcccctcgagcaggtcgagctcgcccaggataaacggggcggcgcagatggcggcgacgtgcttggttgcggcgaactcgcggaccacgtcgcagacgcgctgatcggcgcgcaggttggtagcaccgggtaggccgccgggcagcacgacgcagtcgtactcgtcaaagtcgatctcatcaaagagcgcatcgcaggtcacggggatctgcagcgagcttacgacctcacgcgtgggcatgatcgagacgagcgtggcgcgcacgccgccgcgacgcatgacatcgaccatggtcaagcattcaatagtttcaaagccatcggcggcgagaacggcaacgctgggcatgggggttcctttcataggcggcatacaattagccgtcttataccccgaagacctccgcttgccacgctcgatttcccaatgatttttctgagcaatgattaagtggctagttgcgcctaaggtggacgacagtctcgcagtggaaggtttgcgggaacaggtcaactggcgtgatctttacgggggagaaggtgccttcctcgacaaagcgcttgaggtcgcgcgccagggtggccggatcgcagctcacgtaggcgacatcgcgagcgctcgtgctggcgataagatcgatggcttcgggggcgaggcccgcacgcggcgggtcgaccaccaagacgtcggcatcctggtcggggaactcgcgcaccgcgtctccgccaatgacgtcgacgttatcaagcttgttgatttccaggttacggcgtagatcgcgcacggcggggccgtaggcctcgacggcagcgacaaagtcgcagcggcgggcgagcggcagggtaaaggtgccggcaccgcagtacaggtccacggcaagctcgtcttcctgcgggtcgagcgcttccatgacaagctcgatcaaaatctcggcacccttggtgttgacctggaaaaaagacggggcagacaagcgcatctgaccctcggcgatattctcggtccatgagccctctccggcgagcatttcgaccttggagacacggcgggccttcttttcgcccttgctcatcacgcgcacgatgctcgtgggatgagcggcgtccgccagcacgcgggagacctgcgagcgcggaaaagagcctgtgggcgtccagagagcgacctcgagtgccttggtgcggcgcgatgcgcgaatgcccacgcgttcgagccccaagtcatggctgccgcttagatagttgagtgcgccgacgaccgatttgagcgccttcgggaagcgcttatcgaacagcgggcacgtatcgacggtcacgattttgctggggtcgacaccatgcatgccaaggcgcacgcgaccgttgacgacggtcggttcgagctcgattttattgcggtagccccagtcgtccttggtgtggcagatgggctgtaccaactcatcgacctgctcaggcgcgaacttgccgatgcgctcgagcgtggagcgcaggttttgctccttggcggcgagctgtgccgtgcgtgagagattgccccacgagcagccgccgcagatgcccacgaaggggcagggaggctgaatgcgatcggggcttggctccagaatctcggtggtgcgggcgcgcatgaacgacttgccgtcctgtacgacctcggcctcgacggtgtcgcctgccacggcaccctgcacaaagacggccttgccgttgtcggcgtgcgccagcccgtcggcgccgtaggtcatcgattctatagtgagcttcatattcctgcctgtcattcgcgttgttgctcgcaccatggtagcagggaaaagcgccccgcatccgaggctttcctcaaatgcggggcgcttctacaaactgcttctacaaacgactatttcgtcttgccggtaatgagcgtcttaagacccaggccgatcagacccaggcccatgcgcacgcgaccggggcgatggcgctcgatggccttggtcttgccggcgggcttatcgcgacgggcactcgtcccgggtgcggacttggtgacctgcggctcgggctgaggtgcaggtgcaggctcgggctcaatgacggtcgcctggacctcttggaccttgggcgtggtcggctgcggatcaggagctggggcgggctttgcctcggcggcgggctccggagtcgcggtagcgggctcgggcgctttctccatggcgggctctgcggcagcctcgggctcattcaccgggggagcggcaaccgcttccggtttggcggctgccccatgttcaacctcggcctgaatagcttcttcggccacacgttccttctcctgtgcgcgctgctgcgcggcggcctcggcgttgcgataggcacgctccagtagagcttcctgcgagttgaagggtttctcaccctctgcacactccacggggacccaggtgccgtcgctcgtgaggctgcgggccttcacgttgtcctgcagctacacgacgctcttccgatcttctaagctctgcatgcccatgtactcgtgtaccagggcgcggcaggtggggtcgagcacggggaaggcgatctccacgcggtgctcggtgttgcgtgtcatcatgtctgccgagctcaggtaaatcatgtccgagtccacgccaaaagcgtaaacacgggcgtgctccaaaaagcgtccgacgatggagcggacatgcacgttctcggtcttgcccggaacaccgggcttgaggcacgagatgccgcggatgatcatgtctacgcgcacgccggcacacgatgcctcggcgatcttgtcgataacctcgcggtcggtcagcgagttgagcttaaagaacacgcgggcgggctcgccggcaagggcgcgctggatctcgcggtcaagcccgcgcatgatgagcggtttcagtccgacgggcgccacacccaggaagcggtaatcgccgcgcaggttgcccagcgacagattgcggaagaacaagttggcgtcctcgccgatgccgggatgggcggtcatgagcataaagtcgctgtagagcttggccgtcttctcgttaaagttgccggtgcccaaaagtgtgaggcgcgttagcgccatgccctcgcgataggtgagctggcagatcttggagtggcacttaaagccctcggagccgtagatgacagtgcagcctgcctcttccagacgctcggcccactcgatgttgttctgctcgtcgaagcgggcgcggagctccatgagcaccgtgacctctttgccgttttcggcggcatcgatgagcgactcgcacagacggctctgcttggccacgcggtagagcgtgatgcgcaacgagatgcactcggggtcgtaggcggcctcgtgcaccagatccaggaaggggttcatggcctcatagggataaaagagcagcttgtcgtgctgaagtacctgctcgcggatggagcgggtcatatcgatggtggggttgggctgcggcttaaacggcgtaaagagcagctcgttgcgcaggtgctcgggaatcttgccctcaatgccgaagacatagcccaggttgagcgggatgtcgcaggtaaagaccgagcgacgcgagagctcgagtgccttgcggatagtcttgagcgttgctttttcgagtgaacccgagacggcgagaaccaccggctgcaggcgcaggcgcttcttgaggatgcgcttcatatgctggcggtagtcctcttcctcctcgacgccctcgccgtccggatcgatgtcggcgttgcgggtgacgcggatgagcgcgcggtcgagcggcttataggagccaaagcagctgtccaggcaggcgaggatgacgtcctcgagcagaatgtaggagtaggtgccggtgggcgaggggatctcgaccacgcggttcatcgaggcgggaatctcgatcaggcccagcagactttcctcgtcggtgacgccgtccaggccgcaggccaggtagagtgcgccgttgcgcaggttggggaaagggtggcgcgggtcgatcaccagcggtgagatgaccggcgacacgtaggcctggaagtagcgggttacaaaggtgcgctcctcgggcgtaagcgaatcgacacgcgcacggtgaacgcccagggtgtcgagcttgccctcgatactcttaaagatggactcccaacgggtaaggagcccgggcatttcggccatgacagcatcgacctgttcggaggcagtcatattgctcttgttgtcgacaggttgttttttgagctcggcaaggtcggacaggccacccacgcgcaccataaggaactcatcgaggtttgactcgaagatcgagacgaacttaaggcgctcgaacagcggcacggactcatcaaaagcctcgtcgagcacacggttgtcaaagcgcagccagctgagctctcggttctgcgtgtacgagaagtcgcgcggcggtttgcgcagctttgcggcggcttgctttttttcgattttgctcggcatatgcatctgtccgttcagtccccgcaggggacggtagcctaaccctattcactattgtctcaatttagtcgacttgtggcacggacgtattgtgcgaacggtatcttaacctacttcttacgccgtcaaggcatgcaactaactgcccgactcgttttgaaaacaatctatatccatactcaactggtgaggatgtatgaataagaatgattgcgagctgaatataatcgaatccaaattgaatcatggacagacgacatatatatgcagaaaacagttttagctatgcaattcctaaacatgaaattatttgtgcaatcttgctcaattccttagaaaaaagaacgattacctttgaaaacctgctttagagaactgaagtgcatcatgggggaatcatatgcgatataccgttcatcgcactttgctgaccgttcgggggcgaggtggaattgctggtggtttttggatataactagagctgtcagcaagcagcgtcccatacggaggggcgctgatacattcggccagtaaggcccgaaagaaaggtaggaggccatgacgaaaggtctgcacgtgccttccgagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcccgaaagaaaggtaggaggccatgacgaaaggtctgcacgtgccttccgagatcggcaagctcaggaaggtctgcctgcaccgtcccggcgacgagctcctcaacctgccgcccgacgagctcgagcgactcctgttcgacgacgtcccgttcctggaggtcgcacagcaggagcacgacaccttcgcccagatcctgagggaccagggcgtggaggtcctctacctcgagaacctcgtcgccgaggtgttcgaccaggtccccggcgcccgcgccgagttcaccgaccagtacatcgccgaggccggcatccgcggccagcacatgccgcagatcgtccgcgagaagctggactccatcgaggacaacctcgagttcgtcaagaagaccatggccggcatgaccaaggccgagatcgacatgcccctcacggcgtccacgaccctcgactccctggtcaactccgagtccgagtccgacctgatcatcgacccgatgcccaacctctacttcacccgcgacccgttcgcggtcgtcggcgagggcgtcaacctcaaccgcatgtactcggtcacccgcaaccgcgagaccctgtacggcaagtacgtcttcaagtaccaccccgactacaaggacgtctccctgtacttccgccgcgactgccagttccacaccgagggcggcgacgtgctgaacatcaacgagaagaccctcgccgtcggcatctcccagcgcacccaggccgccgctatcgacgtcatggcccagaacatcttctggaactccgactccaaggtcgagcgcatcctggccttcgacatcccggtctcgcgcgccttcatgcacctcgacacggtcttcacccagatcgacgtcgataagttcacgatccaccccgccatcatgggcaccctgcgcgtctacgagctgaccgctggcaagaacccgggcgacgtgaacatccgcctgatcgaggacaccctcgagcacgtcctggaggacgccaccggcgtcgaccaggtcaagctgatcccctgcggcggcggcgacccgatcgcggcctcccgcgagcagtggaacgacggctccaacaccctgtgcgtcgagcccggcaagatctgcgtctacgcccgcaacaccgtcaccaacgacgtgctgtacaaggagggcctggaccttctcgtcgtgccctccgccgagctctcccgcggccgcggcggcccgcgctgcatgagcatgcccttctggcgcgaggacctctaaggtcttcaaggacccgtacaggtcataatacatacatctagctgccattagatgtctcccattggggcggtgcgggttttcgcaccgccccaatcttgtatgaggaacgtcaacacggttggatgactgcttttgtaaggagctttgccatggacatcaagacaatcggcgttgaggaatggcttaacgtttgggagaagagcgctacgtgggatatcgcccagtcgacaatctcctcgcttaccatgggcgagctgcgcgcgctcgacgaccaagatggtgccacgttctacgagcgcctggaccgcgagaaaatgaactacggctggattgagggttcgccggagtttaaggccgaggttgccaagctgtatcgtcgcgaggtcaatcccgatcatattctgcagaccaatggctgcacgggtgccaacctcaacgccatcatggccgtggtcgagcccggcgaccatgtgattgccgagtggcccacctatgcgccgctctatgagatcccgcgtacactcggcgccgaggttgagtattgggagctttgcgaggagctcggatggaaacccgatatcgaacagctcaagcgcctcgttcgccccaacaccaagctcatttgcatcaataacgcatcgaaccctatcggtacggtgctcgatgccgatacgctcggccagatcgccgagattgcccgctcggttggcgcctatgtgctgtgcgacgaggtgtacctgccgcttgagaacaccgaggactttttgtcgatggccgatgtgtacgagaaggccatcgtcaccaactcggtgtccaagacctattcgacgcctgcgacccgcgtgggctgggttgtggcagacgaagaggtatctaaccgcattcgcacgtaccgcgactacaccatgatttgcggcggcgtgttcaacgacgccctggcgacctatgtgctcaagcacaaggacaagatcctcgagcgcaaccgcaagatcgtgtttggaaaccgcgatatcgcgcaggcttggattgatacgcagcatcgcgtttcctggacggccccgcagggcgtgtccacctcgtttatccagcttgacattcccgaggatgatgaggagttctgcaagcgcctgctgtccgagaggggagtgctgttggttcccggcagccgctttgagcttccctgcggcgcacgcctgggctactgcgcgagcgaggacgttctgcgcgagggtctgaggcttctgggcgaggcactggcggtgttcgatcgctaggattccgacggctctcaaagccgctcaaatctgtctacgattatcgataactgacccgtttcccaagaggggagcgggtctgtttttctataccgagaagtcaagttgttacaaatgaggccgtaaggcgaaccggtatccgatgggccttatactgagcttccggtgaacggtatcaagcgtctggtaaacggtaatttgttaccagaaatgaataggacaaacttttttctgaataaaaatgaaaatggttgagacgcggtatgaatcgctaattctattcatagctttattggaaatatgcaatttgagggtggtttaataaagttaagttccatttgttatttagattgaaaacgcgtttaagcacgtaaataaactttattaaatcaaagtgtgccatgcgtgaagtatatgtgtatgccgttcacccatcatataaaaccgttcgggggcgaggtggaagtatgaactgattttggatataaatatgtcgtcagcaataacgcctcacacggaggggcgctaacgaatcggccctgacaggggcccgaaagaaaggtaggaggccatgacgaaaggtctgcacgtgccttccgagatcggcaagctcaggaaggtctgcctgcaccgtcccggcgacgagctcctcaacctgccgcccgacgagctcgagcgactcctgttcgacgacgtcccgttcctggaggtcgcacagcaggagcacgacaccttcgcccagatcctgagggaccagggcgtggaggtcctctacctcgagaacctcgtcgccgaggtgttcgaccaggtccccggcgcccgcgccgagttcaccgaccagtacatcgccgaggccggcatccgcggccagcacatgccgcagatcgtccgcgagaagctggactccatcgaggacaacctcgagttcgtcaagaagaccatggccggcatgaccaaggccgagatcgacatgcccctcacggcgtccacgaccctcgactccctggtcaactccgagtccgagtccgacctgatcatcgacccgatgcccaacctctacttcacccgcgacccgttcgcggtcgtcggcgagggcgtcaacctcaaccgcatgtactcggtcacccgcaaccgcgagaccctgtacggcaagtacgtcttcaagtaccaccccgactacaaggacgtctccctgtacttccgccgcgactgccagttccacaccgagggcggcgacgtgctgaacatcaacgagaagaccctcgccgtcggcatctcccagcgcacccaggccgccgctatcgacgtcatggcccagaacatcttctggaactccgactccaaggtcgagcgcatcctggccttcgacatcccggtctcgcgcgccttcatgcacctcgacacggtcttcacccagatcgacgtcgataagttcacgatccaccccgccatcatgggcaccctgcgcgtctacgagctgaccgctggcaagaacccgggcgacgtgaacatccgcctgatcgaggacaccctcgagcacgtcctggaggacgccaccggcgtcgaccaggtcaagctgataccctgcggcggcgccgacccgatcgcggcctcccgcgagcagtggaacgacggctccaacaccctgtgcgtcgagcccggcaagatctgcgtctacgcccgcaacaccgtcaccaacgacgtgctgtacaaggagggcctggaccttctcgtcgtgccctccgccgagctctcccgcggccgcggcggcccgcgctgcatgagcatgcccttctggcgcgaggacctctaagtctttccgtttccggtgcggtccccctacaaccgcaccggtttcgcccgtcaaacgggcaacactaatacttacgtaattcattttttcgaaaggaaacgaaccatgggtgttaacctctccggccgtagcttcctcaagctcctcgacctctccaccgaggagatcgagtacttgctcaagctttccaagaacttcaaggacatgaagcgcgctggcgttccgcaccgctatctcgagggcaagaacatcgttctgctcttccagaagacctccactcgtacccgctgcgccttcgaggtcggcggcatggatctgggcatgggcgtcacctacctcgatcccggttcgtcgcagatgggcaagaaggagtccatcgaggacaccgcccgcgttctcggccgcatgtatgacggcatcgaattccgtggctttgcccaggacgacgtcgaggagctcgctgccaagtccggcgtgcccgtgtggaacggcctgaccaccgagtggcaccccacccagatgctcgccgacatcctgaccgttcaggagaacttcaactacgacatcaagggcaagactctcgtcttcatgggcgactgcaaaaacaacgttgctcgctccctcatggtcgtctgctccaagctcggcatgaacttcgtggcttgcggccccgaggagtgcatgcccgctgacgacgtcatcgaggcctgcaagcccatcgccgaggctaacggctgcaccatcaagctgaccactgacgtcaaggacggcgtcaccggtgccgacgttatctacaccgatgtgtgggtctccatgggcgagcccgacgaggtctgggccgagcgcatcgctcagctcaccccgtatcgcgttacctccgaggtcatggctatggccaacccgggtgccatcttcctgcactgcctgcccagcttccacgacaccaacaccacgattggcgccgagaagtgcgagcagttcggcatcaccgagcaggaggtcaccgacgaggtcttcgagagccccgcttccaaggtcttcgacgaggccgagaaccgcatgcacaccatcaaggctgtcatgtacgccacgctcaagtaagagcatctagcatctcgctcggggtgtattgctggacaccccgagcggttttatctggtaataatctcgcatcaagcggcaggcacggcacggaagagccgcttcgggcgagatcagtaaatgatttatgaaggggggatgagaactatgactgagaccgctaagaaaaagcgcggtatgccttcatcgttcaccattcttcttgctctgctggcaattgttgcagtgattaccgttatcgtctccggcacgtccggtggcgcggttactgccgcccgtctgagcgatttctgcaccgccccgatcctgggcttcgctgacgctctgcccgtctgcctcttcgttatgatcctgggcggcttcctcggcatgatgaccgagaccggcgccctggacaacggcatcgccgttctggtgcagaagcttaagggcaacgagattatgctcattcccgtgctgatgctcatcttctccctcggtggtaccacctatggcatgtgcgaggagaccgttcccttctacgccctgctcgccgctaccatgatggccgctggcttcgaccccatggtcggtgccgctaccgtcctgctcggcgctggctgcggctgcctgggctccacggttaacccgttcgccgtcggcgctgccgtcgacgctctgaccggcgttggcattgaggtcaaccagtccatcatcatcggccttggtgccgtcctgtggattgtcactaccgctatgtccatcttcttcgtgatgaactatgccaagaaggtcaaggctgacaagggttccaccatcctgtcgatgcaggagcttaaggacgccgaagaggctcacggcaaggctgcttccgaggtccacaaggaggtcaagctcaccggtcgtcagaagggtgttctgatcgccttcgccttcaccttcgtcgtcatgatcgtcggcttcattccgctggccgacctcaacgagggcgtcgccaacttcttcgacgccggcgctgtctacgacgccgacggtaacgccgtcgtccagggctggtctgccctgatcaccggcctgcccattggccagtggtacttcgacgaggcttccacctggttcttcctcatggccgtcctgatcggtatcatcggtggcctgtccgagaagcagatcgtcaacaccttcatcaccggcgctgccgacatgatgtccgttgttctcgtcatcgccctcgcccgtggtatctccgtcctcatggctaacaccggcctcgatgtcttcgtcctcgacgctgccgccaatgccctggctggcctgtccggcgtgatcttcgctcccatgagcttcctggtctacttcggcctgtccttcctgatcccttcgacctctggtatggccaccgtctccatgcccatcatgggaccgctggctgttaagctcggcttctcgcccgaggtcatggtcatgatcttctccgccgccatcggtgtcgtgaacctgttcactccgacctccggcgccatcatgggcggtctcgccctggccaagatcgagtggacgacctggctcaagtttgcccttaagctcatcgtcgctctctccgtcgtctgtgccgtcatcctgaccgtcgcctgcgtgctgctctaagtacccaacgggtaccccacggaaaccttgacgatcctgtagaggatcacctggtcatcgtctgtccggtggggtaaacccaccggtagactcctacctttagccccctcccgttccgtgcgcgggagggggcgcacttatgttgcgcggttctacgaaccgcgcaaccagtcaacgctgcgcgccgcccaggacgacaatttgtcattcaaaaggcaaggcatgaccaaaaggtctatgccttgcctttttcatgccaacttgtacgtcctgggcggcgctcgctgacttatgctcaacctgcgacttttcccttgttggtgcaaaggtgtcagattgctttgcgccatgtcctcctctttcacgtcaccttgctcgttctggcgggctttcgctgacttttgttccacctgcggcgctgccattgttggtgcagggggacagcttgcccgcactggtgcccattcgctgacttatgctcaacctgcgacattccctttgttggtgcaggggaagtgcgtgggggagggtctgctccgctataatcgcctaggacattaaatggaaacgggacgggagccatacatgcgccagggtttcgacaacgcgaaatatatcgagctgcaggccgctcatattaaggagcgcatctcgcagtttggcggcaagctctatttggagtttggcggtaagctgttcgatgactatcatgcgagccgcgtgctgccgggttttgagccggacagcaagttccgcatgctcaagagcattgccgacgatgtcgaggttattatcgcgatcaacgcgaaccacatcgagaaaaacaaggctcgtggtgaccttggcattacctatgacgaggatgtgctgcgcctggttgacctgttccgcggcaacggctttgccgtcgcggctgtggtcatcacccagtatgctggccagcctgctgccgatgtgttccgcaaccgcctgaacgcgctcggcattcccgccaagttgcactatcccatcgaggggtatccgcacgatgtcgatctgatcgtgtccgacgatggctacggcaagaatgagtttgtcgagaccacccgaccgctcgtcgtggtcactgcccccggtcctggctcgggcaagcttgccacctgcctgtctcagctctatcacgagcacaagcatggcacggccgccggctatgccaagttcgagaccttcccggtctggaaccttcccctcacgcatccggtcaacatcgcctacgaggcggccacggcggacctcgacgatgccaatatcatcgactccttccaccttgaggcctataacaagaccacggtcaactacaaccgcgacgtcgaggccttcccggtggtccgtgctctgatggaaaagatcctgggcaagagcccctaccagagtcctacggacatgggcgtcaatatggtcggctttgccatcaccgatgacgatgcctgccgcgacgcttccaagatggagatcgtccgccgctactttaccgcggtcgaaaatgtgcgccgtaccggcgtgggcgatgagcaagtcgaccgtctcaagatcattatgaagaaagccggcatcgataagaactactcaccggcgcgctcggcggccctcaccagggagcaactgacgggtggtcccgtgggtgccatggttatgcccgatggctccgtggtgaccggcaagacttccacgcgcctgggcgctgcgagctcgctcatcatgaatgcacttaagcatgtctcgggcgtcgaccttgagctcgaggtcattagcgatgaagcgatcgagcccatcagcaagctcaagacgcatttcctgggcagcaaaaacccgcgtctccacaccgacgagacgcttatggcgctgtcgatcacctcggccacgagtgagacggccgctcgcgtcctttcgggcctggagcagctgcgcggttgcgatgccttctttagcgtgattatctcgccgacggacgagacggtactgcgcaaactgggtatcaacgtgtgctgcgagcccaagtttgagcgccgcggtttcttccatcgctaagtttgaagcaccgcggtaattgcattgcattttggccgtatcgagttagcgcccggtacggctttttgatcaataaagcgcctatttcggcgaaaaatagctgtttacctgcctagaaacaatttgagcggtatacaataaccgtaactgtttcatccttagcgggatgccgcatgatggatattacctgccatcgtgaggtgtgtcggtcgcgcacggcgcgttagatgctcgtgctcggtttgaggaggctgctatggcgggcaagggtcgtgcgagtgtcaacgatatgaagcgtgttgaggtgctggtgttgatggaaatcgaccagcaaaccgaagacaatggcgggccgtatggtttctcgcgcaaaacgcttgccgagcgcgtgggggtttcgccgtatcgtgcccgcgccgcaatcgatcgcttggattccgaaggcatgattgatgtcgtctcgcgttatagcgacgacggcggtcagcttgcaaatggcatttgcctcaccgaacgtggcgagtggtatcttgacggcgtccgtaccggcatgctcgttcaagaaatgcttgaggacgaggttgctgatcgatagcagcatgtaacccttgccatagcgacgccgcctgggaaaccgggcggcgttttgtttcaagattgagaaatgcaatcgcacgcgagaaaaattgcgaacggtccgcggcgcgagtattacaatgaagacccgtaagatgtggataaacaacttctacgggaagcgcaggtaactcaatatgaccaagcatgtgttcgtaaccggtggcgtggtttcgtccctgggcaagggtatcaccgcggcctcgctgggccgtctgctcaagtcgcgtggctacaaagtaacgatgcagaaggccgacccgtatctgaacgtcgaccccggtaccatgagcccgttccagcatggtgaggtcttcgttaccgaggatggttacgagtccgacctggacctgggtcattacgagcgctttattgatgagaacctgacccgcgattccaactttacgaccggtgccatctacaaaagcctaatcgcccgcgagcgtcgcggcgactttttgggcggtaccgtgcaggtgattccccacgtcaccaatgccatcaaggacaagttccgccgcatcgaggagcagaccggctccgatgtagtcatcaccgagctgggcggcacgattggcgacatcgagtcccagccgtttgtcgaggccatccgtcagtaccgcaaggaggccggccccgagaacgtctgctacatccacgtgtcgctcgttccctatatcgccgccgcccacgaggtcaagaccaagcccacacagcattccgtcaaggagctccgcagctttggcatccagcccgatattatcgtgctgcgctccgaccaccatatcgatgacgctatccgcggaaagatcgcaagcttctgcgacgtcgacaccgattgcgtctttaccaacgaggactgcgcgagcatttacgatgttccgcagctgcttgccgagcaggactttgacctgcgcatttgcgagcgcctgggtctggacccgcgtgagcgcgacatgagcgagtggaacgagttcctgcgcaaacagaatcacgccaaccatcacgccgacaaggtgaagatcgccgtcgtgggcaagtacacgcagctgcccgatgcgtacctgtcggttatcgaggccctgcaccatgcgggcgtcttctacgatcgccatgtggacgtccagctggtcgacggcgagagcctcgacgagcagaatgtctccgaggttctgggcgacgcctcgggcatcctggtccccggcggctttggcaagcgcgccctggagggcaagatcctcgcggccgagtttgcccgtgagcacaagattccgtatctgggcatttgcctgggtatgcaggtggccgtgtgcgaatttgcgcgcaatgtcgtcggccttgccggcgccagctcctccgagttcgatccggacggcccgtttagcgtcatcgatctgatgagctcgcaggaggacgtgaccgagaagggcggcaccatgcgcctgggcgcctatccgtgcaagctcgccgccgatacccttgctcgcgaggcatatggcgaggagctcgtctacgagcgtcaccgtcaccgctttgagttcaacaacgccttccgtgaccagctcgaggacgccggtttggttatctcgggtctgtcgcccgacgagcgcctggtcgagatggtcgagctgccgcgcgacgtgcatccgtggtatgtggcaacccaggctcatcccgagttcaagagccgcccgaccaacccgcagccgctgttccgcgagttcgtgcgcgcttcgatcggccagcacgagggtgtcgaccgtctgcaggtgacgcccatgaacctcgctacggactaagggtgccggcgaataaggaacataccgaagctactccctcgtcgctcgccgtggcggcgggggagtatctcgattacctcgcggtcgagcggggtttggcgcgcaacacgattgcggcctatcgtcgtgacctgacgacgtactgcgcctatctggagcgggcgggtattgtgtcttttgaagaggtgacccgtcaggtcgtggagggctttgtcgccgaccgtcgcgatgggggctatttcgatgcctcggtggagcgtgcgcttgcggccgtgaagggcctacatgcctttttggtgcgcgatggggctgtggcccaaaatccaacggcggcgttgcgcctgcctaaaaaggctgagcgtttgccggagtatctatcggtggaggatgtctcggcgctgctcgatcaagacttccccgagggcgagatgggcttgcgcgaccatgccatcttggaagtgctctatggatgcggtttgcgtgtgagcgagttggtgggactcgatgtgggcgatatccatatcgacgatggctttgtgctcgttcgcggtaagggctcgaaggaacgtctgtccccgctggtgggaagcgcggcgcgagctctggcgctttatgtaactgaggggcgttctcgcttggcggcccatgcccgcggaaccgagacctcggcggtctttttaaataagaacggccgccgtctgtcgcgccagggcatccatgccatctgtgagcgctacgggcgccaggtgggactggtggggctccatccccatacgctgcgtcactcctttgccacccatatgcttgcgggcggcgcagacctccgtgtgctacaggagatcttgggacatgccgatatatcgaccacgcaggtctacacgcatgtcgatcgtacgcaactgaccgaggtctatctggcggcgcacccgctggcacatcgttaacacatcgctgacctgcatatttataggtatttggggacgggctccagattgccgtggcgtgcttttgcgcgcgcatgggcaatctggtgcccgtcccatttttcgccacttggcgtcgcggtggtgggccgcacgtgccttgggtgggggagtttgggggcgatgtgaatggcatgtaaagggacgcaaaaatcgcttcaaggtcaacttgaaggttgaggttgaacggcggggtgccacaggtggcatcccgccgttgctgtaaacacaacatattgtgttttcgaacatatgcttgggggtgttttgcaatatatggtgggtggagcggtggggcgaggtgggggaaggagtggggaaaggtgttgaaaaatggggcggttccccatattattaatgacgtcgacaggcggggtggttctccgcgtacgtgccatctgagtaaccgaggggagggcgcacatgggaatgactggtgcatacgagcgcaatctcgatgcaaaaggtcgtctgtccctgcctgcaccccttcgcgaggagcttggagagcaggttcgcgtgttcaaagccctggatgtcgatgctctgtacgtgttctctgccgaggccttcgataagtgggtcgaaggactcttcgcgggtcgtgagggccacgagggttttaacccgcgtgacattaatgaccagaagctcatgagggcgatcaacaagcgcaccacgtcgatggacgtggacagcgccggtcgtatcggtctttccgagtctctccgcaagcaggcgaaactcgaccgcgaggtcacggttgtgggcaactacgaccaccttgaggtttgggatcgcgccgcggccgatgaggacgatgacgatgaggccctgctggacctcttcttctcgtaagggcaaggcacgggtaacggatggagcgtgggatcttgacacaagaatatcggcatgaacctgtcatgctcggcgaagtgcttgagtcgctgcggctaaagagcggctccgttgtctgcgattgcacccttggcggtgccggccattcggtaaagatggccgcgcaggtgggggagatgggccttttgctcggcgtcgatcaggacgacatggccctcgaggccgctggcgcccgtctggaccgcgaggttcccggcgttccgcaccagctcctgaagggcaacttcggcgacttggacgagctgctttgctcggccgaggtgcccggggtcgatggcttcctgttcgatttgggcgtttcgtcgccgcaactcgatatccctggcaggggcttttcgtataacgaggacgccccattggacatgcggatggatccgggtaataacaccttaaatgcagctgaggtcatcaacacctataacgaacacgacctcgcccggattctacgcgtctacggcgaagagaagttcgcctcgcagattgcgcgcgagatcgtgcgctgccgcgagcaagaaccgatcgaaaccaccggccaatttgtcgagatcatcaaggcgggtatcccggctgccgctcgtcggcatggcggacacccggccaagaaaagtttccaggccattcgcatcgaggtcaatcacgagctcgatgtgctcgaacgagggcttgatgccgccaccaggtggctcaacccgggcggacgtatctgcgtcatctcgtatcactcgctcgaggaccgtatcgtaaagaaccactttaaggagatgagccaggggtgcacgtgtccgccggagattccggtgtgcgtgtgcggcaacgtgccgatactcaaggtcatcacccgcaaacccctggttgcccagcctgatgaggttgagcgcaaccctcgggcgagatcagccaaaatccgcgtggcgcagcgtctgtaggcgcgaccgcgcgatattggacctcccgctcgcaccataaacgaagcttaaacacactaccaacgtactcgggatgggaggcggcatatcatgggctacaacacttcaagcgcagcactcgcctatgatatgaacgccatgcccgcctatcgtgagacgccgcaggcccccgttgctccccgtgagcagcgcacgccgcgctttgatgtctacacgggcgcgggccgtcaggcaaaccaggcggtaagcccggttttcatgagcgttcttaaaacgttttgcatcattgcggctatcttcatgacgatcggcgtcgcccgcgtggcgctcgccggcgttacggcccaggtgctcaacagcaacgccgagcttaccagcacgctcgaaaaggcgaccgatgagagctccgacctggaggtcatgcattcggtctatggtgccgacacgcgcattcgcgaccttgcgggcgcttatggcatggtggagcccagcgagagcgttacacttgacttttcgcaggatgcagccgcgggcgccaacgcgaccgcgaccgctcagtagcaagacggtagctgagtatgacaaatgactatcgccgcggttccgatgggggccgcggttctggacgtccctcgtcgcggggacgttctggttatcaaggaacgggtcggcaatcttacaacgccgggcggtcccgtggcaacgacccggcgtcgcgacttcgcggctcgggcggccctcaagtgcataacaccaggtcgcgcaagagttcgtcgaccgaatggctcacaggcgcgcctctgcctcgccgcaaagccgtcatgggcttcatcgggcttggcttgggcttgggcgtctttcgccttgccgactatcaaattgtcgaagccgataaactgcgcgagcgtgccgatgcgcgccgcctgcttgcgcagaccctctatgccaaacgcggcaccatctacgaccgcaacggcaacgtgttggcgtcgtcggtcgaatgtcgcaacatcgccgtgaacccgcagcttgtcgaggatgttgacaagacggtgtcggcgctggtcaaggcaactggaatcgataaaaagacctgccgcaagctcgtcgagtccgatggaacctgggtgtatatcaagcgccaggtggacgaagacgatgttgcggcgctggagaagaagaacctgcccggcgtgctttttgagcaggccatgaagcgtgtatatccatacggcaatctggcatcgcaggtgctgggtgtagtgaatgtagacaacgacggcttgacgggtctcgaaaagcaatacaacaagcttctgaccggcacgaacggttctctcgtacgcgagcgcgcgagggacggcagctatatcgcgggcggtgcctataaaaaggtggctgcggtcgacggcgttgatatcgtgacgacgctcgacgtcaatatccagcgtgcggccgaggatgccctggcagaggctgtcgagaagacaaaggccaagaacggctcggcgctggtcaccgatcctacgacaggcgagatcttggcagcctgctcgtacccgacttacgaccagaccgatctggagaacgccaagaccgaggatatgaacctgcgcctggtcactgacgcctacgagcccggctcggtctttaagacgctcgtggcgggcgccggcttcgacttgggtgtcgtgcgatcgagtacgtcgtttgaggtgccggcgagcatcaaggtgggcgacgataccgtcaccgatgccgacaagcgcgactatgccatgaccatggatgtgcgcgagatgatgcgccgttcgtccaatgtgggctttgtcctagtggggcgcaagatcggtgccgacgactttgccgcctatgtggacaagtggggcatcggtcacagctcgggtgtcgattttccgggcgagagcctgggtatcgtcaaggagcgtgaccagtatgacggcgccacgctgggctcgatgagctttggacaggcactgtccgtctcgccaattgagatcgcacgtgccgtgggcggcatcgccaacggcggcgtgatgatgacaccgcacttctataagtccagcaagggcgacgagaaggactggggcgaaggcgagcgcgcgatttcggaggacgccgcatcccaggtgacatcgtgcatgcagacggtcgtgtccgagggtacgggcgttggcggcgcggttgacggctatgacgtggcgggtaagaccggtacggccgaacgtgccgacgagaacggcggctacctcaaggagaactacatgtcgtcctttatgggctttgcaccggcacaatcgcccaaagtgctgtgctatatcacgctcgacggaacgccgagcggttcagatgccgctgcggtgccgttccagtccattatggccaacgcgctcgacgtgctgggtatcccgcacacgaagtagggggttacaatctttggggcgttgtttgttgtcccatatgagggtgttcacatgccctgcaccacgcatgtgcggcgctgggatacaatacgccgatagcattattaggtttacaggggagctgcaatgatagagatcgccgtcaacaacctcgcggccgcaacaggggcccgaaccgtgacgggagaagccgatcgggtatgccgcgggtgcgttatcgactcgcgccaggtcgaggaagggacgattttcgtcgcctttcccggtgaaaacgtcgacggcaatgattttgcttcccgtgccgtccagtcgggtgccggcgccgtcgtgatgacgcgtgagcccgaggccgagctggtctcgctggcgcaggacaaggggtgcgccatcctgctgaccgatgatcccgaggagtttctgctgcgtttggcgcacacgtatcgcctggagcttggctgcctggtcgttggtattaccggttccatcggcaagacgacgaccaaggacgtgctcgccgccgtgctcgccaagcgctatcgtgtctgggccaccaagggcaatttcaataacctgatcggcatgccgctcacggtgctttccgctccggccgataccgaggtcctggtgctcgagatgggcatgaaccatttccacgagattgagcgcctgtcccagtccgccaatcccaaccttgccatcgtgagcaagattggtacctctcacatcggcattttgggcagccgcgagaacatcgcccgcgctaaggccgagattgtccagggtatgtgcgccgccggcgacttcttgccgctgctggttttgggcggtgaggacgactttacgccgttcattcgcgatacgttcgcccagcctgctggtatcgatgtgatgctggccggcgtctcggacgatgatgaggtccgtgcccgcgacattcgtgttgatgacgagggccgtccggtctttacgctcgattttggccagggtgagacgaccgataccatgcttgccatccccggcgtgcagtccgttcctaatgccgttaaggccgccgcggtttcctatcgcctgggcgtgatgcccgagcagatcgatgctgcctttaggggtcttacgatcaccggccaccgccaggagatcaagcgcgccaagagcggagcccgcgtcatcgacgattcctataacgccagtgccgaatccatggctgctggcctcgatctactgtgctcgctttcgtgcacggggtctcgcatggcgatcctgggcgagatgggcgagatgggcgatgaggctcctcgcatgcatgagctcgtgggcgcctatgccgccgccaagaagctcgacatgctggcgtgcgtgggtggtgagctggcccagcttatggccgatgccgcgcgcatgatgggcatggacgaggaccgcatccaggtgttctccgattatcagcaggtgctcgaccgcatgggcggcgcgcttgaaaaacatgatgttgtactggtcaagggttcccgctttgttgagctcgaccgctttgtggaaggtgtgtgctagcccatgttcggcaatccctcgtatccaacgtatcaggcttttttggggcttggcatcgccgctgccattgcgctgctgctcatgccgtggtggatcaagctgctcaaggtcgagggtatcggccagcaggttcgtgccgacggccccaagcgtcatttggttaagcagggaacgcccaccatgggtggcgttgtcattctcgtcgcgatttcgctgacctgcctgctgatgggcaagctcaccaccgagctcgtgctcgtgctgctcgccacgctggcgaccggcgtgctgggcctgatcgacgacctgacctccgttacgcatgggcgctcgctcggtctgacgcctcatgccaagatgatcggcctaaccattatctgtgtcacctttacggtacttgccgtcaactggtgcggcgtcgcccccgagattcgttttcccggcggcctgacgattgaccttggcgtgctttcgaccaccatctgcggcctttcgttcccgtggctctacattgtcttttgctggctgatgatcgccggtctttctaatgccgtgaacctgaccgatggccttgacggtcttgccggcggcacctccatgattgccatgctcgccatggctgccatggcgtttttgcacggagacgtgaacctgtccatcttctgcaccgcgtgtgccggtgcctgcttgggctttctgtggttcaactgctatccggcgagcatctttatgggcgataccggctcgcttgccctgggcgccgcgtttgcctgcacgtccatcatgaccaacaccgaggtcgtctccctcatcatcggcggcctgtttatcgttgagaccctgtcggtcatgattcaggttgtctacttccactttacgcacaagcgcgtcttccttatggcgcccatccatcatcatttcgaaaagaagggctgggccgagaccaaggtcgtcatccgtttttggattatcgctgcggcctttggtgccgttggccttgccctgttcttccagttgggatagtggtctttcatgcctcttgctgatgtctttagcctgctcgttttgggtcagggcaaatccggtctcgatgtcgcccgctgggcgctggcacatcccgagcgcgtaagcgccgttaccgtgtatggcggcggcacctctgagcccaatgacgccacgcgtgcgctcgaggctgctggtgtgtcgtttgtctatgggaccgaacaggtcgagggcgcctatgacgtatgcgtgacgtgcccgggcatctcggagttctcgggcttctttaaggccgggcgcgagcatgccgcccagattatgggtgagcccgagtttgcctatcgtctgtcgcccgataactggattgccatcacgggcaccaacggcaagacgaccaccacgtcgctgactgattatctgctcaaggctgccggcgaggacagcgttgctgtcggcaacatcggcgagccgccggtcaacgagattgacggccgagcccataacgagtggtttgtggctgagctctcgagctatcagattgctacgacaaccgagctccacccccgcgtggcggtgctgctcaacatcactcccgaccacttgggctggcataagagccataagaactatgcgcttgccaagatcaaactgtttgacaatatggtcgatgacgatctggcggttgtcgacgtcgaagacgccggcattcacgagttcgatgagtacatctacacgccgggtcgtcgcatctgcaaggttgcctttgacgagcctgagggcgaggatgccgcctttgtgcgcgatggcaagatgatcgtgcgcctgaagggcgtcgagaccccgctcatcgctacatccgagctcaagatctcgggccatcacaatgttatcaatgccctgtgcgccgccacggctgccttggcggtcggtgccgatgtcgatggtgtctgccgcggtcttgcctcgttccagccgctcgagcaccgcgtggagccgtgtggcgagattgacggcgtgcgctacgtcaacgattccaaggcgaccaacaccgatgcggtcgagaaggcgctgacggcatttcccgatgacgacgtgatcttgctgctcggcggccacgataagggcacgccgctcacggacttctcgcgcgtcgttatggacaacgtgcgctcggtcgtctgctttggcgatgcgcgcgagcgcttcaccgccgctatggacgaggccgatgtcgatggcgatgtggatatcgcccaggcggatgacctacgcgacgccgtggacgtcgcccgttcgctgtcgagccgtggtgacgtgatcttactttctcctgcctgctcttcgttcgatgagttctcgggctatgaggatcgcggccgcgtgtttaaggactacgtggcccagcttgccgctgcagcgaaatcacaaatggaataggggttgcggtgagagaggagagcccccgacaaggtatgaggaggcccgactcggaccgtgcttcctcacgtcgcatcacaccgcgttccagccgcggcgggcagtcgtttagcgaacgctatattgccggcgttcccgcccgtatcatgcgcccccgtttgatattcatggcctgcttgtttaccttggtatgctttggcctgctgatggtgtactcggcgtcttcggtcgaggcgctgcacgagaatggctcggcgacgttttttctgggtcgacaggccgcgtttgccgtggtcggtgttctggcgctgattgccatcgtgcgcgttttgccggacagctggtttggggaggatatgctcaggatcttccttatcggcatgatagggctactgcttctggtgttcttggtgggcagcggcagccgtggcgccacgcgctggctcaacatcgccggtattcagttccagccttccgagtttttaaagccatttgccattgcgtattcggccatcatgcttgatcgctttttttcgcccggtggcaacatcaacgaattccttcgcaagatgggcatctacctaggaatttcgctctttctgatctttatccagcccgatttcggtactgttctgatcatcctgttgaccctcatgtgcatggcgttgtttgcgggtctcgaccccagatttatcatcggcgtgctaatcttcggcattctcgtgatcgtgattgcgcttgtcgcagagccgtaccgtatggtgcgtattcaggttgccttgaacccttgggccgacgagtatggtgacggctatcaggccacgcttgccatcatggcctttgcctcgggcggtctgttcggccgtggcatcggcaactcaaccatgaagtactcgtatctgcccgaggcacacaacgactacatcttggccatcattggcgaggaagtcggttttgtcggaaccgtgctgttcttcttggtgtttgcgatgctgatctactcggcgtttcgcattgccgagcaggcgaccgatcgtcggggcgcgctcatggcgtctggctccgcggtcattctcgcggtgcagtttttgattaacgcgctgggcatcctcaacgtgtttcccatgacgggcaaaccgttgccgtttattagctacggcggttcgtcgattattgtgtcgcttatgcttgccgggttgatcctgcgcgtttcgtacgagagcgcccgtcgcgatgagtacgaccgtcgccgcgagagctttgccgttatggatgagagtaccgccggcgtgccccacgtgcgcggcgagcgatcttcgcgtaacggttttaccgtcctggatggttctgcatccgagccggcagctcgtccacgcccgcgaatggctccgcaaggtcgtccgcagcgccccagccctcgcaacgcgggcggcggatataatcgaatcgatttgaactcggacccgtcggcgcgtctgcgtaccgacgaccagggaccgcgtgtacgaagggactaccatgaccgataaaatgaccgttgctattgcagccggcggcacggcaggacacatcaaccccgcgctcgccttggccgaagaactgcgtgaccgtggccaccacgttgtgttcgtgggccagtcgcgcaagctcgagggtcgtctggtccccgaggctgggtttgattttgtgcccattacggtcacgggcttcgaccgctcccgtccttggacggcgctgacctcgctgtggcgtgtcaacaaagccaagcgtgcgctcgccagtcatttctcaaaggtcggcaagcccgatgccgccattggttttggtgcctatgtcgaggttccgctgctggggtggtgcaagggcgcgggcgttccgtatctgctgcatgagcagaactctgttccgggcctggccaacaagatgatgaactcccacgccgcccgcgtgtgcatctcggtgccggcagcgcgttcggtctttgagcgcgaaggtgaccctggccacgtgctcatgaccggcaaccccgtacgtcgctcggtgatcgagggcgatcgcgctcgcggccgcaaggcacttggcgttcccgaggacgctacgctgctgctcgtctttggcggttcacttggcgcccagcacctcaatgagcgcgtggtttcgctcaaaaacgagctgctttcgcgcaagaacctctatgtgttgcattcgacgggtgccgacggctttgaggagaccgagcgcgctttggcgctgacgcccgaggaggcgaagtgttaccgcgtccagccttacatcgacaacatgggcgatatgctggctgctgccgatttggtgctctcgcgttcgggtgcatcgagcgtggccgagattgctgcgctcgccgtgccctcggtgctcgtgccgtatccgcatgcgacggccgaccaccaaaccaccaatgcccgttatctagtcgacgccggggccggtgtgctctgtgccgatgccgatatcgacagttctgcctttgccgatgagctgctgcacctggtcgatgacgcggcggcgcgcgacgccatgcgtcaggcggcgcgtggtctggctcaagatagggccgccgctcttctggcggatgcggtagagggtttgcgttagttagacgggatatcgtcggtcgccctcgcgctgatgcggtaggtgcggtacagttaacgggttacaggcagtgtttacgcaaggagtacacgagcacatggctgattcccagactgcaacctccgcgcccgagtttaagagcgcccactttatcggtatcggcggcgccggcatgagcggcatcgccctcgttctgcacgagcgcggttatgccgttaccggctccgaccttaagacgtcacgttatatccgccagcttacccgcgctggtgtgaaggtgcatgtgggccatgaggccgccacgatcgacgaggtcaagcccgacgtggttgttgtctccaccgctattccggagtctaaccctgaactcgtgcgcgctcgcgagcttggtattcccgtgtggccccgtgccaagatgctctctgctttgggccacggctacaccaccgtcgctgttgccggcacgcatggcaagaccaccacgtcttcgatgtgcgccaccatgctcgaccgcatgggtctggatccgagcttcctgatcggtggcatcgtcgagggctatgacacgaacggcaagaacggctcgggcgactactttgtcgccgaggccgacgagtccgacagctccttcctgttcctgaaccccaacgtagtcattgtgaccaacgtcgaggccgaccacctcgatcactactcgggtatcgaggagatcgaggcaactttcgccaaattcatgagcctggtgggcgaggacggcaccgtcatcgtctgcggtgaggacccgcatctggtcgagctcgccaagtcgacgggtcgtcacgtgctttcctacggctttgccgagagcaacgacatcgtctgcatgcacccggatgtcaagggcatccagagtgactttatcgttcgctttgaggatggcactgagcatgccgtggagatcaagagcaatcccggtcgccacaacatgctcaacgccacggcggtactcaccgtcgcccatgtcctgggccttgacatcgacgccgccgccaaggcgctctcgagctttgagggcgtccgtcgtcgctttacccacgtgggcgatatcgatggcatcaccgtggtcgatgattacggccatcaccccaccgagatcaaggcgacgcttgctgccgcttcgtcgctgggctacaagcacgtcgacgtcgtgttccagccgcaccgctattcgcgcctgcaggccctgtgcgacgactttgccgatgcatttgccaatgccgataaactgctgctgattgatgtgttctcggctggcgagatgcccattccgggtgtcacctctaagatgctcgccgataccgtgcgcgccaagcatcctggtaaggaggtcgtgtattgctccagccgtcttgagcttaatcaggagctcgagcagatggtgggcgagggcgacctgctgctcactatgggtgccggtgacgttacgaccgtcggtcccgagttcattgagtatctgactgccaagaaagacgcttaagtctaatgggtctgtttaacgccgttatggcgctctcgggcatgatcgacacggatgtgatcgaggacgagcgccttgcgcgtcatacgagctatcgtatcggcggcaaggccgacctctttgtgacgtgccatagctatcatgcccttcgccgcgccgtggcggtgctcgatcgcgagcaggtgccgtgggtcatcatcggcaagggctccaatctgctggttgccgatggcggttatcgcggtgccgtcatttcgctcggacgtgagtttcagcgcacggttgttgccgatgacggttgtacgctgacggtcggtgcgggcgtgatgtttgcgcgcctggtcaacgatgccctgtcgcgtagcctctcgggccttgagtttgccgttggcatccctggttcggttggcggtgcgatatctatgaatgcaggcacacggaccgagtggattggctcgctggttgaggatgtcgtaacgtttgacccggcatccggtatcaagcattatgcggggtccgagatcacttggggctaccgagaatgtagccttccccgcaatgagatcatcctcgagtgcgtgctcaagcttaaaccggcgcccaaggccgacattcgcgagcgcatggaacggtacctgacgaggcgcaagcgtacgcagcccatgggtcgcgcatcctgcgggtcggtctttcgtaacccgcccgatgcgagtgtgggcaagcttatcgaggattgtggattaaagggtttttcgattggcggtgcggaagtttcgcccgttcacgctaattttatcgttaataacggaactgcctcggccgatgacgttgccgcggttatcagacatgtgcacggaaaggtgagggaggcgtatggcatcgagctcagaccggaagttaaattcctcggcttctagagcatcgaaacccaccttccgccgcgccggagggcgttccggcgcgcctgccaaacctcaacgcaataccgtcgcgcactctaagcctgtcgggcatgctcgacaggccagtcgtccggtcgtcggctcgcagctcggtaatcgtccggctgcaaaaaagtcctcgcgtccctcggtgacgtcaaagcctgttatgggcgccaagcctgcccgccccatggcaactcctaagccctcgacgggaactaaagcggcgcgtccaggtcgcacactgggcgcatcgaaaccgcgctcgctgacatcggtgccggctaccgccaagaagcctttgagtaaaaaaggcgtaaacccgttgtcttcacttggggcgatggcaaataaaacatcagacgccgcttctgtcgttgcaggcaaaggcaaaatcgtgggcggagttctggccgccttggccgtgctcgtcgtcgttgccatcgtggtgattaactctggattgtttaccgccactgatattcagattcaaggcagcgagcatgtgacgaagcacgatgctatccagctgatcgatttgcccgagggaacgtcgctttttaacgtcgatcccgaccagattaccgaggatctcaagcagaacccgtgggtctcgggcgtggatgtccagcgtcagttcccgcatacgctcatcattacgccgatggagcgcaaggtcattgcaattgcctacatcagctccgatgaccttgcctgggccatcggggatgatgacacctggatcgccccgctgtcgacgtcggtcgaagtggacgatcagggcaacgtcatcacgacagggcagggctcaaataccttgaccggcattgatgccgcactggcgctcgctaagcattatggcgcggtgctgttgactgatgtctcggcggatgtcgctccggtttccggccaggcggtgagctccaaggccgttaaggccggcttggattatgtgcgtggtttttcgagcgagttcttgggacaagtcaaggatatttccacgccttcggtcgaagccatctcggcaaacctcaatagcggcattgaggtgtcgctgggcgattcggacgatatcgccaagaaggaacgcgtagtcaccaagttgctttcgcaggtagagggcgtaacgtatatcaatgtgcgctctccgggcaactacacatttaggaatgctccgacctcgtagcgctggttgatgctttgttgaggggccataccacgccgtttatctggtttgtttggttttcacggtcaattatttgactgatacgttcataatgtgcaaccataatacggtttacctttgcatttactttcaacctgaaggttaatgtgcgcaggggtcgacccatgctatggctataacctttgttcggaggaccgacatgcacgagacagagatcaacaactaccttgccgtcattaaggtggtcggcgtcggcggcggcggtaccaacgcggtcaatcgaatgatcgaagagggcatccgcggcgtcgagtttgttgccatcaacaccgatgctcaggcactcgcgatctctgatgccgatatcaaggtgcacatcggcaccgaccttacccgcggcctgggcgccggcgccaaccccgaggttggccgcaaggctgccgatgagtcccgcgacgacattgccgaggcgctcgctggcgccgatatggtgttcatcacctgcggcgagggcggtggcaccggtaccggcgctgctcccatcgttgccgatatcgcgatgaacgaggtcggtgcgctgaccgtcgccgtcgtgaccaagcccttcaccttcgagggccgcaagcgcaagaagagcgccgaggagggcattaagaccctctccgattgcgtcgacaccatgatcgtcatccctaacgataagctgctcgacatcgccgagaagaagaccaccatgctcgaggccttcgcgattgccgatggcgtcctttcccagggcacccagggcatcaccgacctcatcaccgtccccggtatcatcaacctggacttcgccgatgttaagaccatcatgaagcaggccggtaccgccatgatgggtatcggtacctcttctggggacacccgtgccgtcgacgctgcccagcaggccatctccagcccgctgctcgagagctccatcgatggcgccacgcgcgtgctgctctccatcgccggttccaaggacctgggcatccaggaaatcagcgacgccgccgacgttgtcgccaacgccgtcgaccccgaggccaacatcatcttcggtaccgttgtcgacgagtccctgggcgatcaggtgcgtatcaccgtcatcgctacgggcttctccgactccaacgtcaaccgtcaggacgagctctttgctgctcagcagtctcagagcaaggccgctgcctccgctgagccgcagcgcaccgctcctgccacgagcccggctcaggccgctccgacccgcaacgtcggtggcaccgagcttcctaacttcggcaacgatcagttcgagcttcccgacttcctgaagcgcggtagcttctaagtcgttctttgcattgttgtgcacaggggcgtgtccgtatggacgcgccctttttatttcgactttgtaaactagaacctccaatctctttacgttccctttacgattgcctccagcgcagcaggtatccttttagagaagtatgacagccgtataaacgcgggctgtagcggcgatgccgcggtacttgtgttattaggaggctttagtatggcagcacgtgcggacaaagtttcgcgtgtcgaccatgatggagttacgttggtggagggcgcgacatccgatgttcgctttgccttcaccgagcgtgccggtggcgtttccgaagatgcgtactcctcactcaacttgggctcgcatgttggcgatgacccctttgctgttcaagaaaatcgtcgtcgtgcgctcgaggctatgggtgccgccgagtgcgagcacaacctgctcgttcccaatcaggtccatggtgatcatatcgttgcggtgacctcgaacggcgccgatgaccttgaggacgttcgcgagcagattgccgagggctgtgatgccatcgtctgcacggcgcataacgtgcccgtgctgctctgctttgccgactgcgttcccgtggtgctggtggcccccggcggatttgccgtggtgcactccggttggaagggcacgattgcacgtatttccgccaaggcgtgccaggcgctttgcgatgctgccggttgcgatgcgagcgacgtttccgcctatatcggcccccatatcttgggtgacgaatatgaggtatcccaggaactcatggatcgctttgccgccgagttctcttgcatcgatgcgaatacctctcgcatgctcgatctttccgctgccattcgcgaggcgctggtagatgtcggtgtcgacgcggataatatcgtggatacccagctttcgaccgtgcgtcagaacgaccgcttttattcctaccgtaacgaggacggcacctgtgggcgccatgctgcgatcggcgtgatgctatgagaaagatcgtatcggtcctgagcgccgctgtgcttacgcttacgctgtgcgcctgttcttcgggatcttctagctcttccattaccgtggccggctccacgacctgccttcctatcgccgagattgcggccgagggctttaaggaggagaccggcatcgacgtgctcgtttccggtttgggttcttccgctgggatcgaggccgtcagcgccggcacggccgatatcgccagctcctcccgtggactcaatgccgacgaacaggatctgggcctgactcccatcgtcattgcccacgacggtatcgcggtcatcgtgaacgacgataacccggtcgataacctctcgaccgagcagctccgcgatatttacgccggcaagatcaccaactggaaagaagtcggtggcgaggacctgaggattcaggttatcaaccgagatgaggcgtccggcacgcgtgaggccttccgtaccatcgtgatggacggcacgccgttcgatcgccgctcggccgttctttcgggcacgggccaggtgcgcgacgtggtatctcgttcgcgcggtgccattggctacatttcgctgggcttcgtcgatagcctcaacgccaagacctcggtcaaggccgtctcggtcaatcatgttgaggcgtccgagaagacggtcgcgagcggcggctatcccatctcgcgcgacctttacttctttgtgaagggtgctccttcgcagcaggcgcaggattacatcgactacgtgacgtccgaaaagatggacaagcagattcgcgaggcgggctttattcccgtcaccaacgacgagaaggggagtgagtagcatggaagcacaggaaaactcccagactgagcagaatgctcaggcacccaagaagcgcgagctggcgctcgtatcgcgcagtacctatatcaaggagaaggcgctgcagtggatcttctttgcctgtgcgttcttggcggtcgttaccgtcatcctgatttttgtctttaccacgtactcggcgctgcccgtctttaccgacatcggtctggcggacttctttagctttacgtgggcgccctctgagggccactacggcatcatgtcgctgcttgccggctcaggtctggtgaccgtcggtgcgctcgccatgggcgtgccgctaggtgtgggcacggccgtgtacctggtcgagatcgccggcaagcgcgtgcgcaagcttatcagccctgccgttgacctgttggccggcatcccttctatcatctatggcttctttggaatgatcatcatccgtccgtttatcgcgcaactgaccggtggtcttggttttggtgcgctgacggcgtggttcgtgcttgccatcatgatcgttcctaccatcaccacactcaccatcgatgctctcaattccattcccatgggcattcgcgaggcatcgtatgccatgggcgccaccaagtggcagaccatctataaggtcgtgctacctgccgctaagctgggtatcgtggatgccatcgtgctgggtatgggccgtgccatcggagagaccatggccgtgctcatggtcgtgggtaatgccccggttattcccgacagcattgcgagccctatctcgacgctcacgagccagatcgcactcgacatgagctattcctcgggtctgcaccgctcggcgctgttcggcatgggcgtggtcctgtttatcatctccgccacgctggtgggcatcgtccgtctgatttccaagaagaagagggggtaggctatgtccgattccgttgacacgacggtcgatacgacctcgtcgcgcgagcgcatcaagcgtgccctttcccacggcaagaagggccgcatcaacaaggacctgtccaacaagatcatgcttggcgtgttccgtgccgcggcatacatcaccacgctggtgctggtcgctatcatcgcctacgtggtcattaacggcctgccgcatatctcactcgactttatcttcggttggccccagggcgtcaacgccgagggcggaatttggcccacaatcgtctcgaccgtctatgtgacggcactcgccatgcttatctgcacgccgatcgctgtgctggcagccgtctatctggccgagtacgccaagcagggcaaggtcgtcgagctcattcgctacgctgctgacgctttggcctcggtgccctccatcgttatgggcctgtttggctacgccttgtttgtcgaggctatgggtctgggcctttcgatggtctcggccgccctggcactcgcgctcttgatgcttcccatcgtcatgcgcaccaccgaagaggccattcgcgccgttccgcgctatatccggtggggtgcgtacggcctgggcgccaccaagtggcaggtcgtctccaagatcgtgcttccttctgcctttggccgtattgccacgggtatcgtcctcgccatcggccgtgccattggcgagaccgcggtggtgctctacaccatgggccaggccatcaatctacctatttcgccgctcgattccggccgtcccatgacggttcacctgtacctgcttgccaacgacggcatcaacatgaacgcagcctatggcaccgcgctcttgctgatggtgatcattctggccttcaacctgtttgcgcgcttcctgtcgcgcaagcgtcgctagttaaggagtcccatgtccgtttatcagtccgctcccacgctggagcaagcggccattacggccaaggatttcaacttttggtacggtgactttcatgcgctgacggggcttgacctcaacatcgccaaaaacgccatcacctccttcattggcccttcgggctgcggcaagtcgacgtttttgcgctgcatcaaccgcatgaatgacctgattgagggcacgcgcgtcgagggcaccatgacgctcgacggcaacgatatctatgccgagggtgtcgatccggtcgatctccgtcgtcgcgtgggcatgatctttcagcagcccaacccgtttcccaaatccatctacgagaatgtcgcctttggccctcgtctgcagggcgtgactagcaaaagcgacctcgatgacatcgtggaagaatcgctcaagcgcgccaacctctggaaagaggtatccaatcagctcaacaaggatggtttggcgctctcgggcggtcagcagcagcgtctgtgcatcgcgcgcgtgcttgcggtgcaacccgatgtcctcctgatggacgagccctgctccgccatcgaccccacttccgtctctaaggtcgaggatctgatggccgagctggcgcccgagatgacgattatcatcgtcacgcattcaatgcagcaggcagctcgtatcagtgactacaccgcgttcttcttgcaggaagttgccggcgagcccgctacgctcatcgagtatggtcaaaccgacgcgatcttcaccagcccggtggactcgcggacggaagactatatcaccggccgctttggctgatcggtgcgactagtcccaagccgatcggatctggtccggtgcgtattcactgtgcgggcggcatgaccgcacccaactgattggagtgaaccatgcgcaaactgttttcccgtcagctcatcgaggcccgtcacgagatgctgagcatctacgaggccgtcgatctggccctccacgatgccgtgaaggcctatgtgaccgacgaccgcaagctcgccaccaagaccaagaagcgcacgctttcgattgacgcacgctgcgccaacctggaggccgtctgctacaacctgattgccacgcagtcaccggtcgcctccgacttccgcttgctgcagacgatcatctacgtcgactttaacctgcagcgcatgaccgataaggttcgccagatttgccgcgccacgcgtcatatgatcaaggccgacatctcgctgcccaaggagcttgtcggcacggtcgaggccgaggctgaggccgtctaccaggtgctgggctcttcgctttctgcgctcgtcaccaacgacatgtccatcatctgcaacttggccgtcgaggacgagccagtgcacgccgcctacgagaagttcttccgcacctttaaccgcatggacacgggcgattttatggacgacgacagcaactatgacgacctgcgccgcgccatcatggtatcgcgctatctcgatcgcatcgcctcgatttccatcgatgccgcctgccgtctgaccttcctgttgaccggacagcgtatgactgccggtgatatcgcctgcactgatgaggatgagctcgagagcatgcgcgtgccttcgggcgagggtgttatcatgaggcccgccgtcgatgcacgctacgttgccaaggtgcccgttaacgaggtcagcgagggtcttcgctacctgctcgatcatcttgaggatgaggacgatggcgaggacgacgaggagtaagtaaccccgttcgtcgaaagattgtaaatacctaagtgagcgcggccttgcacatgcggggccgcgctcttgcgttagcatgggactacttgtttggctgtcagcggaggcgattggcaatggataactatttggacttgatgcgcgctcgccgcgagcagattctggaacgtttttatgcggcgctcgatcgcgcgggccgtccccacgacgccgcgagcctcattgccgtgtccaagaccgttggtgtcgatgagaccgttgccgccatccaggcggggtatcgccattttgccgagaaccgcccgcaggagctggttcgcaagctcacgggtctggcggagcatccggagctgcccgaggtgcgcttcgatatgatcggcaacctgcagaccaataagatcaatgcggtgctgggctcagccgagctgattcactcggtgggttcgctgcatctggcgcaggcgatctcgagccgtgctgttcgcaagattgaggcaggcgagctcgtcggcccccagcgtgtgctcattgaggtcaatgtgagtggtgaggagtcgaagggaggcttttcacccgatgagattcgcgccgccgcgggtgagcttgcagaacttgagggaattttcgtacaggggcttatgactatggcgccccgggggaataaggatgtggcacgccgcacctttgcggggcttcgtgagctgagggatgagctggaggcggcgcatcccgatttgaacctgcctgagctttcctgcggtatgagcgaggactttgagtctgcccttgaggagggctctacgctcgttcgcctgggcagggtagtatttagcccggagtttgcagtaaaataaggctctgaagtgcgcactgattatcggggcgcctgcactaaaccgcgagaggacacaaccatgggcttccttgacgagattaaaaataagatgcacctgggcggccagcagggttacgaccagggttatggccaggacgacgactacggctacgatgacggctacgacgatggctatcagggcaacggctacagtggtgcttcgggcgagggcttctacacccaagacgagccgagcaacggcctgcttggtcagacgcgccgcggtgaagctgagtcggttgccgtgtatacgcgctccggtcagctggtcggcgatgactctcgccatgccacaacgtataacccgccttcgcgctcgcaggacagtgttgcgagcggttatcgtcctggtgcctatgacacgccgtctagctacgccgagaacacccgcgcccgtgccgccgctgcgcccgcgcctgcaccgagcgatgcctcggcctatgcgagcaatatcatcaacgccacaccgcagctgccggcctatgtcctgcgccccgagagctatgacgacgtggagaccgtggtgcgccgcgttcgcaccaagcagcctgtcgcactgatttttgtgggcgtacgcaccgaagttgccaagcgcgtcttggacttctcttacggctttgcctgcggtctgggtgccacggtcaaggaggtgggcgaccgcgtgttcatggtgctgcccgccggttgcgaggtcaaagattccgatctcaagaagcttcgtgcggacggctaccttaagtaaagacaagacgaggagattcccatcaacatctacactatcgtccagctggtcaacacgctgttcaacttctattccacgctcattgtcgtctactgctttatgacgtggattcccatgaagcagggtggtttgcttcaggatattgccgcggtgcttgatagcgtgtgcggtccgtggctcaacctgttccgtcgtttcatcccgccgatgggcggtatcgatttttcgccggtcgttgcgattattgcgttgcagttggtgcagaggctggttctgcagcttcttataggtatactcgtgtagaactgacttagtaacttacgtcgggcgtgtagcgccgaggcgatgaaaaaggagacttgttatggctattacccctgcagacatccaggctcagactttctctgaggccaagcgtggctacgatcctgccgaggtcgacgtcttcttggagacgctgtcctctgaggttgacgctatgctcgctaagatcgtcgaccttaagggtcgtctgactgctaccgagcagcagcttgccgatgcgcaggctcagcttgcccaggctcaggatgcccccgcccaggccgttcctgccgcccccgtggctgctcccgcccctgacttctccgctcaggagcgccagatttccgctgccctgatcgctgcccagcagaccgctgagaccatcgtcaacgatgccaatgagaacgctgagcgtattcgcaacgaggctgacgccaaggcccgcgaggttatccgccaggctctgaccgaaaagcaggctgagctcgaggagatcgatcgtctcaaggcttctcgtgaggagttcaaggccgagtatctcaagctcatccagcacttcatggacgatgcccagaactccttcccggccgacctcatggcctccacgccggtcggttctgccgcttctcctgcggtgactgttcccgccgagccgctgcccgtcgctgacccggttgtccccgtggccgatcccttcgccccgatcgacaacttcgctgccgacgacctggactaacattcggcctacaatttagtgcctagaaaggacccgcagcttgcgggtccttttttatgactgtaccggggcgcgcaacataaaaaaccgagccctgcacatagtggcgcagaactcggcgaaccggtgagcggtcaaggataggttttagggcatgtcccaaaatctacttgaggaggaagttggagaggggaatggtacgggcctcgcgatgctcggaatcggcgatgtggtcggcaggatatccgcagacgagcatgtgatagggatagacgcccttgggcagattgaactgctcctgcgccacctcaggcttaaaatggcatacccaacacgttcccaggccctgctcggtggcctccatcatcatctgatcgcacactatggacgtatcgatttcactggaattcatctggtcatacgggcgcacccaagcgtcttcggtaacgctacaaataaggaagatgagcggagcgccaaagatagatccatcacgagcaaaccgaggctgacaagcagcagccttctccagaagctcaggcgtatccagcaccatcacacgagaaggatgattattacaagcagaaggagcaatccgcccagcctcaacaatggcatccaccacagcctgctccacagcccgatcttcaaactcacgacaagaataccgaccccgagccagatccaaataccccataaccaaaccctccaaagtcagcaaatcaatccaaggtaaaccaaagggtacccaaacccccatccacccaaacgcccaccgaataccaaagtgttcaattgggtattaaaggccccctcggccaaccccccattgcgctctaactatcagccaaagttccaatggtggtacgtaaggcgaagggccggccacggtttactttcgaacgactctgcaaagcagccggagtgagaaagcaaaccgtggccggcccttcgccgccgggacacgtacccccaattaactgttcttcatgacaatcgaatccacaacatcggccacattctcgcagcagtcggcgcagtactccaggaaggcgtagacgtcacgccaagcgatgacctcgagcggatccttgccgttaacgtgcaggttgcgcatggcgttgatgtagagctcgtcggcctcggactcgatggtgttgatctggatgaccagctcgcgcagggtcttggacttgcggtagttgggcagctcgaccatcaggtctttcatggcgcggcaggcgtcagtcaccttgtgggcgatgacgatggcgtcgggatggatgctctgaatgttggtgaagtagacgcgctgcacgacgccctcaatacggtcgagcacggtgtcgagcgcgcagctcatcagatccagatcctcgcgctcgagcggggtgataaaggcggtgagcagggcgtcttcgagctcgtggtgcttcttgtctgccgcatgctcaatcgcatgcatctcctcgagcatgtcgtggatctgcgcgggatcaaagttctcaaaaatcttgatgagcaactctgcggcctggacagcaaggtcggcgcaggcgacgtagttgtcaaagtagaacgaatcgggtttctttgccatgggtgggtcctttcgaggcgaagacgggtgggcgaagtgttgcggtccagatggacgttcggtttgactagaggaacatcatgaacagcttggccatgacaaagctgatgagtccgcaggcggggaaggtgaagaaccaggtgaacatcatgtccttgacgacgccgaagttgatggccgagaggcgcttgacggcaccgacgcccatgatggcgcaggtcttgatgtgtgtggaggacacggggatgccggtaagggtggcaagcagcaggttcgcggcgcccgcgaggtcggcggagaagccctgatacttctcgagcttaaccatgctctggccgacggacttgatgatgcgctcaccgcccacgctggtgccgatacccatggtggccgagcacagcagcataatccagatggggatgccggcatcgccgacgctggtctggccgtttgcgaaggccacgcctaaaaagagcacgccgatgaacttctgtccatcctgcgcgccgtgcataaagctcatggccgcagcgctcgcaatctgagcgtatttaaagaagacattggcacgtcgcctgttggcggcggcgaaaagaatcgagacgagtttgcacaggacccagcccatgacaaagcccaggccgatggagagcgccaggccgtagatgaccttcatccactcgtggacgttgacgctgctcgcgccgccgagggcgatagcggcaccggtcaggccggcgataaggctgtggctttgcgaggtggggatgccaaaacgcgacgctgtggcgccgtagacgacgatggagaacaacgccgcgcacaggcaggcgagcgccatggtgctgtttccgccaaaatcgacgatatgtgagatggtgttggcgacgctcgcattaaagtgcgtcatgatgagcacgccgaggaagttgaatgcggcgctcatgagaatggcggcgcgggcgggcatgcaacgcgtagtgacgcaggtcgcgatggcgttgggcgcgtcggtccatccattgacgaagatggcgcccaacgcgaggatcacggtgacggcaaggactgggttcgacacaatttggccgaggaaggttgagaacgttacgtccatatatgggctttctcgaagtttgcagacacgttacaaaaacatgataaatcgtatcacctcctacgggtttctttgccgagttctgatgggagaagtaattttttggcactaaaattgaatattagccctgttgaccgtgggtgttctttttgctatcacgccatgcggacacgcgcgttcgctccgacactccaaaaccacagtctgttcgctttacaacatgcaaacatgcgttcgataataggagacatggaatatcgacagacagatggcaaaactcggcgcgtgcacaagcagtatgtggacgtcgtggctcgcatcctcgcgggcggacaggtcgtgccggtcaccgtctgctgggtcgacggtcgttgctttacgattgacgagattgtctcgaccgctgggtttggcctgacggttcacggcatccgtacggcaacctataaggtgcgttttggcgggcacgcgaccgagttgtatctggaggaccagacgcgcgaacgaccagatggctcgcaggcccacctgatgcgttggtgggtgtgggcattcgaccgtacgcttgagggcgagcgccgtaggtaaggacgcacggcgttcgggtacaatgacaggaatcttgtcacctgctgcgccgtctttcacggcactttttgaaaggacgaacctatgaacgatatccagggctatcagaacggccccgtcgagagcggcgcaagccgcgccaaggagatgtcgccgcgcgcgtacaaccttgtcatgtctgccctgatctttttgggcttttgcgccatgggcgtcggtgcttactttacgagcaccatgtcgtttgcgcgcatgatgatgagcggcgccgctttgccgctggtctttggctcatttattttgaccatcgtcggcatggtcatgatgtcggccgccgccagcaagcagtccgtgggcctgtcccttgtgggctacgtaatctttgcgagcacctttggcctgaccgcgtcgtttggccttgccaactacgacctgcccaccatcaacactgcctttatcgccacggccgccatcacctttgtctttggcgccttgggcgtgacgttccccaagtttttccagcgcgtatatggcatcggttttggcattctgctcgctactattctggttgagatcgtgctgatgttcatgggcgtctcacagaccatcaccgacctgatcgtgatcgtggtgttcgccggctttattggctacgacacctatgttgccacgacggtgccgcctacgctgcccaacgccgtgctcatggcgtccaatctgttcgtggacattatcaacgtgttcttgcgcatcctgaacatcctcggccgtcgcgactagtggcgaattgcggcggtgcttgccgtgcgtgcaaatcgatgcgaaaggcggtccttcggggccgtcttttttgtacgcggcggggtatcatggatgggaaaagccgatagcggcagagaccgagaaaggtgaccacttatggcagacgtcgacaacaggaaccgtaaccgcaggtccaaccgagcgggtcagcccaatcccaagcgcgaggcccgtgccaaggccgccgagcgtcacgtggcaactgtgtccgaagcgtgcgccaaggatatcgagcgttcgcttgccggtgttcgcgagtttgacggtatgcctgccggctttgtctcggcgatgaaggccagggtccagaaggcagcggctgctgaggagcaagctgccgaggacgtcgaggctgccgaggtcgaggctactgaggctgctgaggtcgaggctgcggtcgatgccgaggtggcgcccgagcccgtcgaggaggccaccgaagccgagcccgcgcctgccgccgaggagcccgctccggtcctgcccgaggtcaccgtgctcgacgcctctgccacgcaggccattctggataacggtcgaggctacgcgcagttctgcgacatggctgtgcttgcctttgcctcgttcaccaatccgggcggtggctacatccagggctatctgggccaggaggccacgctgtgcgccgattcgtacctgtacaatgtccttgataagcagcgtaaatggtacggcgagaaccgtcgccgcaacatcaactgtgagctgtaccgcaaccgtgcgctggtggtgcccgcggtgcgcttcgaccgcaagcatgtgcacgcctatgccgacgtaatcgtcgccgctgcacccaacgccaagcgtgctcgccaggagtaccgcgtgagcgacgatgccttgcttgacgccctgcgcgaccgcattcgctttgtgcttgctatctgcgatgagctgggccgcgagaagctcgtactgggtgcttggggctgcgagaacaacggctttgacgccgaggccgtggccgagctcttccgcaaggagctcgcatcgggcgacttcaaggtcaagcaggtcttctttgccgtgccctctacgcgctgggacgaggattttgccaagttcgagcacgtgctggcaaacttccccgagcgcaacgaggagtcctatgcccaggttgccgcccgcgccgcagccgctcgtgccgccgagcaggcccaggcagcagccgaggacgatgaggacgaggacgactggcgcaagtacctgtaagcggtgcgcgcgatgtgatatgccaagccgacgggagggattgctcccgtcggctttttacggaatggggaactcaagatgaaaaacgttctgtgctttggtgacagcaacacctatggctatgatccggcgggtatgcgcgacggcaccgcagtgcgctatgcgcaggatgtgcgctggtgcggtgtggtgcagcgtgacctgggtgagggttggcatgtgattgaggaaggcctaaatggtcgcacgacggtgcgcgacgatatgtgccatctggacaccaacctcaacggcattcgcgcgctgccgatgctgctcgaagcccataagccgctggacgcgatcgtgattatgctgggcaccaacgactgcaagacggtctttggcgtgacagcctccgatatcgcccgtggcgccatggcactgattcgcgccgtccgcgcgtttgcctggaccgatgccgcgccctgcccacggattctgctgatggcgcctatcaagattaagccgcagatcgccgacgtatatatgaccgattttgacgagcattccgtagaagcctcggaacattttggtgagtactacgcgcatgtggctgagcagtttggctgcgactttttgaatgccgccgactttgccgagccgggcgatatcgattatctgcacatgatgcccgaaggccacgagagcttgggacatgccgtggcagccaagctccaagagatgctcggtgagtagcgcagccccaaaccagtacaaaagtttcccttgcggcggcttgtttcgttggtttgtctcgatctgtaacagctgtaaggccgaaaacgggctagatgttacagattgagattattcaggttgatatcggtcgtttgtctcgatctgtaacatctagggtcgattttgccgatctactgttacagatcgagattatcttctcggcagaatttgaatgtctcaatctgtaacaggtgggccgaaaaatggactctaactgttacggatcgagatgtctgtgggaaccaccgcaaaggtgtctgtcccctttgcggtggttttggactgcgaatcttagtactgccacatgtggttgacggggccggagcctttgcccatgtcaaagccggcggccagagcgccggttaggtaggccttgccggcgttgacggcgtcggcaagatccatgccctgagccagcgcgcaggcgatggcggacgagagcgtgcatccggtgccgtgcgtgttgtcggtctcgatgcgcttgtggcggaaccacgtggtgagtggatctcccagatggttgccctcgtcatcgagtggcgcgggttcggccagtacatcgttggcctcgttgacaagatgcccacccttaacgagggatgcgcaaccaaagcggcgggtgaggagcatggcagcattttgctgcgtgcgctcggagtcgacctcatagtcgagcagtgccatggcctcgggaatattgggcgtgataaccgtcgctagcgggaacaggcggcgggtgagcgcctcggcggcatcttcggcaatcagccgcgcgcccgaggtggcgaccatgacggggtcgacgaccacgttcgttgcgttccaggcgctcaagcggtcggcgatgacttcgataatctcgacagaagaaaccatgccgatcttgacggcgctggggcggatatcgtcaaaaacggcgtcaatttgcgcggctacgatatctggcgagatatcctgcacggcggtaacgcccagggtgttttgcgctgtgatggcggtgatggccgtctcggcatacaggcggtgcgccgtgatggtcttgatgtcggcctgaatgccggcgccaccgctggaatcggatcccgcgatggacaggacggcaggtaccttactacgatccatgttcgctcccttgttcggtcggaatcaaatgggtctttaagccagcattataaagatgcccgggccgactctatgccgaacccgggcgggcgatgcaatctctacgcaagtgtaagtaaatgttcacaagtcaacaattgacaggcaccagctcgccgccagaagcggccgcggcgacagggttagtcctccatgccgaggtcgatcgtggtgccctcgaagatcttgttgacggtgcggacggcgcacatcttgccacacatggtacaagtgccctcggtggcggcgggggactcctcgtagcgcttcttgcccgtaaccgggtcgagcgcgcacttccacatggcgtcccagtcgagcttgcggcgtgcctggcccatcttgtcgtccatgtcgcgggcgtggggcacctttttggcgatgtcggcggcgtgtgcggcaatcttggtggccatgaggccgtcgagcacgtcctgggcgttgggcaggcacaagtgctcggccggcgtcacgtagcacaggaagtcggcgccggagctggcggagatagcgccgccgatggcagcggtgatgtggtcgtagcccacgccgatatcggtcaccagcggcccgagcacatagaacggggcgttgtggcacaggcgcttctgcagtttcatgttggcggcgatctcgtcgagcgccatgtggcccggaccctcgaccataacctggacgccggcggcccatgcgcgcttgcacagcttgcccagctcgatcatctcggcggtctcggtggcgtcgttggagtcgtagaggcagcccgggcgacaggagtcgccgagcgaaatcgtcacgtcgtactcgtggcagatttcgagcagctcgtcgtagaactcatagaacgggttctcgttaccggtgacctccatccagccaaacagcagcgagccgccgcggctcacgatgttcatgaggcggccggtctccttaaaggtctttgtgaccgacttgttgatgccgcagtggatggtcataaagtccacgccgtcctcggcgtgcgcgcgcacgacctcgaacaggtcgtccttggtaagcttgaccagcggcttttccatgtagccgatggcgtcgtacatggggacggtacctaccatgagcggcgtctcgtcgatgagctgctggcggaactggcgcgtcttgcccgagttggagaggtccatgatggcgtcggcgccaaagtcctcggcgatcttgaccttcttccactcttcggcggcatcggccttatcgcccgagatgcccaagttgacgttgaccttggtggacaggccctcaccgacgccaaaggcgcgcatgccctttttgatgtgcacgatgttggcgggaatggcgatgcggccgtcggccacgcgctcgcggatgtactcggggtcgcgatgctcgcgctcggcgacctccttcatctgcggtgtgatctgcccggcgcgggcgaagtcgatttgcgtgacgagcttgggctcggtctgtgtgctcattggcacggctcccttcgttggcattacccatatcaggtttgcgggtcagggcgggcgcgcccagtctcagcctgccgtcttgtcctgcaagctccccgtttatgtaatgggctcaagtatagctcgaatgggtacgattggcctaacggacgtgccagtggggaggcgtacatggaagacaagcatctatatcgagagacacaatgggacatatcggccgaggagggccgtgcgcaccatgggttagtcgcgattggctttgcggtgcttgccgtgctggtgattgccttttgtatttggacgtttggcggtcgcggcggcgctgcctgggaatttgaggccgatgatgccctgccgattatgacggtgaggagtactggcggtaatgccaatacgctcgccgttccgggcgattattggtatccgcgcgacgagtttgtgcagttgcagctgagtggtggatccattccgggtgaagaaatcgaacgcgtgacgtttgatgcagcgctcaaaacgctcacggtaaagctcaaagatcagggggacgtgcccacgaccatggatatcgccctgacggaatggcgtttggagcctccgacgggtgttgcggtgtccgaggttgagcacgtcaagattgtctatcaggacggttcgacaaatgggattgcaaaggccgacggtctagcagaataggtgtcgagcctagcagccaattcataaaagttgcggtggaatagttcctgattgtgcgataaaaggctcaaataggaactattccaccgcaagttatatggagaaagctgagcgggtcagtgttgggtgccggctctagagtgctcgttgatgaacacgagggtgcctgggcatgagagctcgggaaagtgtcgataaccaacgtcgaacgcggtgagctcgcttgcatcctcgagcttgttttctgccatccaccgcaccatggagccgcgcgcctttttgctggcggtcgaccgctggatgggcttcccgttgcggataccctcgccaaagaggcatgtgacggccgtggcgtcgcccgcgaggtggggcagaacggctttggcatactctacgctggcgaggttgacgatcgtggtgtttgagcctgccggggcgatagcccgcgcgagcttgtcgctccaaaacgcgtagaggtctcgggcatcgtcaacggcgagcttcgcgcccatctccagccgatacggttcgacggcatgaaagggacgaacgcacccgtagaggccggagaggatccacagatggtcttgcagccatgcgagctgcgcggaattcatcacctcgggtaccatgctctggtattgaatgccgtgataggacatgacggcaggggagatgtgacgggcgagtgcgggattgtcgagatcgccgcttttcaggatgggcccgaactcatgcagggtgttgaggcaaggccccagcagtttgtcactcacgttccacagcgcctgcaggccgccgctgccttcattccgctcgatatctagcagtgcgcggtggaggcgagccgtctcgcgcacaaagggtggaatgcccaggacttcaaaagcatcttgggccgcgcgcatctgcttggcgggcgaaatgatgacttgaagcatggactctgccaaaaaagttgcggtggaatacggtctgttttggccgtttatgggccagtttagtctgtatttcaccgcaactgatgaagggttggttaggcgcgctcgaggaaggccttgtagccgcgataggcctcgtagatgtcggccttgttggcgacctcccacagggcgtgcatggacaggacggcaacgccggagtcgatgacgttcatgccatacttggccatgatgtaggcgatggtgccgccaccgcccgcgttgacgcgaccgagctcacaggtctggaagtccacgccggcctcgtccatgatgtcgcggacgagggccacgtactcggcatcggcgtcgttggaaccgctcttgccgcggctgcccgtgtacttgttaaagcacaggccacgacccataaaggcggcgttcttcgtctcgaacttgccggcatagcccgggtcgaaaccggcggacacgtcggaggagagcatgcggctgcgggcgagcgcgcggcgcagggccagcgggctatcctcgccggcgagcgtcatgatctcggcgacggtgttctcgaagaagcggctcgtcataccggtggcacccacggagccgatctcctccttatcgacgatgagcgtgatgctcgtgcgctccacgttggcgacgtcgatctgggcgagcatggacggataggcgcagacacgatcgtcgtggccatagcccaaaatcatggagcggtcgaggcccatgtcgcgggcgggaccggcgggcacgacctcgatctcggcggagaggaagtcctcctcctcgacgtcgtactgctccttgaggatgtccaggaacatctgcttgacgggctccttgggggcgtccttgtcgtccccatcgaacttgacgggacgaccgcccacgatcacgtcgaggatctcggcatcgacggcgtccttggcaggcttggacatctgctcgctcgagaggtggatcagcaggtcggagatggtaaagaccgggtcgtccgccttgtcgccgatattgatgtcgacggtggtaccgtcctttttgcagatgacgcccacgagtgcgagcggggaggctacccagtggtagctcttgacgccgccgtagtagtgcgtgtcgaggtaggccatgtcgccggcctcgaaggcgggattctgcttaaggtccaggcgcggcgagtccacgtgggcgcccaggatgttaaagccctgctcgagcggggcggtgcccaggttgacgagcataaggtccttgccgtggttggcggcgtacaccttgtcgcctgccttgagctcgcggccctcggcgatcacggtctccaggtcgacgtatcccgcctcctcggccatcttgatgccggtcttgacgcacaggcgctcggtcttgttctcgctcaaaaactgcttatagccgcggcaaagctcctcgagctcctcgacttgctgtggcgtgtactttttccatgcgcagggacgctccatgacgcagtctcctttcggatcgatcgtgctggttgatgtaccgtgagccatcgtatcacgcgcgggcccgcggcggcagggaagcctgatgtgcggtggccgcggggcggggagcgtgtaaactggtgtgagcaaaccgtgcccagcccaaagcgaggtattcaatatgtctgacaagcgccgcacctttgccgttatcgacggcaactcgctcatgcaccgcgccttccacgccgtgccgcccaccatgaatgcgccggacggccgccccaccaacgcgatcttcggctttctgaacatgtttctcaagatgatcgatgcctttaaccccgacggtgtggtcgtggcgtttgacaagggcaaaccgcgcgtgcgcatggagatgctgccgcagtataaggcgcaacgcccgcccatggaccccgatctgcatgcgcagtttccgatgatcaaggagctgctcaccgcgctcaacgtgccgattctgcagtccgagggctgggaaggcgacgatatcctgggaaccatggcgcgcctgggtgaagaggccggctgcgacatgctgctggtgaccggcgaccgcgacatgtatcaactcgtgaccgagcacgtcaacgtggtctcgacccgcaagggcctgtccgacgtggcgatcatgacgcccgagagcgtggacgacctgtatcacggcattacgccggcgctcgtgcccgatttttacggtctaaagggcgatacgtcggacaacattcccggcgtaccgggcatcggccccaaaaaggcgagcgcgctcatcgcacagtacggcagcttggacgaggtcatcgcgcatgccgacgaggtcaagggcaagatgggcgagaacctgcgtgcgcacatcgacgatgcgctgctgagccgcaaggtcgcaaccattcgcaccgatgcgcccgtcgagctcgactttgacgaaacgtccttcccggcgttttctgccgacgaagtgtccgcggcgctgggcacacttggtatcaccgccatgcagaaccgtttcttggcgctggtcggcggcgagggcggggctactgctgcctccagtgtggttgagatacctgctatgcttcgcgcagccgccggcgatgccgacgcgcttggtgccgttgcggctgaggtctcccgcgcgattgatgccggcgagtgggtcgccgccgtggtggacgacgacaaggaagagggcgcgctctttggactgacgcgcacgctgtggttggcgacgtccaagggcctgttcgcgctcgaggagggcgacagctgtgcggcggctgaggttgagggcttcaacttcgttcacggcgtgattgccggcgtgctcgcgcgtctgtttatggagggtcgcgtggcgagcccggatatgaaggcgctgttgcacgagctttcgcccgtcgattcttctgagcccgagctcatggatccgctcgctaccgattccacgcgtatcttcgataccgtggtcgctgcctatctgctggattccgatcgctccgagttcgatgaggcatatcttgccgatacgtatctgcagatggcgctgcctgcggcgcgcggcgcagagggtgccggtgaggacgctccggcgcctgccgcccgtactgcggctctgacgctggcgctcgtggcaccgttgcgcgagtgcatggcccgtgagaatgccgccaacgtgttcgatggcatcgagatgccgctcgttccggtacttgccaagatggagcgcgcgggcatgctcgtggaccccgaccgtctgcacagtctgtccgagggtctggcgacccagattaccgaggttgagcgcagtattcgcgacctggcgggtgacgagacctttaatattggcagccccatgcagctgtcgcacgtgctctttgatgtgatggggcttccgaccaagggcctcaagaagactaagcgcggctattattcgaccaacgccaaggtgctgagcgaccttgcgcgtgaccacgaaatcgtgcgtctgatcttggactggcgtgagaagtctaagatcaagtccacctatctggacacgctgggcccgctacgccgtggtgacggtcgcgtacacactacgtacaaccagaccatcacggcaacggggcgtctgtcctcgagcgacccgaacctgcagaacatcccgacgcgctcggagctgggtcgtaccgtcaagacggcgttttcggcaggcgagggaagcgtctttttggcggtggactactcgcagatcgagctgcgtctgctggcgcatctctcaggtgacgagcacttggtgcgcgcctttaacgagggcgaggacttccatgccgagacggcggcgcgcgtgttcggtgtgccggtgtccgaggtaacgcccgacctgcgcagtcgcgccaaggccgtgaactttggcatcgtgtatggccagcaggcctacggcctgtcgcagtcgctgcatatctcgatggccgaggcacgcgacatgatcgaccgctactacgaggcctacccgggcgtgcgcacgttcctcgacaacgtggtggcacgcgccaagcagacgggctacgccgagaccatgtacggccgccgtcgtcatattccggagctcaaggccaaaaacccgcaactccgcggctttggcgagcgcacggccatgaaccatcccatgcagggaaccgccgccgacatcatcaagatcgcgatggcccgcgtaagccgccgcctggaagaggaaggctttgccgcccacatgatcctgcaagtgcacgacgaactggactttgagtgccccatcgacgaagtcgagcgcctaaccaccatggtccgcgacgtcatggagcacgtagtagacctccgcgtccccctaatcgccgaagccagcaccggcataacctgggccgacgcgaaatagaaaaacagccacaggtccaaagcagccaaaccagaagggagtccctttcagcaaggaactcccttcatccataattattcagccaagtatctagacgccaagacgccatctaggcggcaagcaagtcaccctaggacctggccgggcgaggcgggtaagtttttcgtagattccgcacgagccggaaagcacttaatgtgctttccgagcgagcccaggacctgaccgaacgaaaaacttacccgtctcgcccggccaggtccgacgagccacgttaacgagccgccaagatggcgtcgatgagcgtcagtacgcccccgtcgttgttgctcggaatgcgccatttggcatgcgcgttcatgtgctcctcggcattgtccacgataaagctgtgaccgacgcgctccagcatggggatgtcgttgtaggtgtcgcccacggcggcagcatcggcaatatcgatgcccaggtgctcgcacaggtgagcgacgccggcgcccttgtcgacgcccaggttcataaagtcgatccactcgcgcccagcgttggtgacgtagagtttgtccgagaactcggggctataggtctcgcggaaagcgggctcggcgtcgtagccggggaagaagaccgaaatcttgttggactcgaaatcaatgccctcaaagctgtctacgtagttgattgtgttgtagtagacgctgatctcgtcgtggtattgatggtcgcgggcaagcacgtagaactcgtcgaagcagcacaggacggggacagcgcgaggatcctccgaggcacggttcaagacctgctgatacagctccacgtcaatattgcttttatagatatagctgccgcgatagatcacgcacgctccgttgtcgggacaaaaggcgaggcggttcttgatgccctcgaacatctcctcgagcttgggggcgggacgtccgctggcggggcagaatacgatgccggcgtcggcgagcttgtccaggcgctcatcaagaccctggggcagcacacgctcgtcggtcagcagcgtcttgtccatatcgacggcgagaatcttaatgttgccgatgttggcgtccgattcgtaagtttgcataaaaatgcgcctttcgtttcgagattgtttcagacgttataaccatcaactagtagtcgagcgtattttcgcaggaatggtgcgtatttgcaccacgcttcacaaagtaatgaaaaaaacttttcagaaatttgaatttgtcgcttgtgctgcgggcactttagcgtaatatagcgaccatcgaaaacggagacggaaaaacaaccgcttaccgagtaaaaggtaccgtttacgatatttgaattgcgcccggcgatacgtgaaaggagaggcagatgcagttcgtaaagatcatcaccactgcagacaatgccatccgacgccagcgcgcaatttcccgacgacgataacaatcgtctctgtccgcatggggcgaattgcctcaacagagtcattttgaggtcgttgggttttagcacgacattgctgcatgtttctagggcatgtatgtgctgatttttgctatttaacctgatattgcacggtatatgaccttgaaatgacttgcaactgaccgatgttctaactagctaccaagggcgaaaggaaacagccatgagcaaggaaaaagtcgttctcgcatattccggtggtcttgatacatccgtatgtgtcaagtggctccaggacgagaagaatctcgatgtcgtttgcgtctgcggcaacgtgggccaggaagagaccggactggatgccaagaagcagaaggcgctcgacctgggcgttctcgattgccaggtgctcgacctgcgcgacgagttctccgatgagttcctgaccaaagccatcgccgcaaactccatgtacgagaataagtatccgctgctctccgccctgtctcgcccgctgcttgccaagaagcttgttgaggtcgcccacgagtttggcgcgacctacgtcgcccacggctgcactggcaaaggtaacgatcaggtccgttttgaggccgccgtcaaggccctcgaccccgagctcaaggttatcgccccggttcgcgagtgggacctgaagtgccgtcccgacgaggtcgcctatgcccacgcccacaacgtgccggttcccgagggtgccaacgacaacccctactccatcgacgacaacctgtggggtcgcgccatcgagtgcggtcacctggaggacccttggaatgagccgctcgatgacgcttgggttatgaccaagaaccccgaggacacgcctgacaccccgacctataccgagatcgagtttgaggccggcaagcctgtcgccgtcgacggcaagaagatgaagctctccgagatcgtcatcgccctcaacaagatttcgggcgacaacggctttggccgtcttgacctggtcgaggatcgtctggtgggcctcaagagccgcgagtgctatgaggttcccggcgccctgacgctcatcaccgcccacaaggcgctcgaggacatctgcgtcgagggcgacctgctcaagaccaagatcaagctcgagcaggattgggccaccgccgtgtacaacggccagtggtacagcccgctcaagaacgcgctcgacgcctttatggccgatacccagaagttcgtgaccggcactgtccgtctgaagttctttaagggcaactgccatgtcgtcggccgcaagagtcccttcagcctctacgactacggcctggctacctacgaccgcgacaccacgtttgacgagaaggccagcgccggctttatcgagatcgatacgctgtcgctcaagacgtgggcaaaggtccagggccccagctctgctgctgcccaggcctagcgcctccttcccttggtatccgcgcggcccatccgcgtgatacataacgggcgcacggggtccctacctttcgttatgcttgctgacacttcttaacatcggtggcccctacgttccgcccgcatatatgatgccgcgtctgcggctgagtccgagccccgccggggttgtccggcggggctccttctatcaatttggcggctctgtgcctatatatatgaggagtatccattatgttcaatgctatcgcgcatgctttgcttgccctcgcgcccgagttcgatgctgtaagggtcgaggacgttcctatgagcctgaaggcctggatcgatggttcgcagggcaacatccggagggagacgttgggcgccaagtgcatggtgcgtcacttctttgcaaattagccacatggccccgcgcgcggcagggagtgtgtaaaactagcggttgataaatcgctttagcgacagggcacattgctttggacgcttgttttggtatttggagaaaggagacggttccatggctctttggggcggtcgttttgaggcgggcgtggccgaggtcacgcaggagtttggcgcgtcgctgccggtcgacaaacatctctataagcaggatatcgccggctctaaggcgcatgccaagatgttggccgcccagggcatcatcagtgccgaggacgagcaggcgattgccaagggcctgaccggaatcgaacaggatatcgatgccggcaactttaccttcgacatcaacgatgaggacattcatatgtccatcgagagcgagctgacgcgtcgcatcggcgaggctggcaagcgcttgcatactgggcgttcgcgcaacgaccaggtggcgaccgatacgcgcctgggcgtcaaggcgctggccaaggagctcatggaggccaatcttgagctgcgccatgtgctggtggatgcggccaagaagtacgacaaggtgattctgccgggctacacgcacatgcaacatgctcagcccgtgctgctgtcgcatcacctgctggcgtattcctggatgttcgcgcgcgactttacgcgtttgaaggccgcctttgatgctgccgacaactgcccgctgggtgccgctgcgcttgccggtacgagctatccgctcgatcgccagatgacggctgccgaacttggctttgcgggcgtgatccccaactcgctcgatgccgtttccgaccgtgattttctgctcgatctgcattacgccggatccgtcatggcgatgcacctggcgcgtctttccgaggagatcgtactgtggtcgagctccgaatttggctttatcacgctttccgactcgtactccactggctcgtccatcatgccgcagaagaagaaccccgactttgccgagcttatccgcggcaagagcggtcgcgtgtacggcaacctggtgcagctgctggtaaccatgaagggcctgccgcttgcttataacaaggacttgcaggaggacaaggagggcgcgctcgataccgcccatacgctcatgcagtgcctgtccgttatggccggaatgatttcgacttggaccgtcaacgaggatgccatggcgcgcgagtgcggcgtggggcaccttgccgccaccgatgttgccgattacctggccaagcgtggcctgccgttccgcgaggcacatgccgtggtgggccatctggtccagcttagaagatcggaagagcgtcgtgnnnnnnnnnnctgatgtgcgagaagcgcggctgcaatcttgaggacctgccgtttgaggtgttccaggaggcaagcccgctctttgagcgcgacattaccgaggcgctcgatatcccgtcgattgtcaccgcgcgcacgaccgagggcggcaccgctcctgccgccgttgccgtgcagttgcagcgtgccgaggcacagctcgtggctgacgagggcgtgtttggatcgctgaccaaggtcgtcgagatgggtcacggggcaaagtagaggtttggctgaagccgttttggccatgtattgataaatcgttttcgctttacgggcgcctgctgatgtgggagcccgtattttgttgctatgggggaggggcttgtcgagaacttctgtaggacctttgggcaggttgtgaaggggatacgttcgcgggcggcaaccgaccgcctgctctgttcggcgcagttgatgggcggtcggatggtactctaatcgggcttcgaaacagaagtgacacatatggagcgctttaataaattgcaacgtttcaataaacagctttttgtttaactgcagctaaaactctgttacgatgcagtccaggcgggtgccggaatgggacttgggcacgcgcgaacctacttgaaaggctacttttatggctatcgagaagaccttcatcatgattaagcccgacgccgtgcgcgaccgcaagatcggcgagatcgttgctcgcattgagcgcagcggccttgtcatcgagcgcatggagatgaccacgctcgagcgcgctaccgtcgaggagcactacgcccatctggccgacaagcccttctttggcggtctctgcgactttatgacgagcggtccggtcgtcaagatggtcgtttccggtctctccgctgttgctaagatgcgcaccctcatgggcgctaccaacccgcttgaggctgctcctggtaccatccgcggcgactttgccgtcgatgtcaacgccaacgtgatccacggctccgactgcctggagaacgccgagattgagatcaagcgcttctttggctaaaccagctttgactccttaaagctgttagcgtgtggcttgggcgccgcggaactccatccgcggcgcccttttattccaaaatctatgcaggggcccgctcggacatgtgttccgagcgggcccctgctgttagcttgtggcactgaatagtttaggcttcgtcgacgatcttaagggcgcgcgtgtgatcgatctcgttgaggaggttaacgcgacgctcgtgacgaccgccctcaaactcggcgtcgagccactcgtcgacgatcatcttggcgagctcggagcccacgacgcgggcgccaaaagcgagcacgttggtattgttgtgcatgcgggagagcttggcgctgaagggctcggagcacacgacggcgcgtacgccctcgaccttgttggcagccaggctgataccgacgccggtgccacagatcaggatgcctagatcgacgtcgccgttggcaacggccttacccaccttgtagccggcgatggggtagtcaaagctctcggaggtgtcggtgccaaagttcacgacctcgcagccgcgctccttcaggtgctcggagatgatgttcttgagctcgacggcggcgtggtcgttaccgataccgatcttcatggatagttcctctctggtctgtgcggcgagattgctaaaggttttaccgcgttcgactgcatgatagcgcgacttttgtgtaaacgcttgggcgttttttggtcaaacgctttagcatgcaacaagaccggtttctcatgaatgaatgccgtcagtttgcgcctgaatgccgtctaccggaacctgggttgcggtttttgatgcattgttatcaaataaaagagctaattattattgagagcccagcccgttatacaagtaggagatacctatgcctgccgattcccttcgtgatgccgcgttttgcgatgttttgaaccgcgaacttgtttgtgcactcggctgcaccgagcccattgccgttgcttatgcagcggcgctggcgagccagacgctcggttgcgaacccgatcatatggatgttgcctgctcgggcaacatcatcaagaacgtcaagagcgtgaccgtgcccaactcgggcggtatgcacggtattgaggccgcggccgtgctgggtgccgtgggcggcgacgccaagagcgcgctcgaggtgctcgagagcgtcgatgacgcggaccgcgcccgcgtggccgagctgcttgccgatgcggactactgcgatgtgtcgcttgtcgagggtgtgcccaacctctacatcaaggtgactgcgacggccgggggccataccgcggtcgtcgagattaccgatcaccacactaatgtcacgtgccatacgctcgacggtattccggtatgcggtaagtcggcgggggagtgcgccgcctgcgccgagcgcgtggtggccgagcgtgcggcagataacgccgacacgcccatgtcgatcgagaccatcatcgactttatcgaggatggtgacattgaggacgcccgcgctgccgttgagcgtcagattgagctgaatggcgcgatcagtgccgagggtctcgcgcacgcttggggcgccgaggtgggccgtacgctgctgggtgctcgtgccgatgacgtcgcctgccgcgcccgtgcccgtgcggccgccgggtccgacgcccgcatgaacggttgcgcgctgccggtcgccattgtgtgcggctcgggcaatcagggcattacctgcgcattgcccgtcatggagtatgccgagtacctgcgttgcgaccacgagcgcctggtgcgcgccgtgatgctgtccgatcttatcgccgtgcatatcaagagctatattggtgcgctttcggcgttttgcggtgctatttgcgctgcgtgcggcgccggcgctgcgattacctggctgtgcggtggcacgcgcgaacagattggcgcgaccgtctcgaacacgctcggtaacgtgggcggcatcgtgtgcgacggcgccaaggcgagctgtgccgccaagatctcggctgccgtcttctgcttgaaaaaaaaacatgatatggccatgcagggtcgcggcttccgcgccggcgagggcctgatccaagataccgttgagcaaacaatcgccagtatgggctacgtaggccgcgtgggcatgaaggacaccgacatcgagatcctcaacatcatgatcggcaaaacccaggtgtgctagttacgcggttttaccaaaccgcgtaaccagtcgacgctgcaaatgcccctaagcggcaatctgcctttcaatcgtcgggcatggccagaaggcctatgccctcctctttcaaggcacattgctcgcttaggggcattttcgctgacttgtgctcaacctgcggcgatatttggtttggagcgaggggtcctacgacagttcgtcggctacttggtgttcgtagaaggcttcgattacggcgttaaagtcgcgggcgaagtcttccatggttccgcgccaggtggctcggccgggttttccctggccaacataggcagtttgaatgccgcaggcgggactggggaagtcgcgcttgggatcgttgcccaccataaggacctcgtgtggctcgagccccatcacctgaagctgctctagatagtaggtggcatcgggcttgcagcgggtggcgtttcccatgtgcgtcacgagttcaaagggggcgtcggccaggtcgccccaacccatgcggcactcgatggccccctggggaaagctggggttggtaaagagcgcgcagcgcagccctgcgtcctgtacggcctggagcgcggcgtgtgcgcccggcatggcgtgggcgttaatgatatcgtcgttcttgtacggaagaacttcgcggtcatagtaggtaaacgcctcgtagatgaggggatcggagaggcagatcccgcatcggcgctcgacctcttcttggtaaaactcaagattggtgcggttgtccgtgccgctgcggcgattggcgttgaggtcgaccaggatggtgccgaggcgcgccatcgtgccaccgcggctgcggcgcccgatatccgcgagcatcgaagagacatccttaaaatagcgaaggatgaacgcgttgaggttgatgctgagaagcgtttcgtccatatcgaaaacgactgctttgagcacgcgggcacctttctcgaaaaatcgatctagaatcgttggctccggatactttaccccaaagccgaatgcctggctggttatcgtcaagttgcggagacgtgtgttcataagattacgaaaaagtctccacacgagtaaaaaatcgcagttcacgcttgaaatcgaactcatttccccgtaacctatacgaacgtgattgcataagcgtcacattagtatctgtcggctcccgagtgttcctaaacgttgtgtgcttgtcgcacccttctgtaggtcctagcaatcggggccccgtagttcgaaaggggtccacctttgagtgagattcagaactcgtccattttctctcttgacgatgtcaacgaggaggagatgaacaacctcatcgacggtacgattaccgactttgatgagggcgatctcgttaacggcactgtcgttaagatcgagcatgacgaggtgctcgttgacatcggattcaagtccgagggcgttatcccggtccgcgagctgtccatccgcaaggacgctaaccctgcagacatcgttgcactcggtgatcccatcgaggctctggtactccagaaggaggacaaggacggtcgtctggtcctgtccaagaagcgtgccgagtacgagcgtgcttggaaccgcatcgaggagaagttcaactccggcgagaacgtcgagggcgaggttatcgaggttgtcaagggcggcctgatcctcgacatcggcctgcgtggcttcctgcccgcctccctcgtcgacctccgtcgcgtcaaggacctcacctcctacatgggcacccgcatcgaggcccgcgtcatcgagatggaccgcaaccgcaacaacgtcgtcctctcccgtcgcgtcgtgctcgaggagtcccgtaaggccgagcgctccgagatcctgtccaagctcaagtctggcatgcgtctccagggcaccgtttcctccatcgtcgacttcggcgccttcgtcgacctcggtggtatcgacggcctcatccacatttccgagctctcctggaaccacgtcaaccatccttccgaggttgtcaaggtcggccaggaggtcgaggtcgaggttctcgacgtcgatctcaaccgcgagcgcatctccctgggtctcaagcagaccaccgaggatccgtggcgcgcactggtcaagaagtaccccgtcggcgctatcgtcgagggcactgtgaccaagcttgtcccgtttggcgctttcgtcgacctgggcgagggcatcgagggcctggtgcacatctccgagatggccaacaagcacgtcgaccagccttctcaggtcacccacgtgggcgacaaggttcaggtcaaggtcatggagatcgacctcgaccgtcgtcgtatctctctgtccatgaagtccgctgctgagactctgggcgtcgagatcgaggttaccccgcttccttccgagaagaaggacgaggagaccgacgccgagtaaatcggtttgacgatcacttgttttaagggatccgttcgcaatggacgggtccctttttgctttcgctgctgatgcacgcgatgctacccgggctgtccacaggctattgggttgtcggtgaataaaaaaatgccgacatcccgcctcggggaggaggcgggaacgcaccgagtagacggaggggtgcggagcgcggtcgcgtctcgactgacgacattgcccatcgacaaccctattgtactgcatggcgtggttcttggtttatcgtgtcgaacgcttgtgttgtgccattgcctgcggcaacggtgtgctacactcttgcactgctgagtgggccagacggtcgcgcgatgtgctgtttgcagtacgcgtgaggaaagtccgggctccagagggcgggatgccggctaacggccgggcggagtgatccgacggaaagcgccgcagaaaagaagactcccacctgcgccgcaaggcgtaaagggaaaagctgaaacggtggtgtaagagaccaccagcgtcgtggcaacacggcggcttggcaagccccatccggagcaagcgcgaataggaacgctatgggccggcccggtccgcgttcgggtagcgtgcgtggagctgcacggtaacgtgcagacaagataaatgaccgttcacgacagaacccggcttataggcccgctcagcactttgctgacgctgcgaacccgtcagcgcggcaatctgcctttcaagccttcgggcatgaccataaggtcaatgccctcgtctttcaaggcaccttgctcgcgctgacgggttctcgctttcgttgacggaatcataggtggcttcgttctttttaccgaggttatcggtacggtctttgccgtattattgaggctgtttgttgctttgcttgttgttgaggggctttgttggacagctattttactctgcaatcgaatattgaggcttcgggcgagtttgtggaccgcaagagccggtttattgcccagctggtccatattgagtccgaggatgaggcgaatgcctttatcgagatggttcgcaagcgtcattacgacgctcgacacaatgttcccgcgtggattttggtcgatgggcgcgagcgccagagcgatgatggtgagccgagccgcacgagcggcatgccgacgctcgaggtgctgcgcggtgcggggctcaaaaaagtttgctgcgtggtgacgcgctattttggtggcacgctgttggggcctggtggcttggtacgcgcctataccgcggcgacgcaggcggcggtggccgcggctcaggaggcagggcagatcgttgagatgacaagcgtcgtgcctgttgacgtgcatgtggcctatccgcagtatgagcaggcgcttcgtttggcgcaggattcgggtgccaaggtttcggataccgattacgcggatgccgtgacgattcatttggtgtttaaggcgggggagcaggagtcattttgcgctaagattcgcgagcttatggcggggcgcgaggagattgaggtcggcgctcccgaatttgccgagttctaacggcgacggccggcgtgcttttggatggatcccaagcgcacgccggcctttgtttttccgttgctgccgtttactcggcgagctgctttagcacatcgcaggcgatcgcgacggcatcgtcgatgcagccggggcagctgcggagcggacccttgtccgatccgatgcccttgagcgtgccgcagacggtcgtcgtattcttctcgccaaaacgcttggcgatttcgcgcgacagcttgtaggtctggcccttggtcttggggttttccatgccgtcgctcattacaaagcccatgatggctacggcgcccgagatagcgccgcaggtttcggtcataccgcccatgccggcgccaaagccctcggtgagggtaaaggcgacctgggggtcgagcccgacggcgggagcgagcgtgcaggcgacggcctgagcgcagttaaacccacgggcgtggtattcggcagcctgagcctgacaggcggtgatgtcgagctgggccgtatcgatttgcttcatcgttgtctccttggtcacggtgtacccgcctatggtacccgtgacggtgcatgtaatcatcgagagcttcatgtatgcctcatttttatctatcgagcaaatgtccaaggcttgagataaatgaccctgatcaattagtcccataacctaccttggggatgggttgagaggggtgcggggtagcggtatcgtgaaccgaattaaactaaaacccaggcaagggagctagatatgagcaagcagaccatcggtacgacgtgtgttcagggcggctatcgcccgggcgatgcagagccgcgtcaggtgcccatctaccagtccaccacgtggaagtacgacacgtccgaacacatgggcaagttgtttgacctggaggagtcgggctacttctacagccgtctgcagaaccccacgtgcgatttggttgccgccaagatctgcgagatggagggcggctccgctgcgatgctcacgagctcgggcatggccgcgaatttccttgcgatctttaacgtggccggtgccggcgatcacgtagtcgcgagctctgccatctatggcggcacgtacaacttgctcgcccacaccatgggccgtatggggctgacctgcacgttcgttgctcccgactgcaccgatgaggagctcgaggcagccttccggcccaacaccaagctcgtctttggcgagacgatcgccaaccccgcccttgccgtgctcgatattgagcgctttgccaaggccgcgcatgaccacggcgtgccgctgatggtcgacaacaccttcccgacgcccgtgatgtgccgtccctttgagtggggcgccgacatcgttacgcactccaccaccaagtacatggatggacatgctgcctacctgggcggcgtaatcgtcgaccacggccagtttgactggatggcccatgcggataagttcccgggtctcaccacgcccgacgagagctaccacggcgtgacgtatgccaagaagttcggtcgcgagggcgccttcattaccaaggccaccgcgcagctcatgcgcgacctcggccccatgcagaacccgcaggcggccttcttcctgaacagctcgctcgagagcctgcatgtgcgcatgccgcgtcattgtgagaacggcctggccgttgccaagttcctgcagagtcatcccaaggtacgcttcgtgagctatccgggcctagagggcgataagtactatgacatcgctcagaagtacatgcccaacggtacctgcggcgttgtgagctttggctttaacggtggtcgcgcggcggctgagacctttatgaagagccttaagctcgcccagatcgccacgcatgtggccgacgcccgcacttgctgcctgcatcccgctaatgccacgcaccgccagatgaacgatgaggagctcatcgcctgtggcatctccgccgatatggtacgcctgtcgtgcggcctcgaggacacggccgacttgattgccgaccttgagcaggcactcgagcagtgctaggctagcgttcgcataaggcgccgatgctggcagaaagcttcggcgacctttcgtttcgattccgtaggcgggaccccaatcgcggctgtttgctggcgattggggccccgtttttgccttgcgccactcgaaaggatggatatggagaaaaccgcagagcagctgcgccgcgagcacattgcccttgagggcgacacccatggcaagaacaaatgggcgattctgtttaccgtgctcatcatgacgtttatgtcgtgtctggattcgaccgtcgtgaccgtggcgttgcccgtgatgcaaaaggagctgggcgtgggcctcgatcgcattcagctggtaagttcggtgtatctgcttgcgacttgcgtggctatgttgccgtttggccgtctgggcgacgtgcgcggcaaggtgaatgtgttccagttgggcgtcatcgtcttttcggtcggttcgctgctgtgcggcctttcggcctcgcttgaggttcttatcctggcacgcattgttcagggcatcggttgcgcggcggccatggctaacaacatgggtatcatcaccgagtcgtttccggcgcgcgaacgaggccgtgccatgggtattctcgcgacctttgtggccctcggcatgatgtgtggccccgtgctcggcggcatgctggtggcaagctttccctgggagagcatcttcctcatcaacctgcccattggcgtgatctcgtttatcgtgggactctacacgctgccgcatgttaggccagaggccggcgaacgtcccatgccccttgccgaggccgctcgtcgctgctttgcaaattcggccttcaccatcaaccttgcctgcatgctcatcgtgttcgttggcattggcgcatccgagtttattctgccgttctattttcaggacgcccaaggctttggttctgacatttccggattgctctttttggcgctgccaatggtgaatgcctttatcggcccgctttcgggaacggtttcggaccgtgttggctgcgagggtcccacggcggtcggcctgggcgtgtatgtgtgcggtctctttgcagtaagcacgctcgacgagcactcttctatccctgtgatcgtgtgctgcgtcgcatttatgtcgtgcggtacgtcgattttccagagccccaacaactcgctgtacatgggctcggctccgcgcgaggcacttggctttgcgggtagtctgggtagcctggcgcgttatgcgggtatggcaatcggcattacggtggcgtcgaatatcctgtatggacagatgagcgtggcgatgggcgaggccgtgaccagttttgttgcaggacgtccggatgtgttcctgtttggtttccgttcggtgttctatgtgttgatggctgtggccgctgtgggctttgcgcttgccatggtgcgtttggtgaagatgcgcgcccgccattagcgtgttgggaggctgtctgccacgatttgcattgtcccaaaaagactggtttgtggtgcgatgcggcttgtgggacgggcgggggtcggtccgtggtagactatcgaacaacgtttattaatcgcgcggtatcgttgccgcgagaaggggttgcgccatgcaggagcttgaggatcgtattcgccatgacggcatcgtaaaggccggtaacgtccttaaggttgatgccttcctcaaccaccagtgcgacgttgagttatttgaccacatgggtgccgagtgggcccgtctgttcgagggtgtcgagatcaacaagattctgacgattgaggcttcgggcattggcatggcttgcattgcagcccagcattttggcggcgtgccggtggtctttgccaagaaggcacagtccatcaacctagacggcgagcagtatgccacgaccatctactcctttaccaagcagaaggagtacccggtcatcgttggcaagcgcttcctgtctgagggcgacaaggtcctgatcatcgacgacttcttggccaatggctgcgcgctcgagggccttatcaagatctgcgaggctgcgggtgccgaggtgtccggtattggcattgcagtggagaagggcttccagggcggcggcgataagctccgcgagcgcggcttccgcgtcgagagcctggcccgtattgccgatatggactgcgagaccggcgagatcaccttcgcctaagcgcgcaacacaagcgattggtatgcgatgtgacaaagggctttccctttgtcacattttttgtatgaggggaggtgttgatatggacgagaacaagatgggatggcgcgagtatgcgcgctatgccgagatgtcggccgaggagttggcgcgcgattgcgaggtgcaggtgtttcgcgcgactggtccgggcggacaaggcgtcaacacgacggattcggcggtgcgcatgaaacatatcccttcgggaattaccgtgacggcgcgcgagagccgcagccagttccagaaccgtatctgctgtctgcgtaagctgcgtgcagagcttgagcgtcgtggccgtccgccgcgccgacgcgtaaagaccaaggtgcctcagcgctctcgccagcgcaggctcaatgacaagcacttcaacgccattaaaaaggccaaccgtcgcaagccgggcggggaggaatgatcttatcaataagttgcggtgaaatagggactgttttgcggctttagctacataaacagtccctatttcaccgcaacttaggtggggttagcgggtggggtgccagacgtggagggcgccggcgaggatgtcgacctcgatgcgcgaggcgacaacgggctcgccgtcggcctgaatggggtagtcgggctcctcaaaggtgagctcggcatggcggcagcggcgcatgcgaaccggcggcaacttggtatggtggccgtccttggccgaaagaaacataggcagggcaaccgcgcgagggacggggccgcaggcgtagcagacgtcgagtatgccgtcacaggggtcggcgtcgggacagatgcgatagcccgagccataggtaggacccagctgaatcgccatgatgatcgcccttacgcgctcggcgggcgccccgtcaaagctgactgtcatggggtaattgcgatagcgtaggccaaactgctcaagtcccgaaagagtgtagagcggcgcgccggtgaggctcgtctttttgcgtagctcggtggtgccaaggccgatggcggcatcgatgccgaccgaaagcgtctggtcgtagtactcaacggtagcctcgccgctgccgcttgtggggttccataagcgaatgcgcccgatgtcctgacgctgcagctcgcaggtgagcagcgcgccaaaatccttaccggagaaatcgtcgatgccgagcgtttgggcaaaatcgttgccggagcccacgggtaggatggcaagagcggggcgggtgtcctcctcttgcgtcataagcccgttgacgacctcgtgaatcacgccgtcgccgccaagggcgataacggtgcgatagccctgagcctgtgcggccagctccttggcgtgtcccatgcgctcggtcagcatcaggtcaaactgggatgcgcgcgcggtcatatccaaaaagcgttgcaggcgctcggcaacttcgcgcgccgcacccgactgggcggctgggttggcgatgatgagcgtgaggccaaaatcagttgcgtgcatggggcgactcccggcgtatgacgtgacggtgcggtcgcgctcaggtcgaattgcccccgattgtggctgcacgtcgaatacttacgtctactctatcaggtcgttgtggcgctcgatagcatccgctaccgtaccgccctcatccacaataagcgaacggcgcttgggcgagatgatgcgctgggcggggtacacgccgcggtgtccggcggttaggtagctgataaaggccacgatgacaaagaacccggctgccgtgccgtggaacaggtcgatggccatcatacaggtggtgataggcacgttaaggccggcgcagaacacgccgagcatgcccagcgctgctagaaagctgggatcgattccgacgaggcaaccgatccagccgccgagcgccgcaccgataccaaacaggggcgtgacctcgccgccttggaagccggcgcccagggtgagcgctgtgacgaccaacttgatgactgcgtccgccagggtggtgttgccggcaaatccggcgccggaaagccacgtggaaaggccggcgtagtcccaggcgtcgaggagggcataggcggccaaaaccacgagtgcacctatgagtgcgcgaataagataattggtgataaagcgaccgtacaggctcttgacggttcgaactgaccaggcaaagaggcgtgccgtcagaccgaagataatggcgctgataacaacgatgacgaccgttgtgggcgtcatagcgggaacgctggcgatgacattcgcttcgtactcggtacccagggcaagtgatgtaaagtagccggtaaacgaggcgaccaggcagtagacgcccgcggtgtagtcgatcttgccgataaagcacatctccatgccaaagaaggctccggcgaggggtgaaccgaatacggcgccaaaggccgacgagatgccggcgagcatgaggtcgtggtggtcatgctttttgaggtgggcgaggctcgagatgttgctggcgatggtgccgccaatctgcaccgcggcgccctcgcggccggccgatccgcctgttaggtgcgtgagtgtggagcagacgaaggtgaggacggccatgcgcatatggataaggcgtgtgcccagggcggagtcgatgaccaggttgttacctcgtttggcggcaaggccgtggtttttgtacacccatgcggtggcaacgcccacaacgggaagcaacgcgtaaatccacacgtggtgctcgcgataatcggtcgcgatattcagcgaggccaaaaacgcccaagcggcaacgcccatggcgagcgagacgatgacgacgagtacgagcaacttagcgctcgcaagtaggttgcgggcgttgcggcgcgtgtcggcagccaagagatgctcggagcgggtaagttgatgcctgcctgccgtgatgacgtcattaagggagaaaaagccgccgtcgtcgagcggctgggaatgatcctgcgctttgtttgcgctttcgggtttgtcgttatgagccatacgttcctcttttaggttgcaacgcaagcattataaaacgcggtaaacgcgacgagccggtgggttggtttccattctgtttcgcggcctgcaaccgacaggtgtatttgcgggtacaggccgagtcgcggtcgtgcgttgggggattatactgagacaagcataaagaattggcgcccctgttgtgcgccgtggcattaagaggtgcatatggcagagaaactcattccactggaggacgcacagtcgattgtcctgtcgcacgttgctccgaccgatctcgtcgagattcccgtgtggcaggcggctggttttcccttggccgaggacgcggtggccgatatcgatatctcgccgtttgccaacagcgctatggacggatatgccgtgcgctcggcggacttggtgcagacatctggcgaggcgccggtgacgctcgacgttatcggacacgaggccgcgggccatgtgtttgagggcgcaatcggtgcgggcgaggcggtccgcatcatgacaggcgcgccggtgcccgagggtgccgatgccgtggtgaagtacgagatcgtcgatgtgctcgacggtgacggcaacgagggctcgcacgttcgcttttcggcgccggccaaggtaggggagaacgttcgctctgctgccgaggaggcccatgccggcgatgttgtgatgcacgccggcgaggtcgtggctccggcgggcgcgggtctgctggcgagcgccggatacgcgagcgtgaaggtgcacgctgccccgcgtgtgggcatcatctcgctgggcacggaactggtcgcaccgagtaaggtaccggcgcgtggtcagattcgcgattccaactcctcggcgctgatggccgaggcactcgatgccggcgccgagcccgtgttctacggcatcgcgcccgatgatgagcaagcgattgccgagctggtacatcgcgccacgcgagagtgcgattttgtcattacgagcggtggcgcctcggcgggcgattacgactatgtgacggcgctcgtccggcgcgagggcgaggtgctgtttgaccgcatctcgatgcgtccgggcaaggccatcacgtttggcttgctcgggggtaagccctacctggggctttcaggcaatccggccgcggcgtatgtgggctttgagatgctcgcccgcccggcgattcgcaagatgcgcggctttgccgagggtacgcgtcccgtgcagcaggcgacgctcacgcacggcgtgaaaaagcgacagcatcgccgcttcttcgatcgcgccacggttttgcgcgaccccgagaccggtgagttgttggtgaccgaggctaagacacagaattcggcgctgcttggaactatgcagcgtgcgaactgcctgttgcgtattgacgaaggaccgtgcgagctcaaggcgggagatgccgtggacgttgttcgcgtcgacctgcctgagggcacggtgctataggaggaatgctatggagttgaagatttcgattgtgacgtgctcggatacgcgcgatcttgcccaggacgaggcgggtgctgcgctcgaggagcttatcgtggcacagggctggacggtcgcctcgcatgtggtcgtgcgtgacgacgtcagcgagatcggtgatgccattgcggaagccgccgatgagtgccacgccaatgtcgtgctcacctgcggcggcacggggctttcgatgcgcgacgtaacacccgaggcgacgcgtgccgtctgtgaccgcgatgtgccgggtattgccgaggcaatccgtgcgtattcgatgaccaagacgcgccgcgctatgctctcgcgcgctatttgcatgcaacgaggtcatacacttgtcgtaaactttcccggttctacgaaggccgcccgcgaaagctgggaggccatagcagaccagctggagcatgcggctcagatgacagcgggcggcggacataccaactaagcggtttacctgcggcggggcgacctgaacggctgctccgcctttgttttccgccgaagcgacgccgaggtgcacggtaattcgaaactatattctctgacgagaataatttctcactttcattattcgcgcagaagtataatctgattgcagattaaagcccgcggtggggtacccgggcacaagatccgaaagggttgaatatgttcgatatggtttcacgccgcggtttcgtctcgctttctgctgccgccggccttggccttgccggttgctcgggcaaaaagacgtccgagcccgctggttccgatgccggctccgccaagtctttctctaagaagaaggctgtcgagctgcaggtctttgccgccaactcgctcgagaaggctctgcccgaggttcaggagctttacaccgaccagaccggcaccacctttgccgacacgcagtttaaggcgtctggcgaccttgtcgagcagatgcgcgccggtgccgccgtcgacgtgctcatcaccgcttccaagggtaccatggacgacgccgaggccgccgagctcgtcgacgccgacacgcgtgaggacatgttcgtcaacgatctcgtgatcattcgcgccgagggctccgacaccaaggtcgaggccatcgccgacgtcgcgaacctggacggtaagatcgccattggcgacgccaagaccgtccccgccggcaagtacgccaaccaggcgctggcttccgtgggcctctacaccggcaccgagggcgacgacggcgagtatgcgcccgagatcgccgaaaaggtggccctggccgacaaagttggtaccgccgccgcctatgtgtccacgggcgactgcgtggccggctttgtctacagctccgatatcttccgctacgacggcatcgaggaggcctttgtgtgtcccgaggattcgcacaagcccatcgtgtatccgggtgccgttgccgagagctctgagcacgccgacgaagccaaggcgttcatcgacttctgtctgtccaacaggaaggctcagaagatttgggctaagtacggctttgagctttccgcgtagtgcggcttggcgcgataattccatcgttttgtgtctcactccgtccttatattcgcttggagcttttcgtgcttaatagattccgcatccttgtcgcctgtgctttgaccttcgcgctttgctgggtgccgggatttgcgtttgctggggacgctgaggacggggcccaggttgctgcgactgctcatgggctttcctatgggatcgagggttttgagcggttggccaaggggaccgctcgtgccatggagggccagcctgagggctaccggtttcccgttgacgaggacgtggaccttgtagtggcgcctgctgccgatcgcgttgtggtgtggatatcgcccaaggcgatcgagaggtatggattggatccgcagaacaacgagtgcgtatcgggtctcaaggccctcgtctgtgagctcgacagcgcaaactgtatgggaggtgcgcagctaggggacgtggatcttccttggtatgtcacggcggaaacaacgtttgatgccggcgggtatacctatggctttgacgagcgcggtgcggatgggggccgctatgtggtgattgcatcagcctcgggtgatgccaaaggcggcgcgcgttggcttgatagcgctcaaatggtagaagcatcgtctgtcgtgttgcgggatgagcaggggcccttgacctctctggcctccttattgggcggcatcgactaccgaccgttttgggtgtccattaaaacgagcggccttgccctgctgatctcctttgcgctgggcctgtttgccgcgtggaagaccatgggcacctcgagtcgcatcaagggcctgctcgactcggtctttaccatccccatggtgttgccgcccacggtctgcggctttctgctccttatgctgtttggccgctcgaccggggtgggccagtggcttatcgcgcacggcgtctcgattgtctttacgtggccggcggcggtgatctctgccgtggtggtatcgtttcccctggtctaccgtacggcgctcggcgcctttgagagcctcgacacgcaaatgctcgatgcggcgcgcacgctgggctggtccgagcgacgcatcttcaccaaactcatgatgccgctcggctggccctcgattgccgccggcacggtgctcgcctttgcccgcgccatgggcgagtttggctgcaccctgttctttgcgggcaactatgccggtattacgcagaccattcccattgcgatttactttgaatggatgggcggcaatacgtcggtggccctcttttgggtcgtggtcgtaatagcgttcagcttcctagtcatcctgttcatcaacatgtacacggcgcattcgcaaaaataccgcgagcgtggcctttcccgtgcggaacgtaagcaggccaaagatctcgccggacagggcgattcactcgacccggcgggcggtgatgccttgcgtatcgatcgcgaggcactggccgagctcatgcgcgatgagcccgctatgcagggaggtcgataggccatgtcactcgttctggacataaaaaagcgctatccggggtttatgctcgatatgcagcttgaggccggcgaggagcgtgtggcgctgcttggtgcctcgggctgcggcaagagctgcacgctgcgctgcattgccggcgtggagacgcccgacgagggcaagatcgtcgtcaacggcgtgaccttttttgactcggcggctggcatcaacctgtcaccccaggagcgaaaatgcgccctgttgtttcaaaactatcagctgtttcccaacatgacggtggccgataacgtatgcgccggtgtaaaggatgctggcgacgccgccgcgcgcaaaaagctcgccgagcgctatttgggcattttcggtctggccgattttgtcgatcgctaccccgcgcgactctcgggcgggcagcagcaacgcgtggcgcttgcccgtatggtggcggcgcatccgggcatttttatgttcgacgagcccatgagcgcgctcgatgcgtatctcaagagcgcgcttgagcaaaacatgctcgacctgttcgatgtatgcaaccgcaccgtgctctacgtgagccacgacatcgacgaagcgtgccgcctgtgccagcgcatctgcgtgatgcacgacgggcatgttgaggagatcggctccgtcgaggacgtggtccgccgtccgcagacgctggcggcgctgcgcctgacgggctgcaagaacacaagccgggcgcgcaagatcgggtctcaggaagttgaagccctggactggggcatgacctttaacgtgggccatgaggttcccgataacgtgacgtacctcggtattcgtgcgagctacttccatgttgacaatcgcgcggagcgcggtcgcaacagctacgatttgcacgtggcccgtgtgagcgattcgcgctttgagcggctggtgctgctggacgtgccgcgtgctgatgcgcccacgcgtctgcagtggaaggtgaataaggtgagtgtacccgtggaagagctgccgcaggcgggtgagactctgcgcatgcattttgatgcaagcaggattcatctcgtttgccgataatgcgggtgcgatgcggtcgaggaggtagtcctcgaccgctttgttttcacttcgccgttcgccgatttctacatgactaaaccttatcagtctgataattaattatcagacagcgagatgctcacatcccaacgttgtcgtacgcgtgtcgacggtgttcgtcttgacgacaaccgttgatatagttaccttcgacgagaaaaggagggcgcgccgatgccgcataagacatattcgcgtcgcgttgccgtgcgcgccctgtatatggctcggagccgcatatgagcaggtatgttcacggctccgggagagacgacgcacaactaaataatcagctgcaaagcaggttccccaaaattccgggtttgagcacggctgggttttcgccacccaccgtgcagcaataccgtagttatccgtatttggttcgagagggggaaccgtcatggctgaagaattcgatttccatccgatgtgggagagcctcggcatgaatcttgccgaccacgacatgctgctgggcgccgtgggccagatgtacggcgatatgttcctgacgcagaacaatcgccccaagtccacgtcctacctggattttgtcgccaccaacatccacagcggccgtattaaggagatgctcgacaagaaggaggccggcgaggccaccaagatcgtcggctcgttctgcgtgtacgtgcccgaggagatcgtgcttgcctgtgacggcattcccgtgggcctgtgctcgggtgccgattgggcaaccgataaggtcgaggagcacctgccgcgcaacacctgcccgcttatcaagagctttgccggctttaagctgggcgaggtctgcccctacattgagtcgagtgacctggtggtaggcgagaacacctgcgacggtaagaagaaagcctacgagttctttgccacgcaaaagaacatgcacgtcatggatattcccaacgtgcacgacgagtcgacgctcgtgacctggaaggccgaggtcaagaagctcgccgccaagatcgaggacgagtgcggcgtcacgattacgcctgagcgcctgaaggctgccatccacgccgtcaacgagaagcgtcgcgccctgcagcgtctggctgccacgcgcgctgccgatccggcgcccatcagcggtctcgacagcctgctgaccgttcaggccgcctttatggacgatacgccgcgtctgaccggagccatcaacgagatggccgccgagtgcgagcagcgcgttgaggccggcgagggcgtggcgcccaaggggaccaagcgcatcctgtacaccggcacgcccatggccgtgcccaactggaagctgttcaacctcatcgagaaggccggcggcgttgtggtaggcgaggagtcctgcacgggctcgcgctactacaaggacctggtcgacgagtccggtgagacggtcgaagagatgctcgacgccatcgccgagcgctactttaagattaactgcgccgtctttacgcccaacgatcagcgtatgaaggacattgtccagatggccaaggacttgcatgccgacggcatcgtcgacgtggccctgcagttctgcacgctctacgagatggagtcgtttgccgtggagaaggctgccgaggaggccggcattccgtttatgcacatcacgaccgactacgccggcgaggatgcaggccaactgcaaaccaggattgaggctttcttggaaaccatttaggactattcgtcccggcggcttccccaggcacccgatcttgccgttcaaaccgtcgcttgcgtaccaaagtacgcggcgctcctttttcacggcaacctcgggcacctgggaaagccgtttccttggttggttaaaaggtttgttaaggagttatatgtcggaaaatatggagcagccgttgccatccacgtttgaggagttcaacgagcagcgcaaggcggcgtttattcgcgttaaggattacaagcaggcgggcaatcgcctggtcggctttttgtgcagctatacgccgctcgagatcatcgatgccgcgggcgctgcaagtgtggccttgtgcggtacatccgacgaggtgattcccgaggccgagaaggtgctgccggcaaatctgtgtccgctcatcaagtcgacctacggttttgcctactcgcaaaagtgcccgtttacgtactttagcgacatgatcatcggcgagaccacctgcgacggcaagaagaagatgtacgagctactcaacgagctcaagcgcacgcacattctgcatcttccgcagggtcgtgatcgcgcctacgagcgtgaaggctggtacgaggagtgccgcctgctcaaggaggagctcgagggcttctacggcatcacgattaccgacgatgacctgcgtgctgccgtccgtcgtcgcaaccgcttgcgtgcggcccagctcgagatgtttgcgctgcaggccaatcagccggcggccatgagcggcgtcgacttgatgagcactatgtttgccggtacgttcagctttgatattgaggcctatacgcagcagctggagcaaaaggtcgccatgctgcgcgaggcctacgacgcgggcgagcgcccggttgcggcggacgccaagcgcattctgatcaccggttgcccggtgggcggtgtgatcaacaagattggccgcaccatcgagtccaacggcggcgtggtcgtgtgcatggacgactgctcgggcgagcgcacggcggctatgatgatcgacccggacgcgcccgacattctgcgcgccatcgccgaccgctacctggatatcaactgctcggtcatgacgcctaacgacggccgcatggagaacacgctgaccatgtgcgagaagtaccatgtcgatggcgtggtagagagcgtgctccaggcgtgccacaccttcaacgttgagagcgcgcgcatgcaggaggccgtcgagggtgcgggtattccgtatatgaagatcgagaccgactacagcaacggtgacatgggccagatcgagacccgcatcgccgcctttatcgaaaccctgtaggacaaatgcggcaaagggatagttgttttgccgcatagaaggaggatgccgtggctggcattggtatcgacataggctcgacggccgcgaaggctgcagtggtggagacggacggcgccattgcgtggacctgcgtcatgccgacggggtattcgtcggtcgatgcggccgagcgcttgcgcggcgagctcgcttcagccgactatgacgtggctgccgacgacgtgcgcgtgatcgcgaccggctacggccgtgtcgccgtgccctatgcgcacaaggtcgtgaccgagatcacctgccacggcaccggtgccgtgcgcctgtttggcgatcacggcacggtgattgacgtgggcggccaggacaccaaggtcattcagcttaaaagtggccgcgtggccaagttcgccatgaacgacaagtgcgctgccggtacggggcgctttttggagatcatggccgaccgtctgggtatttcccaacagcagatggccgaccttgcgcgttccggtgagcccaccaagatcagcagcatgtgcacggtgtttgccgaaagcgaggtcatcagcctgatcggtcgcggtgagccgcgcgagaacattgcacgtggcgtgatcgacagcgtggtctcgcgcgtggcgaccatggccgggcaggccgcgggcgccccgtactacctgaccggtggcctgtgcgagaacgccttcgtggtggagcggttgggcgagctgctggggtcgccggtgaccacctcgccccaggctcgctttgccggagcgattggcgcggcgattcgcgcacaggcgctcaattaatgcatccgccgcaggctcgcattcatgcgtatactgggagaaaatgattgaccgatgagaggaggtatcgatggctgacgatcagattaggctcacgtccatgacggccgcgagcggttgagccgctaagttggctcccggagccctcgcccaggtcctgggcgatttacccaatgtgcataacgacaacctgctcgtagggttcgatacctccgacgatgcgagcgtcttccgcgtaggggagaacctggggctcgtgcagtccatcgacttcttcccaccgatggtcgacgacccgttcctctttggccagatcgccgcggccaactcgctgtcggatatctacgccatgggcgggcggccgagccatgccatgaacttgctgtgcatcccgagctgcctgggcatcgaggtcgccggccagattctggcgggcggcgccgacaagtgcgtcgaggcgggttgctccatcgcgggcggccataccatcaacgacgacgagcccaagtacggcctgtccgtgagtggttttgtcgcgctcgaccgcatgctcgccaacagcggcgcacgcgtgggcgatgttctgctgctgaccaaggcgatcggctcgggcattatcaccacggccattaagggcgagctcatcgagcaggacgaggccgcagccatgtttgactcgatgcgcaccctcaacgaggctccgattcgtctggccgagggacttgagcttcacggctgcaccgacattacgggctttggtctgatcgggcatgcgtgcgagatggccgagggctcgggcgtgcaaatcgagctcgcgtcgggggcggtgccgctctttgaccaggtgctcgacatggcgcgtctgggcattatccccgcgggctcctaccgcaaccaggacttctttggcccgcgtgtagctgccgacgatgacctggagccgggcatgctggatgcgctgtacgatccgcagacttcgggcggtttgcttattgcggcgcccgcggcggatgcggatgagcttgcgcgtcgtttacatgccgaggggcgcgttgccgctacgatcggccgcgtgtgcgagccggtgccgggcggtcctgccgttcgcgttgtgcattaaggaaaaccgtttatgcgaccgcctactgttctgggcggtcccttttgaaaggaaaaactatgtctaccaaaattgaagtcaatgccatgggcgatgcctgcccgctgcccgtcgtcaagacgctcaaagccctgaagcagctcgatggcgagggcacagtcgtgacctcggtcgataacgagaccgccgtcaagaacatctccaagatggcgcaggagaagggctgcacggccttggtcgagaaggtttctgacgccgagtggcacgtgaccgtggcgacctctggcgccgttgccgtggccgatcccgagcaggatggcgctgccttctgtgatgccagcgccggcaagggcaagctcgtcatttccgtctacaccgactgcatgggccgtggcgacgacgagctgggctacaagctcatgaaggcgtttatctttgccgtgacgcagcaggaggaactgcccgcgaccatgctgttctacaacggcggtgccaagctcaccgtcgagggttcgccggtgctcgacgacctgaagggcctggcggagcagggtgtcgagattctcacctgcggcacctgcctcgaccactatggcattaaagaccagcttgcggtgggcgaggtcaccaacatgtacgtgatcgtggagaagatggagcaggccgtgcgcgtcgtgcgcccgtagcgtattggttggagttgccatgagggagaagcgcccggcgcttgtcatcacgtttcctaccacggcggccgccatgggttgtgaatccctgtgcatcgagcgcggtcttcccgggcggacgattcccgtgcccggggaggtcgctgccggctgcggtttggcgtggaaggcgttgcctgccgatgaggaactgctgcgcggcgaactcgccgcggcgggcgttcccaccgagggctttacggtgatcgacatgtgggaggtcgtgcgatgatctacctggataacgcggcgacgaccatgcacaagccgcaggcggtcatcgatgccgtgacgcaagcgatgtgctcgctcggcaatgccgggcgcggcgccacgtcgggtgccctcgacgccgctcgtaccattcacggttgccgtgccaagctcgcgcgccttttgggttgcccgagggcggaccatgtgtgctttacgcccaactctacggcggcgctcaacaccgccatctgtggcgtggtgcgccccggcgaccgcgtggtcaccacggtgctcgagcataactccgtgctgcgtccgctcaaccgcctggcagcggagcggggtgtgaccgttgagcatgcgagctgtgacgcaaacggtgtgctcgactacgacgagctcgagcggctagtcacgcccggtacgagtgccgtggttgtgacgcacgcctccaacgtgaccggcaacgctgtcgacattgtgcgtgtggcggccatcgcccatgcggccggtgcgctggtgatcgtcgatgcctcgcagtctgccggtacggcgcgtgtcgacatgcaggccatgggcctcgacatagtgtgctttaccggccacaaggggctcatgggtccgcaggggaccggcggcctggccgtggcggagggcattgacgtggctccgtgggccatgggcggcacgggcgtgcacagcttcgatgcgctgcagccgcttgagtggcccacgcgccttgaggcgggcacgctcaacggccacggcatcgcgggcctttctgccggcctcgactttatcgaggcccagggtggggtcgaggcgattgctgcccacgagcgtgcgctcgctgatcgcttccttgccggtgtgcgcaagattccggggattaagctctacggtgcctttgaccagcaggcgcgctctgcgattgtgtcgctcaacgtagccgatatcgactctgccgagatttcggacgcgctcatgcaagggtgggggattgcgacgcgccccggtgcccattgcgctccgctcatgcaccgcgcgctggggaccgagcgccagggcgtcgtccgcttctcgtttgggtatttcaacacggacgaggaagtcgacaccgcgattgacgctttgcgcgatttagcctgctagagcgtatatacttgcgggacgggccttttgcccgtcccgtttttgtttcgacccgaaaggtgtgcatatggcctcatccgctccgcgcggtttgcgctccgaccatgtcgttaccgtcggcattgcgctgttctcgatgctctttggcgccggcaacctcattattccgccgctgctggcgctgcaggctggttctgccacgccggtcgccatgctcggctttctcatcgccgccatcggcctgcccgtcatgggctttattgccgtggcgcttgccggaacggcgcgcgagcttgccggccgcgtgcaccccaagtttggcgagttctttgttgcggcagtatatctggcaatcggtccgtgccttgccattccgcgtacgagttccacggcgtttgagatgctggtgccgctactgcccgagggcgtttcactcggcacggctcgcctggtgtttgccgttggcttctttgtcgtcgcgtttgcgctcacgctgcgtccgggcgttatcacgcgcgtactcgggcgcattacgggtcccgcgctcattgcgctcatcgtgctggtcgtgggtgccgccgtgatctcgccgctgggaccggctgccgccccgcaagctccctatgatgccggtgctgccgtgcagggcttcttgaccggctaccagaccatggacctgcttgcgtcgctcgccttcggcatcatcatcgccgagaccatccacgagttgggtgttaccaatgacaaacgcgtggccttcgagatttcgcgttccggtgtgatcgccggcgtgctcatggccatcatctactgcggcctagcgcttgccggtatgcagctcggcaccgtgatgcccgacgccaccaacggcgctgcaattcttgctcgttcggcctccatgcactttggccttgccggcacggttgtggtatttgcgattttcttcctcgcctgcatgaacgtgtgcatcggcctcatcagctgctgctcgcgttacttctgcgagacgtatgtgatcgaggggggagcggaggcctccgaggaggccatgcgccgccccttcgcgattctcgcctttgtgttcgcggcgttttcgtgcgtactctccaacgtgggcctcgacgtgatccttatgttctcggtgcccatgctcaacgccttgtatcccgttgccatcgtgctggtgcttatgggcctggtgcacggtttttgcgacgcgcatccgcaggtgtgggtttgggtcggcggcgttgtcgcggtgcagagcgtgattacctcggttcgagacgcgttctttgcgggtgcgtggctgccgttcgatgcgctgccgctggcggacattggagccgcgtgggcgccggttgccgtggtggcgtttgtgatcggtctgctccacagcaagtttgtcgcacattcgaggagctagggtttctgcgcttgcacaggcggggagtctcccctataatttccttcgctttgggacacgcaaggtttagaccttagctgctcaacaccttcgggacgtggcgcagtttggtagcgcgcctgctttgggagcaggatgtcgcaggttcaaatcctgtcgtcccgaccatatcttgcgggcgtagttcaatggtagaaccccagccttccaagctgatgacgcgggttcgattcccgtcgcccgctccataagatagcttaacggctctgattccctttgggatcagagccgttttcgtaaacgtgccggggaccccacatccccacctaagttgcggtgaaatacggactgtttttcggcttttatggcccatgtagtccgtatttcaccgcaactatttgtaaggttggattttgatgccgttgggaggatcgtagcgaccgtctaccgagagtggaaatattttttgaagctctgacctgcgacgtcaagcttttggtcagcttttggcaaggcctgcggacggaagcatgcgatagcgtaatggtattctctccgccgtgatggttatggggttggccatgctcgataaaggcaaacattttccgcagtcctatgcaaggatgctattctcggccgttggaattcatcaagatggacagctgcttataacaattgatccttgggatgaacgccgtgcgcgcgagcttatgcaggaagagctcatgcttcgtctttacaaccatgtgtatgcggatccggtctattggaataatcttggggttgaagatcgtatctttcagctggcatccgctattgcggtcgttgaaccggatgctgtgttttgcggagcgacagcagcgttgctctacggcatcggctcggcgtatacgcttctggataaagtgcaagtgctgctgccacggtctacaaggcgtgatacgtatgagttcgttgaatacaagcgctggcgcccgggcgaagtgtggcggcttggtctgtttacactgacggatccgtgtcgaacggttgttgatatcgcgcgatcgagcgcctttcgctatgcgctgggttatgtcgatggcttggcccgtgagtacgatgtcgaacgcgaagagctgcgagcatatgcgcaggcaaattgtcgagggctgcatggcatcgcgcgtgcttttgacgtttttgagtatatggacggcaggtcagacaatggcggcgagtctgaggcgagagcagcgatgattctcgctggggttgccgcgcccgagcttcaagttgagataacgcgaccgggaaacgctggctattatctagcagattatggctggcagatgccagacggctcatggacgctggcagagctgcatgggctaggcaagtttgaagacgaggctcaaaatgatccagagcgggcggcggcaaaaacgtatcgagcggccctcatgcgcgacgcgaaccttcgcgccatgggccacaacgtcattcatttcaaactctcggacacctacgacgtagaatcgttcggtgccatgatgcgcggttacggcattccgacaataaaaccctacgcagactcccgatagcgaaatcgttcgcggtccaccttcaataagttgcggtgaaatacggactgttgtggcctttaaaggcataaatcagtccgtatttcaccgcaactcaggtggggatggggttagtggcgaccgtgatggcggagtttgtcgatggtggagtcggtgcttcggctgcgggcttcggcggcgcggtcgcgaacgtcggccacggtttggcgcttgcggcggtaatcgatcatgccttggatgatgggcttgctaaagctcacgacatcatcgttgtagatggcggttcgggctgcaaggaggcagtcggtaaagtccatatgggtcttgccaaagagtttgacggcaagggcgacaacggtgggctcgtcgaccatgacgtcatcgagcagccttttcatggccgcggcaatctcaacgcggggaaccttatagacgtcgcgcagcgtgaccacgacgcgcgtgatgatttcggggtagacacgagcggtgcgcgtggcgatgaccttggcggcgcgcggtgacaggacctcgtcgtcgttaagcaggtagcgcaggatgacggtctcgtcgatgatggtgctactcatggatatctacttcctcgggacccaaaaccgactcatcgctttctgtggctaggtattcaatccaggcattgcgctcctcggcgcggcgattggggtcaccatatgctttgagcgatccataggcggcggtgccgtcctttgagcgcacggcgaccggctgaaaggggagcttgcgcatcaaaatgctttgcgcgacaaataagcggacagcctcggcgagcgatgtgcccatggcatcgtagagatgctcggcatgctgcttgtcttcctcgcgaatgcgcacctgcaggatggctcttttttgagtcgatgacatcactggcccccttaatgagcgtgcaatatagtcggtcaaatgcggcatgtgccgatacttgagcatcttataacgattactttatttcactcaagttgataaccataaacacgaatacaagcgtagtacatccaaaatgagagcgcataaaaatctctgaggcgtacgcatgtaatacactcacctttatagcttctagagaataattccaacctgccaaaacccctgcaatacacccgtattgcagggcctatgctcaagtttgccccctgcaactgcgtatatttaacctgtatatcgttggaggaattctatcgaagtgcctgtttcgccgcatgcactcgatacgccgatgccggaccacgggcggtccggggcaacgtcggcagggtctctccggcatgggattcaggagggagtgaacaacatgggcaataaacgagtcgtggctgattcttcacgctgcattgggtgccaaacctgtatggcggcgtgcatcgaggcacacgatattcccggcaacatcgccgcgccgcgcctgcgcgtgacgcgtacgtacgagatctccgcaccggtggcttgccatcactgcgaggacgctccgtgcgccaaggcctgccccacgggcgccttgttctttgatccaaagaaccatcgcatcggcatcaacgaggacaactgcatcggctgcaagagctgcgtcatggcctgcccctttggcgccgtgagtgtggcgaccacgcaggtccccgtcttgatgggcgacgtgcgcgtgggttcgcagaccaagagcttcgtgctcaagtgcgacctgtgcgtggaccgtcccggcggtccggcgtgtgccgaggcgtgcccgaccaagggcctcaccctggtagacgaggagcgcctggcggaactgactgccgagcgtgcccgcgccaccatcgaaaacgaggcgtaagcgtcgggcgacaggcccaatgattgtcaaataagtaccgagtattcggtagcagagaaaggaaggagggtgtcatggagaagcataaagtgatttgcccgtactgcggcgccggttgccagtttaacctcttggtccaaaatggccaggtcgtgggtaccgaaccgctcaacggcatcaccaaccagagcgagctgtgccttaagggcatgagcggctacgacttcatcaacgacaccaagatcttgactcctcgcgtactgcacccgatgatccgccgcaccaagggcgcggatcttgagcgcgtaagctgggacgaggcactggatttcaccgcatctaagatgcaggccataattgacgaatatggtcctaacgctgtcatgaccaccggctcttcgcgaggcggcggcaatgaggcgaactacgtcatgcagaagtttacgcgtgcgtgcatcggcacccacagcgtggacaactgcgcccgtacttgacacggccctactgtcctcggtctgatggacacggttggttcaggttgcatgtcatgctccatccccggtatggaggatgcgggctgcattttcctcttcggctataactctgccgattcgcaccccatcgtcgcaaggcgtatcgtgcgagccaaagaaaagggttgcaagatcatcgtcgccgacccgcgccatatcgaaaccgcgcgtatcgccgatctctaccttccgatcaagaacggttgcaatgttgcgttcctcaacgcctttgccaactgcttggtcaacgatggcctctacgacaaggaattcgtcgccgagcacacgaacggctttgacgagtggtgggagaccatcaagaactacactcccgaatccgtacaggacatcacgggtgtcgagcccgcgttgatccaccaagctgccgagatgtacgccacggcgaagccctctgccatcattggctggggcatgggcgtatgccagcagaagcagaacctgaagacggtgcacaccatcgcctccatcgcctgcgttgccggtcagatcggcaaacccaattccggtctcgcgcccgtgcgtggccagaataacgtccagggctcttgcgatatgggcatgctgcccaacctgtaccctggctaccagaaagtcaccgacccggcagtgcgtgccaagtttgccaaggcttggggcgtgcccgaggaaaagctcccgctcgaggagggctacaagctcaccgacctgggccacctggtcgacgagggcaaggtgcactgcttctacaactacggcgaggacccggtgcagaccgagcccgattcggccggaatgcgcaagacgctctccgagctggatctgtttatttgccaggacatctttatgacgcagacgaccatgctcgccgacgtcatcctgcctgccacctcttggggcgagcacgagggtgtctttaccgcatccgaccgtagcttccagcactttgacgcggctgttccgcccaagggcgagtgccgtcacgactgggagatcttcgcggacctgtctacgcgtatgggttaccccatgcactacgacaacaccgagcagatctggaacgagtgcattagcctgtgccccaactttgtgggcgcaacctacgagaagatggctcccgagggtggctacgcccagtggcccgtcaagagcaccgatgtgaacgaccacggcacggccgacatgttcgctggtggtaagttcaccaccaaggacggccgcgccaacctgatggcgcacgactgggaggcgccatccgagcttcccgacgatgagtacccgctcatcctgtgcaccgtccgcgaggtcggccactacagctgccgctcgatgaccggcaactgcaagacgctggcgctgctcgccgacgagcccggctttgtccgcatgaatcccgcggacgcccaggcgcgcggcatcaagaacggcgacatcgtctcgattcacagccgccgcggccaggtatacagccgcgccgacgtgagcgatcgcatcaacaagggcacggtctatatgacctaccagtggtggatcggcaagtgcaacgagctgaccattcacaaggtcgacccggtctcgcatacgcccgaggacaagttctccgcctgccaggtcgacgctatcgccgaccaggtctgggccgagggcgaggtcgagcgtcagtacaccgagctcaagcaggctctggtggatgccgccgctccccaggacgttgagcccggcgccgccaagttcgacgatgagacgcacgtgaaccaaatcgtgtagtcccgttctcgttggctttttgggccgggcgtcccgtacgttcgggagcccggcccgttattttgaaaggaagtggggatgaaccgcttcatcgacatcaacccggagaggtgcatcggctgcggaacatgccagtccgcctgtgccgacgcccaccggatgcagggtcttcaggatacgccgcgtctggcgctcgtgaagaccggcggtatttcggccgcccttgcctgccaccattgcgagggtgccccctgcgctgaggtttgcccggtgaatgccatcgagcacgatggcgatcgcatccacgtcaaggagcaggagtgcatcgggtgcaggctgtgcgccatcgcgtgccccttcggagccatccatcccgatggcacgtctatcgccggtgtcgcaggcatgtgcgacccgacgccttcgtatcctaagtccctgagcagcctgcttacgtgggctcctggccagtacacctgcgctgtcaagtgcgacctgtgcgccttcgatccggacggcccgcattgtgtggcggcgtgccccaccaaggcactgaccgtcatgggcggcgcggccgatcgcgagctcgacgaggccaagcgcctgcgctcgatcgaaaacggtcccgtcgtcgacgttaccgctgtggcccagggcctgtccgagaaagcagaagggagcgtaaacaatggatagcatgacgttgtttatcgcatcgcttgccgtctcgtgcatcggtgcgctcgcctcggttctgctgatcaaggccgataacgccgccaagaccgccggctgccttatcggcgccgtcgccgcggtgctttcgtttgtggccggtatccaggccgtgctgggcaatgtcacgtcggtcgataccatcgtgtttttcccgtttgcccatttccagctgctgctcaatcagctgtccggcctgttcgtggcgctcatctcggtgcttgcgtttgccggttcgatctacggtctcaactactttgatgagtacccgggcaaaaagggccgcgccggcttcttctttaacaccttcgtggcgtccatgatgctcgtcatcaccgccgacaacgtgttttggttcctggtcgcctttgagctcatgtcgctgacctcgtacttcctggtcgtgatcgaggagaacgagaactccatccatggcggttggctctactttgtgatcgcgcacgtgggctttgtgctcatcatggcgagcttcctcaccatgaccaacttcgccggtggctcgtttgcctttgcggatttccgcgctacgcagtttagccccgcggtcgcatccgtgtgctttgtgctcgccttctttggctttggcgccaaggccggtatcatcccgctgcacggctggctgcccaaggcgcatcccgaggcgccgtccaacgtgtcggccctcatgtccggcggcatgatcaagatcggtatcttcggcatcctcaaggtgggcctcgacctgctctccgcctcgggcgttcaggtctggtggggccttatggtcatggtcttcggtgcgatctcgtcggtcctcggcgtggccttcgccctgcaggagcatgacatcaagcgcctgctggcctatcactccgtcgagaacatcggcatcattctgctcggcgtcggcgcctccatggccgctatggcgctcaactcggtcggcatcgccgtcctggctctgatggccgccctctaccacacgtttaaccacgcgatgtttaagggcgagctgttcttgggcgccggtgcactgctgtactccacgggtacgcgcaatatggagaagatgggcggcctgttccgtcgtatgccggcaacggccatctgcttcctcgttggcgcgcttgccatctcggccatcccgcccttcaacggctttgtgtccgagtggtttacctatcagtcgctgtttaatgccgccatgcagggtgacaaggccgtcatgatcgtggccgtgttcgctgccgtcgcgcttgccattaccggcgcgctggccgtcacgtgctttgtcaaggcctatggcgtttcctttgcctccgcgccccgctccgaggccgcggccaatgccaaggaggttcccgcccccatggtgtttgcgcagggcctgctcgcggccatctgcgtcgtgctgggcattggtgctcccgtgatcgctcccgtgctggtcgatgtcgccgcgtccgtgctgcatccgtacggtggcgtgtttgccgccgagggcatggagctcatgaaccagtactccggcgctgtcacctccacgcccgcgatcgctattgcgctcgtggtgctcgtcggccttgcctgcggctatcgcaagctcaagaccgtcggtaaggtgcagaagtcccagccgtgggcatgcggctatgctcccaacgagcatatgcccgtcgtggccacgacctttgcctccgaggtgtcctggtttatgcagccgctctacacgctgcgcgaccgctgcacggccgtctgctggtccatcgcgcgcttcttccagaagctcaccggtgtggccgaggctgtggagcccgtacccgacaaggttctcgtcgatgccccgcataagggtgtcgagaagctcgccgacctcgcgactaagctcgagggcggcaactacagcatctatatctgctacatcgtcgcggcactcgtggtgttcctcgtgctcgccgtgcaaatgggttaaggaggggagagcatgaacaacatcgtacttgccgttctgcagggcgtggtcgtcatggccgtcgcgccgttcttctccggtctcggccgcgttatccgcgccaagatgcacaaccgtcgcggccccagcatcatgcaggactaccgcgacctggccaagctctttgcgcgccccgagtcccagagcgaggacgcgagctttgcgctgcgcattatgccgccgctgttcttcgccgtcgcctttatgctcgcgatgggtctgccgctctttacggcacaaagccccatcccggtctttggtgacgccatcaccatcatgtacagcctggcgctcgcccgcttcttcttcgccctctgcggtgtggattcatccaacgcctacgccggtatcggcggcgttcgcgagctgctcatgagcgtgctcatcgagccgtccatgctgctggcgctgtttgccgccgccctggtttgcggttccaccgacatcgccaccatgggccagcacatcatgacgggcgccatagacgcgccggtcgccgtgatcctcgccggcatcgcctttgcgattgcctgctacatggagctcggcaagctgccgtttgatcaggccgaggccgagcaggagcttcaggaaggtccgctcgccgagctttccggcccgtcgcttgcgatggccaagctcgccatgtccatgaagcaggtcctggtcgtcgcctggttctgcgcgatcttcgtcccctggggcgagccagcgaccgtgggcgccgctgccgttctgggcgcggtcatcttcctggtgaagtgcctgatcgactttgtcgtatgcggcgtgatcgaaaactcctgctcgcgctcgcgttttaaggtgcttggcaatcagacctgggccgtcgtgggcatcgccgttctggcgtttgtcttcgtggtcgtcggcgtgtaggagaagggagaaacaatgtcatttgcagtcagtctgtcccttctcggcttggtcgctatcgcggccccgatggtggcctcggtgctcgtcgccctgttcccccgtccgtacgccaagtggttcagcgttttgggtgccgccgtctcgacggtctgcaccatcgccctcgccgcgaatttcgctggtgccggcatgcccgacacgcaggtccccctgatctcgtttgggcagaccctcgtcatgggattcaccttcgatcgcatgagcacgctgctcgcgcccgcctttgtgggtatcggcctgcttgtcgtgatctattcgattccctatatgagcgagaataaccgtgagcatcccgacgcaccacgtcgtcgcttctacgcgtacctcgcgaccttcatcggcgccatggccggcctcgtgtacagctcgacccttttgggccagctcgtgttctttgagatcacgggtgcctgctcttggggcctcatcagctactacatgtcgcctacggccaagaaggccggcatgaaggccctgattatcacgcatatcggtgcgctcggcctgtatctgggcgccgccatcgtgtttgcccacaccggcaccttcgccatcaccgcgattgccggcctcgacgccaagctcaaggctatcgtccttctgctggtgctctttgccgcttgggccaagtccgcgcaggtccccatgtacatgtggctgccttcggccatggaggcgccgacgcctgtttcggcctatctgcatggcgcctcgatggtcaaggtcggcgtgtgcgtgttcgcgcgtgcactcgtctctgccggcgagattcccgagatcgtgggctgggtcgccattatcgacgccatggtcaccatgctctttggtttccttatgtacctgccgcaaaaggacatgaagcgcctgctggccttctccacgatcgctcagctctcctatgtgttctttggtctgggcctttcggtctttggcagccatctggcctttgatggcgccgtgtgccacatctttaaccatgctttcgccaagacgctgttcttcctgatcgccggttcgttctcctttacgctcggtacgcgtatgctgcccaagcttcgcggcatcgtaaagaagtacccgatctcgggcgtgggctttggtgtcgccgcgctcgccattgccggcgtgccgcccatgaacacgttcttctcgaagttccagatcatcgccggcggcttttctgtgggtgccggcaacgtggcgatcctggtgctcgtgtgcatcatggtcgccgagaccgtcgccacctttgcctggttcctcaagtggatgggctattgcctgcccggcgagccgagcgaagaggtcgctgcgggagccccgcttccccgcgcgatggcgttcgtgttcatcgtgctcatcatcatggtcatcgtcagcggcccgctttcggccagctggatcggttaggaggtagaacgacatgggttattcgatcgtcaacatccttggcggccttctgattgtcacgtccaccatggtggtcgtctccaagaacatcaagcacgccattcgctggtatgcggtgcagtcgctggtgctcgtggggcttctcgccacgctcggtgtcaccaccggtgcgcaggagctgctaatgtgggccggatctgcctttatcactaaggtcgtcctggtcccttacatcctcaaccgcgcatacaagaagatgggcgagccgagcgacgcatcgctcaaggccggccttaagcccgcgtgggccatctgcatcatcgccgtcgaggtcgcgatctgctttgccgttgtgacgcagatcagcctgcccacggccgaggtcgcaacgcctgcgctcgctattagcttcgctcacttcttcgtgggcctcacctgcatcatctcgcagcgcaacatcatgaagcagatctttggatactgccttatggaaaacggcagccacgtgacgctcgcgcttttggcccccaccgctcccgagatcatcgagatcggtatcgccaccgacgccatctttgccgtcatcatcatgtccatcgtcgtgcgtcgcatttgggacgactcccactcgctcgatgcgcgcgacctgtccgagctgagggggtagtccatggaaacgttgattctcgccctgctcgcgactcctttggtgttctcgctggtcatggcgtttttgcccaagaacacgtcctataacgtgtttgccggtctcaacctggtctccgtcgcagccgtcctggtgctgtcgattatgacggccggcgacgtccttatgagcggcgaaaccgcgagcgctcttggcctgtggttccacctcgattcgctgggcgccatctttgtgctgctcatcggctttatcggttttcttacggggctgttctcgctgccctatgtaaaggccgatatcgaggagggctccatgcccgccgagcgcgccaagcagtattttgcgctgtttagcctgtttgtgttcaccatgctgctcgcgtgcctgtccaacaacatgatcctcacgtgggccgccgtggaggcaaccacgctttccaccgtgttcctcgtgggtatctacaagaacaagacggccctcgaggcttcttggaagtatgcgatggtctgcaccgccggcgtggcctttggcctgttcggtacgctgctgatctacgccaacgccgccgacgtgattcccaacgcccacgaggccgcgttcctgtcgtgcgtgctgccgtatgccgaccagttcgacccgacgctcatgcgcctcgcctttgcgtttatcgtgatcggctttggcaccaaggccggcctgttccccatgcacacttggctgcccgatgcccactcccaggccccgagccctgtctcggccctgctctcgggcgtgctgcttaagtgcgccatgcttgtgatcatgcgcttctacggctttaccatccaggccgtgggcgccgagtatccgcagcttttgctgctgatcgtcggcacgctgtccattttggtggcggcactctcgatgtttcgccaggacgacctcaagcgccgctttgcgtactcgtctgtggagaacgtgggcgttatcgccctgtgcctgggtatcggtggcccgctgggtatcgccgcggccctgctgcactgcgtgttccacggctttaccaagacgcttgccttctgcgtgtccggcaacatccagcacgcctttggtacgcgtagcctggccaagattcagggtgtcgtcgaggttgcccccgcaaccgccgcgctcgccgtcctggcgctgctcggtcttggcgccttcccgccctttggcatgtttatctccgagttcctgacttttgtcgccggtgttaccgccggtcccatgtggctggtcgtcgtggtcgccctcggtcttaccgtggccatctccgcgctcacccgtatcgcactcaagtcggtattcggccatgcgccccagggcatgggcaagcatgaggctccggcgctcatgcttattcccgaaatcatcctggctgtcatgatcttgtggtttggcatcgccaccccgctgcccctcgtgcacggtgtggagaccgcgaccggcatcgtgctcgagcagagcaccgaggaacttcacgcgacgccgatgtaccgcgctgtgttcggtaccgagaccgctcagagcgaggtgaagtaacgaatgattgaaactgagaacaaggtgtatgcccgtcgctgcgagagccatgtcgaggccctgcgccgcgccgttccgggctgcatcgagaaggttgagtggcagtgcgaggaccagctgacgattaccgtcaagcaggacaagctgcccgaggccgtccactacctgtactacgagcgctacggctggattcccgtgatcatcggcaacgatgagcgcagcctgtgcggccgttacgccgtgtactacgtcatctccatggagggggaggaccccggctgggtgaccgtgcgcaccgaggtcgatcccgccaagatgacgttcccgtccgtgacgccgttcgtccccgcctgcgtgtggggcgagcgcgagctgcgcgatatgtttggcctgatccccgagggtctgcccgaccgtcgtcgcctggtgctgcccgacgattggcccagcggcctgtacccgctgcgcaaggactccatggactaccgcttccgtcccgctcccgcgagtgacatggaaaactacgagttcttggccgataccaagggcaaggagacgacgcttgtccccatgggcccgttgcacatcacctccgacgagcccggccacttccgcctgttcgttgagggcgagacgatcgtcgacgccgactaccgtctgttctacgtgcaccgcggcatggagaaggtcgccgagacgcgcctgaactatgacgccgtgacgttcctcgccgaccgcatctgcggcatctgcggctgcgcccactcggtggcctatgccgaggccgtcgagcgcgcacagggcatccatgtcccgccgcgcgcccagtacatccgcgccatcatgctcgaggtcgagcgtctgcactcacacctgctcaatattggcctcgcatcgcactacaccggcttcgactccggcttccagcagttcttccgcgtccgcgagaagtccatggacctggccgagaagctctccggtcaccgcaagacctacggcctcaacgtgatcggcggcgtgcgtcgcgacattttggccgagcagaagctctccacgctcacgaccatccaccagctgcgctccgaggttcaggagctcgtcgacgtcttgctctccacgcccaacttcattgagcgtacgagtggcatcggcatcttggaccgcaagatcgcacgcgacttctcgccggtcggcccgctcatgcgtggctcgggctatgcccgcgacgtgcgctttgaccatcccttcgacggctacgccgatccggacatccaaaagatgcacgccgccacggccgacacctgcgatgccttcggccgtaccgccgttcgcatccaggaggtctacgattcgatcgacatgatcgagaccatgctcgagaactgcccgtcgggccccatcctcaccacggattgggagtacaccccgcacaagtacgccatcggtgccaccgaggcgccgcgcggcgaggacgtgcactgggccatgctcggcaataaccagaagtgctaccgctggcgcgccaaggccgccacgtacagcaactggccggtcctgcgctacatgttccgcggcaacaccgtgggcgacgcggcgctgatcgtcggctcgctcgacccgtgctactcctgcaccgaccgcgtgacggtgaccgatgtcgccgccaagcgcgaccatgtgctcgacaaggagcagttcgagaacgtctggcgcgacaagtcgccgcttgcgggcgagggcaccatggccgctccgctcgatgaggaggcgctctaatatgctgaagctttggaaggttaacgccaaggccggcgacgcgacggtcaagtacccgtttgcgccgttccctaccaacaaggacatgcgcggcaaacccgagcacaatgccgagctctgcatcgcctgcggtgcctgcggcgtggcgtgcccggccgatgccattcgcatggacaccgaccttgcggccgataccattacctggtcgatcgactatggccgctgcatcttttgcggccgctgtgaggaagcctgccccatggaggccatcaagctcaccgaggagtttgagctggccgtcatgagcaaggacgacctcaccagcaagagcgtctacacgctcgagcactgttcgcgctgcggcaagccgtttgccccgcacaaggagatcgactacgccaagcgcctgctgcaaaaggccggcggcatggaggccgagcaggctgcccgtaccgtcggtatgtgccaggagtgcaagcgcgagctcgacgccctgcgcgccgcctcggccgtaaagaccggcaacgctgccggcatggctgccaacgagacgcttgcgtccggtgagccccagggccccggcatggagtatctgggcggccacggcgtgaacccggagtatatcgaccgcgagctcaaccccgatgcgcccgagatccccgccggtcctgcaccggtcgagggcatcatcatggattttgaaacgaaggaggagtaaccatggccgaacccacgcttttgcccgagcggcttcagtaccgcccgaccaagatcgagctcgacgagagcatcgagaaggccaaggcgacccttcttaagaagatcaagcgctcggtgtacgtctaccgtgtcgactgcggcggctgcaacggctgcgagatcgagatcttcggttccatcacgcccgtctttgacgtcgagcgttttggcatcaaggtcgtgccttcgccccgtcacgccgacgtgctgctgtacaccggtgccgtgacgcgtgccatgcgcatgccggccctgcgcgcttttgaggccgcacccgatcccaagatcgtagtgtcctatggcgcgtgcggctgcaccggcggcatcttctacgacaactactgcgtctggggcggtacggataagattctgccggtcgatgtctacatccccggctgcccgcccagccccgcgcagaccgtctacggctttgccatggcacttggcctgctggaccaaaagctccatgccgagaccacggtggaggccgccggcgagcaggccgatatcctgcaccccggcgtgccgtacaagctgcgcgttgccatcgagcgcgaggctcgcgccatgagcggctaccgttacggccgcgacttggccaacgagtttatggatacgctcgagggcgcgcccaagggcgatatccgcggtgccatggcgctgctcatcgacaagcaggatgatcctcgccgcgttgaggtgtactcggcgttacaggatctggtactggccggaggtcgctagatggagctcacggaccgctctggttactttgcgggccccggcatgctcggcggctcttttggcgatgcctcgcgcgcaagcgacgaggccgccgagggcgtcgccgacccctgcctgggccatacgcccgaccaggtggtcttctatgagctcacgcgtaagtttgtggagaccgaggaagacgttccccaggaggcctgcgacgtgctgtactacacgctcgccgtgggccaccacaccggcgtgctcgactgctttgagccgcgcctgtcggtgccggtgaacgtgttctatacgcttatcgacgcgctgccggagggggaggccaagaccaagttcgaggccatccgctcctttggcgagtgccagctcgacaaggcggcggtgccgtcgctgctcgaggcctgtgacacgctgctcgacgatcgcggttttcgcggttcggccaaggccggcatctcggtgttcgataacgactttggcctgcatgcccagcaggttgcgttcttaatgaagtttcgcgatctggttgagcgcgtgcgcgatgtgtcgggcgtgtatctgacggggaggttgcagtaatgggtcgcgttgtggatggccgtgtgaacgacgccccgtttgcgggcattgtgctcacggcgggaagcgtgctgcgcgccgacgatgccgctggccccgtgctctccaaaaagatggaggacacgcccatcgccggttggtacaccatcgacggtggtcagacgcccgaggacgacatcatcgaggtcaagcgcgagcgtccgccgcgcctagtgttggtcgatgccgccgacatggcgctgcccgtcggtgccatccgcctgctcgataagaccgacgtcgcgcgcaagtcgatgttcaccacgcattcgcttcccttgtcgattctgatcgaagagattgagcaatcgtgcgaagatatcgtcttcatagggattcagccgggcgacacggagttctacaaccccatgtccccggaagtctttgacgccgtcgacgccgtgtacgacgccgtggccgccaacgacttttcccactttgtccgcttgggacaagagcaataggtgcgcttgtccctgctgattaggaaagaagtgattgacatggcagattccaaggcagaatatcccgctcccgattgcctggcgcccgccgcgatcgaggccaagaccgaggccgccggcgtgaccaaggccaacctgccggtcgcaaaggcctttctgttggcaatgttcgccggtgcgtttattgccttcggtggcctgttctttaccgtgttcttgagcgacagcacgctgggctggggtgcccagcgcgtcgtgggcggtctgtgcttttgcctgggcctggtgctggtactggtgtgcggcgccgagctgtttaccggtaattcgcttatggtctgcgcgctcaagagcaaaaagatctccctggctcagatgctcaaggcatgggtcgtcgtgtgggtcggcaattttgtcggcgctctgttcatcgtctttttggtgtatatggccggcatttacaagctnnnnnnnnnnnnnnnnnnnnnnnnnnnnnnnnnnnnnnnnnnnnnattccatggtgagcgtcgccgccggcaaggtgacgatcgactgggtgacgatcttcttccgcggcatcctgtgcaacatctttgtgtgcctggccgtgtggatcggtaccgccggcaagaccgtggtcgataaggtcgtgggcattctgctgcccatcgccgcctttgtggcctgcggttttgagcactgcgtcgccaacatgtactttttgcctatgggcgccgtgatgcatgcatgcggttacggtgccgacgtcgctggcgctgatgcactcaatgctgcgggcattgcgtttaacctgttcgccgccacgctgggcaacatcgtgggcggcgcggttctggtcgcgctcggctactggtttatctacgccaagaagtccgaggcgtaaggtgccgtctgtttgacgttgggcctcccgcggggcgttgccgtgcgggaggctttttgggtctggggctcgttgctgggctgtttgcctgttgtgtttggcttgcgaaaggggtaatcgagatggcatctgctgtggagcgtgacggtcgcgccgtggtgaccacatgcgggggatgctatgccgattgcgcctttgcagcccatgttgaggatgggcgtgtggtggccgatctgccggtgccggggcatccgtgcgcggcgcgtgccctgtgcgcccgcggacggcatcgcctggcaatgccgtttgacgagcgcgaccgcatcgtgcaccccatgtgtcgccgccaggatggctcggggttcgatgcgatttcctgggacgaggcgtttacgcagatcgctgcgcgccttggggggattgttgacgggcatggtccgcgcgcgctgggcatgacacttggtgtgccctcgttcgaccgctactgggcgtttcgttttatgcatgcgctgggttcgcccaacgtatacggtgccgatggcgcctgcgaggtaagccggcttaccggttgggagcacagcctgggctacagccccgcttccgacctggagcataccgattgcatcatgtatttggggcgttccattgtcgattcgtcgacgatgggagccgttgacgcactcaacgatgcgcgccggcgcggggcgaagatcatcgtggttgacccccggcgcagcggttcggccgcgcttgccgaccgctggctgcgcgtgcgtcccggatgcgatttggcgttgctgctgggtatcgcacatgtgctggtagccgaggacctgtacgatcacgagttcgtggaccgctacgccacaggctttgacgagctggcgcaggcggccagtgcttggacacccgagtgggccgaatcgatgtgcgacgtgccggccgcagagattgtcgccacggcgcgcgatctcgctgccgccgcgcctgccgctgtggtggatgcgggctttcatggcggcatcggtatcgcgtatgccaacagtacccagaccgcgcgcgcgatttgtctggtcgatgtgctgctgggctgcatcggacacgcgggcggtgccctcaacccgcccacgccgcttgcgttgggcgacctcgatcccgcacgctttgcgacgccgccggtgccgcgcgggcccaagctggggtccgagcgagtcccttgcggcgtagttcttatttaagccgtccaggttttggggtgcagttcagccgggaggggtttcttctgagcgatcccgcagcgcgaagcgcgaggaccagcgaagaagaaaccccgcaggcggtcgggccggtgggaaggatggcctttcgacctactccttctcgaccgcgcgcatgatcgccttgtagatctccatcagcgggatgatcaggaaggccaggcccagcgcggcaagaacgcccttgagctcaagcgtcacggggccaaagaacatctcggcaagcgtcggctgcacggtcacgatcaccgtcagcaccagtgccagcgcggcagaagcccacagccacttgttctgcttcttcatggtgaacagtgacgcacgacggctgcgcatattgaagcagtggaaaatctcgaccatgttgagcgtgatgaacgccatcatcacgccttcctcgtcggcattgccggcgatcatatcgacgatgtggatgtagcccatgtcaaagtacacgcccacaaagaagctcgccagcaccagcacggtgataatcagaccctggaccacgcagtccaggcccatgtgaccggcaaagacaccgtccttggcgttgcgcggcttgcgcttcatgatgtcgccctcggcgtcctccatgcccagcgcgagcgcggggaagcagtcggtgaccaggttcacccacagcagctgcaccggctggaagatggtaaagccgatgagcgtggcgataaacaccgagaacacctcggcaaggttggccgaaagcaggaactggatgaccttgcggatgttgtcgtagatgcgacggccctcttcgcaggcaccgatgatggtggcgaagttgtcgtcggcaagcaccatgtcggcaacgttcttggtgacgtcggtgccggtgatgcccataccgacgccgatgtcggcgcgcttgatggacggggcgtcgttgacgccgtcgccggtcatggcgacgatctggtcgcgcgacttccaggcctcgacgatgcgcgtcttgtgctcgggctggacgcgggcgtacacgccgtagtcctcgatgtgcgcgtcgagctcctcgtcgctcatgcggtcgaggtcggcaccggtaatggcatggctgcgatcggtgacgattcccagctgcttggcaatggccacggcggtgtcgatatggtcgcccgtgatcatgacggtgcgaataccggcgtcgtgggcctcgcggatggcgtcggagacctcggggcggacagggtcaatcatgccggacaggccgtagaagaccaggtcgtgctcgagcgcagcggggctgcagtcgctcgggacctcggtgtaggtgcggcttgccagcgccagcacgcgcagggcctcgtcggccatggccttgttggcggccacgagctcggcgcgacgctcctcggtcagcggaacgaccctgtcgccgtcgtagatatgggtgcacaggccgatcaccacgtcgggcgcgcccttggtgtactgctcatactcgccgtccagggtctcgacgaccacggacatcatcttacggcccgagtcgaacggggcctcgcccacgcgcgggtgctcggcagtcaggccagtaagaccagccttgccggcatcgttgacgagcgcgcactcagtcggctcaccaacggcctcgcccaggtcctcgtcccactgggcatcggagcacagcgccataccggccaggaacttctccttaggcgcagcgagctcgtgcttgacgacggtcatcttgttttgggtaagggtaccggtcttgtcggagcagatggtctgcgtgcagccaagggtctcgacggcagagagcttgcggataatcgcctggcgcttggccattttggtcacgccgagcgaaagcacgatagtcacgacggcaaccagaccctcagggatggcggcgacggcaagcgagacagcgaccataaaggtatcgagcagcgcggtcgggtcggtgagaacgttgcccacgccgtggcggatgatgtcgacgccaaagataacgacgcagatgacgataaccatgatagtgaggatgcggctgagctcggcaagcttcacctgcagcggcgtgagctcttccttggcctcggccagggcgccggcgatcttacccatctcggtgttcataccggtaccgactacgacggcgcggccacggccgtacaccacggtggagcccatgtagcacatgttcttgcggtcgccgagcggcacgtcgtcggtgccggcggcgagctcgatcacgttggcatgcttctcgacgggcacggactcgccggtaagggcggcctcctcgatcttcatcgtggcgctctcgagcacgcggcagtcggccgggacggagtcgcccgcctcgagcatgatcacgtcaccgggcacgagctcggcgctcggcaggtgcacgagcttgccgtcgcgcagcaccttggactgcgccgcgctcatctcctgcagggcctcgagagcctcctcgcttttagcctcctggaccacgcccagcaccgagttgacgataacgacgaacatgatgatggcgacatcggcaaagtccgcctcgcccttgaccatgcccgtgagcgcgctgatgacggcggcaacgatcagcatgatgaccatggggtcggccatctgctcaaagaagcgcttccacagcggcgtcttctcggcttcctcgagcttgttagggcctgtcttagcgaggcgcgacgacgcctcgtcgtcgctcaggccgaggttctcatcgacaccttggtcgctgagcacctccgccgcggcggacaggtattccttttgcatatagagtcccctcctgggattcgggccactcagcagattgatgcccgatcataattcccaggagaagggcaagggctcatcaaggctgccgtgctgagcggcagttgatagtggagctatggtaccccaaagcaacgcgtctagccaaaacaatccatttggaaatatggtccataagcaacggtgcagaccgtgtgatgctcaatactgataaaacgttttttcttcggcgcatcatcaaattgaaatatcgcccagatagcagcggttagaacggttggtaaagtttttgcatataccgtttttccgcaaaaaatgaacttctaattcggcatacggtcgattttttggggtattcggacgccatttcgttataatcaactcggttttatttcttatggtttatctatcagcgcaagacgatgtcagatggaggtctgaatgtacaagcgcaccaagattgtatgcaccatgggtcccgcctgcgatagcgacgagaccatccgcgagatgatcaaggcgggcatgaacgtcgcccgttttaacttctcgcacggctcctacgacgagcaccacggtcgcatcgagcgcgtccgtcgtatttccaaggagctcggtatgcccgtcggcatcctgctcgacaccaagggccccgaggtccgcaccggccttctggtcgacggcaagaaggttgccgtcaagaccggcgacaagatcgtcgtcaccgctcagcccacgaccgaggatttccacggcacctctgagcacatctccctcgactacctggctctgccctccgaggtcgagaagggctccctcatcctgatcgatgacggcctggttgccctcgaggtcgagtccgtcgacggccaggacatgacctgcgtcgttaagaacgacggcctgatcggcgagcgcaagggcgtcaacatgcccaacgtcaacatctcgctgcccgccatcaccgagcgcgatcgtcaggacatcctctttggcctgaccgagaacatcgactacatcgccgcttccttcatccgcgacggcgagtccgtccgcggcatccgcgagctttgccgcgagaacggcggcgagcacgtgacgatcttcccgaagatcgagtgcgccctgggcgtcgagaacttcgacgagatcctcgaggcttccgacggcatcatggtcgcccgtggcgacctgggcatcgagatcaagcccgagctcgttccgcacatccagaaggagatcatcgccaagtgcaacgcggcctacaagcccgttatcaccgctacgcagatgctcgactccatgcagcagaacccgcgcccgacgcgcgccgaggttgccgacgttgctaacgccatttacgacggcaccgacgccgttatgctgtccggcgagtccgctgccggtaagtacccggtcgaggccgtcaagatgcaggccagcattgctctcgagaccgagaagtacctcccggctcacgctccgctcgaggttccggctgacgctcacggcacccgcgttgtcaacaacgttgtgggtatgtccgctgtgaacatggccaccaccgttggcgccaagtgcatcaccgtgccgacgaccaccggccgtactgctcgcctgatctcgcacttccgtcccaacatgccgatctgcgcgttctcccgccacgagtgggccgtccagcagatgatcatgtactggggcgttatcccgcaccaggccgagattacccagggcaccgtcaacggcacgatcgtcaaggcgatcgagaccgctaaggagctcggctacgtcgaggccggcgacctgaccgtcgccaccgctggcgatccccgcatgagcgtccagctcgaggacaaggtctcctcgaccaacgtcgcttacgtcgctcaggtgcgctaagtcgtacttgcaagcacacttgcatcgcaaagggcccggaaggcgaagccttccgggccctttttctgtgccaatgccggcgcacggcaaaacacacactcatttctttaccaaaagcgcgaaatccacccttcgagacccaatgaataaagtcccaagcgctaaaagtgttcgcccggtggcaaacccacaccttaaccgacgctgctaaatcgttttagcaagagccggattgacctgcttttcggaagtatgcggcaaattctgatacctccgagcacaccccgttttttcgcaacaaaatgcctgataaactagcctcaaaagccaggtctgctcacaaggtttagattttgccgcatacttccgaattgacactggcatcgcacggtccaaaagcatatttcgaccaggaggacatcatggacctgacgctatgcggtcaatccgctttttactatcaccgtatcccgccacagatattaggcctttaccctgccattagccttggcaatatggatcgcagatgttgcggcctcggaagtcatgcagttgtaaaagacctgcttcacgcaccgcttcacaggattgtattcactcgggcacaatccgggtcgcgaagcctgtttaaatcgcacctcctgacccaagagccgcctcccgggtcgtttaggcaaaccgagcatgggtttgatgtcacatcgcccgagttcacactgctcaaccttgctacgcaggtctcacgcaaccagctgcttatggcgtgttatgagatgtgcagctcgtttgctgtgtatacaccctgcaaacgagcgcaacggcaacttgatgaagctatttcgcttaagctcattccacccaactgcggctgggagcgggttatcgacgtcaacggcaaggataccaacctgtggaagcgcacgccgcttctttccgcagcggatatcgccgcgttcgccaagcaggccgcaggcctgcgcggtgttaagcagctccgctgggccgccgaacgcatgacaggacagaccgcctcgcccttcgaagtacagacctccatgcttatctcgctcccccgcgacgagggcggcatgggcatcaacatcgcaaacaacgtgcgcatcccactcagcgacgccgcgcgctcgctgtatgacaaaacctgctgctacgccgatatcctcatcgaaagcgccaccgacagcatgggtgtcatccttgaatgccaaggccgctccgcccacgacagcgaagccgcgagcctctccgatgccgagcgcgccaccgcgctcacaagcatgggctacgacgtcatccaaattacctttggccagattaaggataagaagagcttcgaccacatagccgagctcatccataaaaaggctggactttcctacaccccaaagaccaaacaggagcgcgccgccgaagtcaccctgcggcaagagctacttgtcaattgggttgagctattcaccgccaagccggccagctagcagctagcaatcaggggaagcgcaggcatatcgggcgattcgacgcgagccgcaaatcccgcctcggttagctcgatgacctcggtaaacgttgtatcgaaaaactcctcggttagcaggcgatacggcggatgatcggactcgccggggttttcgcgtacaatctcgtgcataacgccgatggtcttgagcacatactccttatggatgggatactgaccaaaacgggtcgccgcagtatacaggcgatcggtcgcgcgcggtatcgaaacgatgccgagtgtcttgccaaaccagtcaaagtcgccttgctttttaatgcggaattcctcgcacggcttgccgccgtgcgcctccaggtactgattcacacgcgtattccatacggtatcggccaccagatgcgaccaaacgcccagcgtcagatcgagcagcgactgcgccacgtcatcgggcgcgagcgaaagctcgctagcaccgggaccggcgaccggctcggcgtccttgtaacgttggggataatgcacgcgattcagtcgctcgcgctcctcgacaatcgaggtagccgcggctggcgcaccggtgggcgaacttttaagcaacggtgccacataggtatcccagaactcatgctcacgaggcttagggataggctcgggctttgcaaagtgcgtaatgcggtacgggatgggatcggcgatgccagggaccatatagcccacgaagatatccggaaccacgcagccaaacaaaaaggcattgcggtcgcgcacgctattggcaagtgcaccggtgcgctccagcaaacgctccgtctgagcgatatgaatgttccaacttggcatagccacccccataaaaaacctggataactataccatcacggcaaagccgcgcgggcggctacgcacgctctacgcagcaactagtccgtagtaccgctttcggttccatacgacggcgaaggcgcctcgaccacatggtgatatcgatcgatatagattgcacgggcacccaggcgtcgcaccaaatcctggtgatgcgtgctcatcaagaccgtcttacccgccgcgacgtaggccagcaagaagttgaccacgatgtcgcatgaatcctcgtcgagcccattggtgggctcatcgagcactaggatatcggggttcatcgatacaactgccgccagcgccacacgcttcttttgcccgcccgagagctgatagggagaggcgtcggcaaggtcggcaacctggaacagccccatggcatcgcgcacgcggcgctcgagctcgtctgccggcagccccatctgcgcgggaccaaaagcaacttcctcgtccaccgtggcgcagaacagctgggcatcggcgttttggaacacgaagcccacgcgctggtggaacttctgagcagcagcagaatccttcagatacgccgcatcgaccacgtgcccgtcaaacaggtatgcccctgcgtccgcgagttcaaggccgttaataagacgcataatcgtcgtcttgccgcagccgttgggaccgagcagggcaacgagttcaccacgatcgacctgcagcgacacgccatcgacaaccgtatgccccgcataggagaacaccacgtcgcgcagctcgatgagcggaacgacctcggcgccgcccacaccgttcgtgcccgccgcactattcatatcgatcgtcaaaacgtcgcccttccccatttgcatccccagtcggaaccagcagcgcctacagcacggcgcacaacactgtcagcagcgccacgccggccgcataggccgcatcgcgccagccaaacctggcgcgcgcgggagccggatacgcaccggcaaagccgcggcaaagcatagcctcgtccatcgcgcggctgcatttcatcgccttgataaaggtcatgcccatgatacccgcgatcgaatcggtacgcgaaaatccctcgggcgcacggccaacgctgcgcagcatgaccgattcgcacagatcgtgcgccgtacgacccagcacctcgatgtgcttgagcgccatatcaaacgtaaagataacttcgtcgggtagatgcagcatcttgagcgccgccgacatgcggctccacgtgagggtccacgaagcgcccagcaccagcgacacattaatgaaggtcttgagcgcaatcttgagcatggcgcccgtagcggaagcacccagcagcagggcaggcagcgccaaaaccactgcgagccccgcggcgccaagcgccggcacaaaggtcgcgcgcagcccgcgtatgggacgcacggcaacgagcaccagcgcaatggccgccatcaacatgaggtacagcgggctttgtgtcaggcacacgcacaggacgcaaacgaatatccccaccaggcgcaccggagccgaaacgcaagaaagggcgcggtcgaccatcgacccgccctcgtgcgcgcctccacccaggcgaacccgctcaagcaggctcgccaggtgcaggacgttcttttgcatcacgcgatgacgagcgcccgtgggctcgtatcgctcctcggccgcaagccagctaggcagctcgaccatcgccatgggctccgctttccttgaccgtcagcgagatcagacggaatgcgatggtgagcaccgccacgccaatcacgccggacaagatatacatggcagcctgaccggcaaagccgagaccctgctcctcggaataggcctgcaggtaatcacccgtaggcagagcgtcggcaaaggtcggggtgtcgagaccgaccgaagcctgcaggctgtcgtcgccagcctcctgaacggcggtcgcggcgccctcggcgtcccactcaccccaggcgtcacccgtggccagcaggcccagcggcgtggccacgacaagcacggcaaccaagatgagcgtggggaccagcgaggtcttctttgcagcagcgccctcggcagcaagctgtccatcggcggcttcggggccgacgataacgctcggcgccgtcttcttgataaagccgtagatcgcggcagtcgccacgccctcgaccacgccggctaccaacatatgcgggatcatcatggccggaatggcaatggacagcgggaaggggcagtacagcggagcgcccgaagcattcgtgaaaagcatcggctgaataccaaactcgattgctgcgcacagggccgccaggcacaggccgacccagccgcttacgatggccgaaaccgaggtgccccagctcttgtcgtgcaaacggctgttaagcgcgcggaacacgatggctgcggcaaacggcaacacgaaggccatgttaaagcagttagcgccaaaggacaggatgccgccgtcgccaaacagcagcgcttgcagcgccagcgcgaccgaaaccgcgatggcagcggcctcgggacccagcagcagtgcgatgagcgcaccgccgacggcgtgacccgtggtgccgccgggcagcggcacgttgaacatcatgagcaaaaaggagaacgcggcgcagatgcccagaaaagccatgtgctcgcgatcgagcgtggcgcgcaccttcttgatgcagtgaacccaaacgggcaccatcgccaccgccatgacggcatcggtctgcggggacagataattatctggaatgtgcatgtatgcctcccgattgtcggcacgcaatcgcagcaccgtttgaatcaccttgatagtgttacgtattgatagattcgtaacacgccgccggctatcatagcaaacggcgcactgccaacaaagcagtgcgccgttttgcaatacattcgtcacagacgcaagcgatcttagccgcggacctcgccgtttacgcccttgcacaccttggtgacgatcttctggtgcgccttctcgacctcttcgctggtgagcgtgtgatcgtcggagcgatacgtaagcgcaaaggccatggacttcttgcccttgccaatgcggaccggatcgcggtagacatcgaacaggcgcacgccctcgagcagcttgccgccggcactggtaatacggcgctcgaggtcctcgcaggtcacggagttgtcgaccacgattgcaaggtcgtgctcaacagccgggtactgcgagaactcacggtagttctcctggttgcgggcacccttgatcagcttgtccagatcgagctcaaaggcaacgacgacctcatctatgccgcaggcctcgcgcgcctcggggtgaatctcgccgacccagcccagcacggtaccgcccgagagtacctcggcagcacgacccggttgcaggaaggcatagctctcgccctcggcgggacggaagcgcaccttctcgatgcgcagctgagcgagcaactcctcgacaatgcccttaccaaagaagaagcgcagcttgcgatacttcatgttccaggactgctcactccactggcccgagagcacacccgccacggacttggtctccttgggcaggctagcgttctcgcggccgtggaacaggctgccgacctcgtacaggtgcacgttgggcgtgccgtgggcctcgttgtaggccacagactgcagcagacccggcagcagcgagcggcgcatctcggtctgctcggccaccagcgggttcatgagcaccacggggcagccacggccctcggtggacataccgatcttctcaaggtcgcccggggcggcaaagccgaaagtcgtggtctcgttgaggccgcaggcgcgcaggatctcgccgaccttacgggtgagtttctgctcgcgggtcaggccgccaatatggttcttggcagccgggatggtcgccgtcacacggcccatgccccataggcgcaggacctcctcgatcagatcgatctcgcgcggcaggtcgggacggaagctcggcggggtaaccataaagtcctcgccgtcgcgctcgacggtgcagcccaggcgagtgagcgaacgctcgataaactcgggctcgatgtcggcaccgcaaatggcgtgcacgcgggccaggcgcagcttgatgctgtcgatggtcttgggcgcggggaacacgtcgacgtagccgggagcgacctcgccgccggcgatctcctcgatcagcgcgcaggtaacgttggcgacatccacgcagccggtctcatcgacctggcgctcaaaacggatggaggcatcggagatcagcgacagatcgcggctggtgtgcgaggtgcgaccggcgttgaagcaagcactctcgaccatcacgtcgacggtgtcgtcctcgatctcggaatccatgccgcccataacgccggccaacgccacggggcgctcgccgtcggtgataaggcccatgccggcgtcgagcgtgcgctcctcgccgtcgagcgtcgtgaacttctcgtcctgctgggcggcgcgaaccaccacgcggcgatgaccgtcgcgctcggcaaaggtgtccaggtcaaaggcgtgcagcggctgaccggtgagcatcatcacatagttggtgatgtcgacgatgttgttgtgcggacgcacgcccagggcgttgaggcgcttgaccatccagtcgggcgacgggccgaccttgacgttgcgcacgatgcgggcaacgtagcggtcgcacaggccctcgtcagcgatctcgacggaaagctcgtcgtcggtcgcgcggccggcctcggccttaatggcgggcagctcaacgtggaaatcgcggtcgaagatggcgccggtctcgcgggccatgccgatcatggacaggcagtcggggcggttgggcgtaatctcgcagtcgagcacggtatcactcgagcccacgtactcggcaaacggcatgccgcagggcgtatcctcgggcaggatcatgatgccggagtggtcgccgcccaagccgagctcgcgcgcggagcagttcatgcccatggacacgacgccgcgaagcttgctcttcttgatcttgacgtcgccgggaagcacggcgccaatcatggccgcgacgatgtggtcgccggcctcgaagttctgcgcgccgcagacgatctgcagcggagcggggttgccgtcggcgtcgaggttcttgtcacccacgtcgaccgagcacacatacatgtggtcgctatcggggtgcggggtcttggtgagcaccttggcggtcaccacgtggtcgaaggactcgcccacggtgtcgatcgcctcgacctcggtgccggtacggatatattcgtccgaaagggtcttgggatcctccggaatatcgatcatggtcttgagccagtcgtaagaaacgcgcatctaactggtctcctttcataaatgcggctttgagccggaaactgcaactaagaagaaagcgttctagaactggttcaagaacctcatgtcaccagtcatcaacgtgcgcaggtcgggcaggtcgtagcgcagtgccgcgacgcgctcggcgccaataccaaaggcgaagccggtgtacttctcggggtcgatgccgcagttgatcaggacgttggggtcgaccatgccgcagcccaggatctcgatccagccgctgtgcttgcagaagttgcagcccttgccgccgcacacgtggcagctcacgtccacctcgcaggaaggctcggtgaaggggaagaagtgcgggcgatagcgcgtcttgcgatcctcgccaaacatgcacttaacaaagtagtcgagcgtgcccttaagatcgccaaaggtgataccctcgtcgacgaccaggccctcgatctggttgaactgcggcaggtggcaggcgtcggccgtgtcgggacgatagacggtgcccgggcagatcatgtagatgggcggcttctgcgactccatggtgtggatctgcacgcccgaggtctgggtgcgcagcagcacgtcggactcgccgtgggcgtgagcctcggggtgtgcgacgctgccggggttgttgtcgaccacgtagaaggtgtcgcgggccgagcggctcgggtgatccatgggggcgttgagcgcggtgaagttgtagtaggaggtttcgaccatgggaccggactcgacggtgtagccgatgccgcagaagatgtcctcggcctcctcgatgatctgcttgatcaggtgctggtgaccgatctgcggacggatgcccggcagcgtgatatcgacggcctcgcgctcaagtgcgtgcttgagggcggcggccttcatctcggtggtgcgctcgtcgagcatgccctcgatcagctggcgcatctcgttggcgcgcttgcccatcacgggacgatcctcgggggcgagcttgcccatcatacgcatcaggccggtaatacgacccttgcggccgagcagctcaacgcgcgcagcctcgagcttggcggcgtcgtcggcgcctgcgacgagctccttggcctcttcctcgagtttgaccagatcatcaatcagactcatgtcttccctttcgtctctcgcgcattcgcctgccgggacgaccgatgccgcttggcgctgcgaaaacgcggcccggttcggtaacaaaaaaccgccctcgggcatgtgcattgcccaaggacggttgaattccgcggtaccaccttgtttgacccggcggatgtctggcccgccgcgcccactctgcgccccttgtcgcgaggctcacggcttccctactggggcttcgccgccgctggccgcgcgcccgttgaggtcgctgctcgggagtgaacgcttggcccttgccaccgcaggaaggcttgcagcccatgaccttccctctcttgccggcgacgcggcgggcaaaccctctccgtcaacgcattgggctataggataacacattctgcgagcatatcgccgcgttccgttttgttcgcactgggtacaagacgggtagctgtgcaaactggccgcacgcctacccgtggcgtccggtctgcgagatcaaggatataggtatgggaaagaaactcgataagaaggccaaggccgccgtggccaaggcctctaagagcgccaaggcgggcaagggcatcaagaagctccgcaagctcgaaggcaaactgtggacccgcgagtacctgctcaagattgccgagttcgatggcgcgacgattgcccccgccaacggcgccgcggcccgcgccgatgctatgggcacccttgccggcgaacatcacaagctcctgaccagcaaaaagtccgttgagctcgtgcgctctctcgcgcgcgagacggtcgcgggcgaaaagatcgacgacccgcagctgctcgacgagattcgcgtgctcggccgcgaccagcgcgaagcgagcgtcattcccaccgaggaggccgaggcctggaccaggctcacctgcaaggccgacgccgtgtggcacaaggccaagacggccaatgactgggcaagctttgagccctatgtggacaagattgtgggccagctcaagcatcaggccgagcttatggaccccaagcgcgacccatacgacgtttggctcaaccagtacgagcgcggtctttccgccaagagcttcgatgcgttttgtgacgaggtcaaggcaacggtcgtgccactcgtgcacgccatcggcgagcgcggccagcagcccgctgccgactttttgcacgcccgcgtgcccgaggccgcccagcgcgccatgagcttcgaccttatgaagctcgtcggcctgaacctgaacgacaccacgcttgcctttaccgagcacccgtttagcgagggctttgccgtgggtgacgcgcgcatcgcgacacacatctacgaggacgattgcatctccaacgtctacagcatcatccacgaagcgggacacgccatgtacgagctgggcgtcaatcccgcctatgcgcgcacctgtcttgagggcggcacctccatgggcatccacgagagccagagccgctttttcgagaacaccgtaggtcgcagccgcgcctttatgggaccgctgctcgaggtgctgcgccgccacgcacccgaggtctacggcgacgtcgacgaggacacgctctaccacgccgtgaacatcgcgcagccttcgctgatccgcaccgaggccgacgagctcacctatccgctgcacgttatggtgcgctacgagatcgagcgcatgctgtttgccggcgaggccacggccaaggatatccctgcgctttggaaccgcttcatggatgagtacctgggcattcccgttcccgacgacacgcacggctgcctacaggatacgcactggagcggcggctcgtttggctacttccccacctatgcgctgggcagcgcctacgacgccatgtttgtgccggccatgtgccgcgacggtgtcgacctcaacggcgcctgtgcgagcggcgacctgacacccgtccgcgcctggctgggcgagcacatttggcagtggggccgcgccaaggacgcgccggagctcatcaagggcgcgtgcggcatggcgttcgatgcccgctactactgcagctacctgcaggacaagttcaccacgctctacgagctgtaaggcataaccgacacgtcaacgcaaaggggacgccgcggaaccaatccgcggcgtcccctttccacctagttgtttaagaacgtccccaatgactaccttacagagcttccagcgcggcggcgatgcgcttcatggcggcatcggcggatgcttggtcgggcgcctcggccagcacgcggataaccgactcggttccgctcttgcgcacgagcacgcggccctcgcctgccagcgcaacctcggcctcggcgatggcgttctgcacgcccatgttctcgagcgcggcgtccttgtccgccacgcgcacggccacctgcgcctgcggcagcagcttgcacggagccgtgagctgcgagagcgtctcgcgctcggcacgaatcacttccatcacgcgcagcgaggtcataatgccgtcgcccgtgcgctcgatatcgccaaagatcgtatggcccgtctgctcgccgcccaggctgtagcccccctcgcgcatcttggcatacacgtgacggtcgcccacgccgctggtcacggcgctcaggccggcaagctccaacgacttgatcaggccaaagttgctggcaatcgtcggcaccacggtaccgcccgaaaggcgaccgtgcttgttcagatacacgccgcacacgtacaggatctggtcgccgtctaccacgcgaccgcgctcatccacggccaggcagcggtcggcatcgccatcgtaggcaaaacccacgtccaggccctgctccaccacatggcgctgcagacgctccatatgcgtggagccgcagtcgacgttgatgttaaagccatcgggcgcggcgttgatcacgcgcacgtcggcgcccagcgcgccgaacaccggcttggccaccgaggaagccgagccgttggcgcagtcgataccgatcttgacgccctgcagcgaaaagttcgcacttgcaatgagcgaagcaatgtagcggttgcggccctgcatgtagtccaccgtggcaccgatgtggttgcccgtggccagcggcacctcgctcttgccatcgatgtagtcctcgatgagctccagtacgtcctcgtccatcttaaagccgtcgctgttgacgagcttaatgccgttatcgcaaaacgggttgtggctcgcgctgatcatgatgccgcaatcgaagcagccttccacggtctggtgcgctacgcccggcgtggggatcacgtgcagcatataggcgtccgcaccgctcgcgaccaggccgctcaccagcgccgcctcgaacatgtaactcgagcgacgcgtgtccttgcccacgatcacgcgcgccttagcactgcggttgacgccgtaataccagcccacaaaacggccaatcttataagcgtgctctaccgtcagcccaacgttggcctcaccgcgaaagccgtcggtgccaaagtacttcatgcgctctccttacaaaataggggcgaacagattgcctgtccgccccaaaatggtactcgattatctgcgctaccagaaaaaccctacgccgacgcgctgtcgcgagccgcctggcatgtaggagtctgacgcagcgtaagcggcttgtcccccgcctcggccgacgtggtcagcgtatacgtgatcgtcgtcgtctcgccagcatgcaggtcaacggtgcccgaatagaaggggattccatgccacgtagcggcgccaagaccaaactgggtgccctcgacggtcagatcagtaatgttgccgcccgtcggggcaaacaacgagacattcagacgctcgtcgtcacgcgcggcatcgggtgcgctcgccgcaacgtagtcgggcagcttgccagcctcctcctgcgtcatgatgttcgtcagggtaacggtgatgcgataggagcacgtgccgtcaccgttcttgatgccctggccaatctgcgtatcggcgttcaggtaccagtcgagcttggagaagctcaggttgttaaagtaaacgccggcaacgggatcggcactcgggtcatccggatcgggcagcgaagcgtcaatgcccgtctctttgatggcattctgctcatcatcgtttctcatccacgcgatcaggcggccctcttcggcaccgcgctcaacggcgctgacaagcttcgtaacatcgacatcgccgataccgccaaggatcttgtcgaaggcagcgctggcgacggatgcaaagatgccgtcagactcctcgaccggatagttccagtacacatcgtgcatgagaacctttgcggcgttggtgccgtcgacaaccgttccgtcgggcagcgagacattaccgaccaggcccagcagatactgcaggaacaccgggtcgataccgatgacgccatcaacgtcctgtccatactgggacttccacagcgcggcgacacgctgcgagttgcggggccaatcaggcgaataggtattgcccgagttgtacaggttactgtggttgccgaacagcgcctcatcctcttcgtcgacgctctcgactgcctcttcctcgctgagtccaatgcggggaacaaactcgccaatcgacatctggccgtcagtgaccgaaatcaggccctgcgaaccgccaaagccgccgcaagcacgaatctcgacgttgttcatggcgtacataaggtagttgcgcgtctggccgttggcgccgagcatctggggaaggacgggggcgaccttctccgccgcgtcaaccgcaccgttgagggtggcaaagccgtccttggccttatcgaccagctcggtcacctgggaaatatgagtatcgccaatgccctggaccttctcgttggcgctcttgaacaccttcgagctgctggaaagcgaatcggcgaccgcctgcagcgcggacacgttaatcatgccgtcctggaacagcttgccgggcgtagcctgcgaaaggttatcggccatgggaaccagcgcattgctcgagacatcggacagggcgtcaatcatggtgcgggccgcattgatatcgctgccatacaccgggataaacgaagccgccgcccacagcgggctcgaggtctccgccttcatgctgttacagagctcatcgatcttcttcgcgtcgtcaggcagcgtcgaaaaatcgcccgacgtgaccttgcccttaaggccaccgacgatctcgacagcctccttcgcttcgctctttacggtctttgccgagttaagcagcataaagccgcctgtgccaagcacaacgagaagcactgcgactacagcggcaataatggcgccggtgtgacgctttttgcgctcgcccttgcgatggcgatgacggaccagaccgtcagagatcgaactcgacgaagcatcgctaccgtagttcaagccaaaatcgtaataatcttccttggaacccgagcccgcaaactcggcaccgctatcatccaggcgggcgaacgtgccagtctcggaggcgccggtgtaaatcgtgccaaggttacccgtaagccccgcgccaccggcagggggagtattgttggcggccttgccggcattaacgttgccggcagcattcgcggcgttggcagcacctgcgttgttcgcaggcaccgaaggagccccgctcggctgcgacgcggaggttgcaccgcccgcaaagacattcccttttgcacggccggtcttttttgccttttgagactgctcgtacagagcggtaaacatcgccgtctcgcccggggacacgcgcttaccggaactgccctgtccagcgccgcccggcgtgccggccttaccagccccgttcggacgcggcggaactgcaggacggccgctatcgctgcccttaaagtgattaccagccataaagaaatcctcgcaattgagtcgcaatgaaaatgtccataacgttactagtttatggcattttgagcatcgacagctaaactccagacacggacatcaattggcgaaaatgcggcacaacaccttttccgtcttggcgtcggcgccagctacaccgtgaggaacatcatcacgatgatcatggcaaagccgataaggtcggtcggcaaaaacaccgtgcccagcataacggcgctggtgatggtcgccgaaaccggctccacagttccgatgaggctcgcacgcaccgagccgatgtccttaacgccctgcatatagagcatgtaagcaaaaaacgagccgataaccacgaacaccgcaagcgcctcgacgccggcggcgtcgagcgccggcatatgcgcccaaggctgcacgaagacgcacgagaccacgcccgccgtgagcattgccgagcccgtgacgatggggctgccgtattcgggcaggatcttggcgggaatcaccgccatacacgcggcgctgaccgcacacataagacctgctgccaggccaagcggcgagatattcaggctggtggggtcgccgccggtggtgattaaaaaagtaccgccgagggccagaccaatgccgatcgcctcgcgaacgcgcggcctgcggcgatcgaccacgcaggtgtagcccatgatgatgatcagctgcaggcactggagcaccgtcgcggttccggcattggtcaggcgcacggccgaaagatagcaaaactggttgaacagcaggccaaaggcggtaaagagcagcagctgcttgcaatcggcgggtgtggtccagagcttaatcaggcgctcgcggtcgcgcgtaacaaccacggccataaagagtagaccggcgagaatctgacgcacgctcataagccacaaggtatcgacgtggtaggtatcgaacagaaaactcgcgctggtgcccgagaagccccaaaacgaaccgcccaccagcgtagccaagacgcccgtgatcatcttgcgcgtcgaagcgctgttcagacgcccgcgccaggcgcggcgggtgctacggctgagctcgtcggtgccctcgggcacatcaatgttcgatatatcggtcatcggcaccgaagcccctgcgccttcgacctgctcgacacactctttgctcattccactcccccgaaacagtctggaaacaattcggcttaccttaccacggcgaagtcgccagctggaggcttgtccgcttatcggtaggacaattccgcaggcgtctttccatagctcgataccgcaatggccttgcattatgcgacagccaaatcgcggcagcaggctcttttgaaatggatacgacaaagcccccgaattccacaatgtaagcgatttttaaaaatgttcttgccaccgagttcaggctccgttatattatcccttgcgcgcttgcgcatccttgatcgggcgtttagctcagggggagagcgcttccctgacacggaagaggtcagaagttcaaatcttctaacgcccaccaaatgttcgcagctcagaggctatgtcctctgggctgttttgttttatgtcgccaaatccgctggctgctccaaccgcccaagcaaccaccctgcccatgcacaaaaccgcgtcaatagccaccgaggccgaggccaacgcgtctcgaacccatccaagccgcaactcctcagcaaaacgccgcgatgtctgcgccctgcggtatccttgagccacttacacctgcagcaccaaggagccaccatgcgcaccgagctcgatgtccccttttcacacaaagaagaagccaaggcgctgggcgccaaatgggaccggaccaagaagatctggtatgtgcccagtggcgtcaaccccgaaccctttgccgagtggctgcccggtgttgaccgatccgacccctcagcaccgtatatatatctagtactgggcaagcacgagtgctggaagtgtcacaaagaaacctcggtcgcggccttcggcattccctatcgagccgataacgacgagagcatcgccatcgcgcacgcgcccaacgaagccgggcacattgccatcgacacggccaacgccaacgcactcgccatcgtgcccgctcttggctgcgtaccgggcgagatccgcgactaccttcataagcgctgcggctacaagcccgtaggcgcgcgagcctccaaagccccgtcgctcggcaacacgtgcaccagttgcgacgcgctgcaaggcagccgctatctgttcgaggagccctcgtccccgtttgccctcactgccatcaacaagctgccggcactggagtttatacgcgtcgaagttgccggcgtctttggcgtcccggtcacgcgtaccgactttgaccaggcgctctttacctgggcacgcgaccatcacgccgagttccacaagcaactcggtgaggggatttatttgtagaggcaaaagacactcacagccaactcctccgcatcacctatccctcgtcgccggcgtcgtacacgatatcgaggccacaaacagggcatttctccggatacaccggcatatgaacgcctgtccgttttctcacttcgtcgctgagtctgtcgcgcgcatcgataaaccgaatgtcgagacacggtatttgcgagccgcagcaagggcaggtgacgacaaacgacgcgcaatcaacctctacgctcggaaacatattgttgtctataagggcacacggcagttttccgtacttccccatcgcaatatcgcctcgccagctcatatacgctcccctctcgctatacaaatcaggaagagcatgcaccggcgggcgtgcgcgagattgcatcgccacgcgatccgatcaaacaacacgatcgtcaaagaatgccaaagccaaatacgctaatacggcagaagccccgccttttcacgcttcttttccgagcgatcgaactcaatgcgatgggcctcaagaaacaccgtatcgggtcgccactgacgctcatccggctgccttagcgtcgcacccgcaaaggaagcgtagtcggtcttatccagcaggtacgatccgcacagccgatattcgccgcaaacaggctcaaacgaaatcaggtgagcatcaaatagggaatgaagatcgcgccgaagcagaataccgttgctggcaacctgcgatttgggtcccgagtaattctcgatatgtgcagcctccagagcttcactgacgccgcagtccgacaccgcgcaacggccatcataggcggcaacgagctgcttgcggaaccattgctgccccaatcgctcgcgccttaacgcatagcggaccttttcgtcgtcggtcgcaccctgtccggcaaactcaatatcgacgggtatgtgcttcagataactcatgtcgggcgcaaaacgagggtccggtccgcctttatgaacaggaccgtgcagaacaaaccatccattttcgggctcgaaccgctcaacaaacgcaaggccgagcaccttatagcccacctcggttgcaaatatgactccgactgggacgccacattccatgcagttgagcattttacggttgtaattctggtctcgagaaccaacggctcctggcgcttggaccgaatacttaatgacccacgtaccgtcatccaaatagagcggaggcacatcggtgtagaagctctttttagagttatggaccgaaagcgcaaagatcttattgggatcttgcttcacccgatcctggcccggccagaagatccctgaatcccgcgttacgggaaagaagtccgagccaattctcaaacggtactgatactgaggactatcttccttggtgtggtgcggaaggctggtccaaacgccgccgcgctgttcctcacccagaaaccactcccatgcctcaacgtattcggaaggcacgagactgcaggcgcggtcatagcttggtccatccatcaacggaacagcaaggtcaatgtcgttcatcgccagcacctacaaccatacgaacgcgagtcatgcccctcaataatatggccgagagtcaattattacgagatctcattccgcgatcggcacatcgttgatgctctcggtttgccgctggcgcgcttgtaccccgctaccccacttccctgtatactgatgtagcacgtgtttcatccgggcttgttgggccgggtcgttcatgggaggttcttgtggctgtttcgaatccgcctaagggaagcgtttcttcttcgtccatcaagccggttacgcgcaaggctgtgcgttgccagcgcgaggtcgcttggcttgtcacgcaggcggcgggcaggcttgtggcgaccactcaggacgtcaatgcgcctacgccgagctttgtgttagcggcggcgctggattttgtgcgccaattggaggttgccgcgcaggatgccaacggccacctcgactaccagaacgttatggcgcccgacctgcaaacgttctgccacatggccaagttgcctgccgcgcccaatgcgctttcggacgcaggctacatgtttacgctctcgggcgcggaccttatccgcgacatctatgcatactgcagcgagctcgccgagcgccacgtctttgacgcggcagaagtcaaaccgggaaatgtcatcaagctggttcttaggctgttcctgatagacgggttcggggccatgccggcgtaagccgagtctttagcatcaccgtcgactgggcaacaaccgctttaccttaatggacgccaatcgagggtcgattattgggtcgcctcgtccactaacgcatctatcccacgcgctccgacagtcgatacttgcggttgcggctcgtcgccggcgccgtgggctcaagctcgccttgagcaatgagcgcgttgacgcgcgacctaacctgggaaattgtgagccctgtgtgctctgccagctcgcgcgtccccagctcgccgtagtgtttgagtgccgtcacaattaagcccccgccatgatcgaccggctcgatctttgaacggtaaagtacgaccttgaaccgatcgaatcccgggcagaacaggggcccggccagaccatgcgcgcgcatggcatcgatcatcatcgggatgcccgagccattgccctcagccggcgaacctgcgccatccggcagcgggacaatcgacatgagcttcacaagcgtcgcgttacggcatcgggagctgccgtcaaacaagttctcgcgagtctttcccccgtaaaggccgccaggatttgtcacctcgacacgatcatcaaagacgtcgacggcaatcgattgtccacagaaccgatccccgtattctcgatggattacggcgttggcgattgcctcgcgcagaacctcctcgggaatctcaagcgagtcgacacgcgagacgccttggacggtcgaggttcgccgcaaattcttggcgacggctgcgacggcatccgagatcatctcgcccaacgttccctcacagattgtgcggtccatgaacctcagcgaccccgccatgcccttctgagttcccgcatggacagccacgtcaatgaagagcttgggatagaactgctgagggtaggtgcccacaactaggagtccagccttggtgacattgccctgggaatcaaggatatttaggcgctccagcttcgtttgtttgtccggcgcgccgcgcattgcccggggcgtcaacgagaaagcccgatctatcgtacggtcgaccagcgtctcgtcgagattgtccgcgcccgcacccgccaccgcgtcccgatcgctcggagtcgctcgaccgtatgacgccaatgcgagcacctcggtcgatgaaagcggcacatctttgtcatcgatgcgcttgtagctgccgccctgggcgccccgctctatgacatagcagggcttgctcgacggatcgagctcctcaatcgtaatgacgagaacgatgacgtcctgaagctccactcgctcgatcgtgtatttaggcggattggccagctttcctcgaccgcccgcatcacccatgcctgacacaaattggttgagcactttctcggtctcgaagttctcaaccgggacaaaacctgcgcgctcactcactccgagcacgatgattccgccggcagtgttcgcgaatgcgctcaccgtttcccacacatcgcgggaaagcgtcgtggcgctctccttcacttcgacgttaagatcatccgagcccatacgccttaaagactcaagcagaccggtcagctcgttttcgttcatctgcacgtcctttcgctcggtcctgcggagaatgccgcggatagatttccctcgtctctcagttatctctcgaaattatctctcatctatctctctatctctcggcttagagatagagagatagatgagagatggaatgtctaccatttgcttcatttatacatatttttgctggtagaacaattggtattgagacaataccatgattgcctgtctctttgctgctcagttatctctcatatttttctctcatcttcctgtcatctctcatattagagacgaatgagggacgagagatacgcgagtgatggacgagcgaggattttcggacggtcggatatcgagagtggatatttggacggtttttggggcttttgcggcaaattccgtccaaatatccactctcgttcgataggtatccggaaatcctcgctcgtccgtccgaatatccactctcgtttggcgagtgtccaattttccacgctcgtgcggcgggcacgcgagcccttcgcccaatccgctggcatcgtctccagttcgccgcagggtcgcggccccatatgggtatactctcgaggattcgactcgattcgcccccgctggggcgtcaaaggagactgcatatgcccaccacctcaaccgacccgcgcgccgcagccgctgcactgctggtgcccggcactacctgccacggctttgccgtcgagcgccgcgagaccgtgcccgagctcgactcggacgcttacgtgctgcgacacactgcctcgggcgctcgtctgctgtacctggcgtgcgacgacgaaaacaaggcctttgccattggctttaagacgccgccggccgattccaccggcgtgttccatattcttgagcactcggtgctgtgcggatcggccaagtttcccgtcaaggagccgtttgtcgacctgatcaagagctccatgcagacgttcctcaacgccatgacctaccccgacaagaccatctaccccgttgccaccaccaacgagcaggatctgtacaacctgatggacgtgtacctggacgcggtgttcaacccggccatctataccaagcccaccatttttgagcaggagggctggcactacgaactggacctgccggagggcgacggcgacagcagcgccgcgagcctgcacgagggcacgctgcgttataacggcgtggtgttcaacgagatgaagggcgcgctgtccgatcccatgagcgtgctggacgatgccgtcaacgccgcgctctatcccgacaccgcctatgcgcacgagagcggcggcgacccgcgcgcgattcccgcgctcacctacgagcagttcctggacacgcacgcgcgacactacaatccctccaactcctacatcacgctctacggcgacctggacgtggaccgcgcactggcctttttggacgagcgctatctgtcgcagccgagtgccgcgagccgccgcatggacgctgccgttgccgccggcgaggacccgtccacgctggcgcccaatccgttggacgcgcaggcgcccgtgacctgcgagtacaagcgcatcgagatggccaccacacccgagaacgccctggtgggcctgggccttgtgctgggcagcgcgctcgaccgcaagcgcacgatcgcggcggatatcctgttcgaggcgctgctgggctccaacgaagcgccggttaagaaggccattctggccgccggcctgggcggcaacgtggtgagctacaccgcggccgagagcctgcagccctacgagctcatcatgctgcaaaacgcacagcccggtgtggcgcgcgagctgcgtcgcgtgttccaggacgcctgccgcgacctgtgcgagcacggagttccgcgcgagcgtctggaagccatcatcagcagcaacgagtacgacctgcgccagcgtgactatggcatcgccgacggcgtggccattgcgtgcgacgcgctgagcacctggctctacgatgacgacgccgcgacgctggcgctcaagtacggcccggtgtacgaggagctgcgtagcgagctggacggcagctattttgaggacctgctgcgcgagctggtgctggaaaacgaccacatggcactggtcgagctggtgccggtggacgccgccgagggttcggagggtgccgaggccgccgagctggcagccaagcgcgatgccatgaccgatgccgagctgaccgacgtggtcgagcgcacggccgcgctgcgtgccgcgcaggaggcggaagacacacccgaggccaaggccacgctgccgcgcctgcgcgtgtccgacattggcgaggcgcgccccgagccgccactgatcgtggacacgaccgtgcccatcccctgcctgcgccacggcatccccaccaaccgtctggcctacgccatgcagtatttcgacctgaactgcgtcgcgtttgaggacctgccctatgtgacactgctctgccgcctgcttaagcagctgcccacgcgcgagcactcggccgaggaactcgacaacttgctcgctggcaagctcggctttttgagctttacgaccgaggtcatgacgcagcccgaagtggacggcgtgcgcccctacctgctggtgagcgccggcgccctgtccgagaagatcgatgcgctggcgagtctgccgcgcgaggtatggtcgagcacgcttttggcagatgccgacgccgaccgcgtgcgcgacgtgctcacacagattcgcattgggcttgagcagggctttatcaacaacggccactcggcggcgctcggtcgcgcgatgagctacagctcgccttcggccgtggtgcgcgagcagctttcgggcgtggacttctatctgttcctgcgcgacctgctcgaccactttgacgagcgcgtgaacgggttgcgtaccaagcttgccgagctggcaggccgcatctttgtggccgatggctgcctggcgagctttaccggcagcgacgaggactttaacgcatactgggccgccgcgggcgacctggagctgggcgctggcgacggcgccgatgccggccgcaacgcgctcgtggtgccgacgccgtgcgaccgccacgaggcctttgtcatccccagcgacatctgttttgcggcaagcgcgtgcgacccgcgtcgcttgggcatcgacgtgacgggcgcctgggcggttgccgccaacgcgctctcctacgactatctgtggaacgagatccgcgttaagggcggcgcgtacggctgcggattccgcgcggccggcgagcgtcaggcggcgttctacacctaccgcgacccggcaatcgacccctcgattgagcgcgtggcgcgcgcgggcgaatggctcggcagctttgatcccgacgaggccgcctttgagggctttatcgtgagctgcgtgagcggcatggacgcgccggtgaagccgtacgcgctcaccaagcgccgcaacacgacctacctggccgggctcgatccgcatgcgcgcgaggagcgccgcgcccagatgctcgccgccacgcccggtgagcttcgctcgctcggcgccgacgtaacgcgcatcgcagccgagtcacccacctgcgtctttggcggccgcgacgtcatcgccaagagcaacgccggcttcaacgtcatcgacctgctgggctaaggcacggcaagcaaaactaccacgaagggcgcagttcacaggcgcccttcgtggtagttcgaacatttgttctatacgcacacatgttctatagtagaggtgcttgcatcgaactgaaattgcaactagaatatagttgcagaatgtgaggcgggatgactcgatccgataaactcatcgcccagctgcttagctgtccttcaacgtatagatttgctgactttcttaaagttatggcttcatatggctttgaaatggacagcaaaggcaagacgtccggatcgcgcgttcgcttctacaggccatcagatggcaggatgttcgtaatgcacgcgcctcatccatctgacgaattgacagcggggaccattcgaaacatcgttcgctttctgcaagatgtcggaggtagtcatgagtaacgttttggcatacaaaggttatttcgccccggtcgagttcaatgccgaacagcatgtgctaacaggtatggtcgccggcattagggacgcaatcgtatttgaaggctccacggctgaagaagtggagcaatgcttccacgacgccgtcgacgattaccttgagttttgcgccgagaagggcaaggaacccgagcgggcttttaagggctcgttcaacgtaagaacgggctctgagctccacaagcaagcagcgctggcagcagcaaagaagggtgagtcactcaataagtttgtgactgaagcgatcgctgcggcgctgtgaagccaacgtcgagtcgaagccgccacacagggcgcctttgtggcggcttcgacgtttgcccagataaaacccgccaaaataaacctgtccctttttggcaggtttgctagaggaggctgggatggacaaggctgagttgcggcgggcaatgattgctcggcgcgacgatctcgatttggatgtacgggcggcgaagtctgctgatatctatgcgcggctggttgagctgctgggccgcttggatgccgcggcgccgcacaccgttgccgtctatgccgcgatgggttccgaagtcgacccagccgcgtttgccgcagctgccgccaaacgcggctggcgcgtagcctatccgtgcatgctctcggcaattgatgccgcagcttgtggccagcgcatgtgtatgcgggcagttgccgccgacgatgcgtccgcggctccgtttatcgcccaccctacgcgggcctttgcggccacggacatcgacagcaaccacttccctatcgtgcctgccgaagctctcgacatgatcgtcgtgccgctcgtggccttcgaccaaaccggagcgcgcctgggctacggcggcggttgctacgaccgctacctgcccatgctctcgcccgcatgccaaatcatcggcatcgcctttgacgagcagcgtgtcgaccgcgttcccaccgacgctcacgacctgccgctaccccacatcatcagcgcctaatcgccgccatatcagccacggctacagcagtaccatcgcagcctagtgctcctcgccggcgcgggccaggtcgtagggcgtggtctggtagacgtagtagttgagccagttggtgtagaacagctgagcttggctgcgccagacgttgcgcggctcggcggaggggtcgtcacccggaaagtagtgcgccggcacctccgggttgagcccgcgcttcacatcgcgctcgtactccaggcgcagcgtatcggtgtcgtactcgggatggccaaagacaaagaagcgacggctgtcggtcgacttgacgatgtacaggcccacctcgtcggacacggccacgacctcaagctgcggctcggcctccacgtcctcgcggcgcacgtcggtgttgcgcgaatgtacggcatagaagcggtcgtcaaagccgcggaccagcgggcttttcggcttcactagataatgctcgaacacgccgctcgcctttgccggcagatcgtacttctggataccgtaatgatggtacaggccggcctgcgcgccccaacaaatgtgcagcgtagagtgcacgtgcgtggtggaccaatccatgatctggcagagctcgggccagtagtcgacctcctcgaacggcatctgttccaccggcgcgcccgtgatgatcaggccgtcgtagtggatgtcgcagatgtcgtcgaacgtgcggtaaaacgtctccagatggccggcgctcacgtgcgtggcctcgtgcgttttggtgcgcagcaggtccacctccacctgcagcggcgtgttggagagcttgcgcatgatctgcgtctcggtggcaatcttggtgggcatgaggttgaggatgagcacgcgcagcggacggatgtcctggtgcagcgcgcggtactcggtcatgacaaagatgttctcgctctcgagctgcgcggcggcagggagggcgtctggaatgcgaatgggcatggatgctccttacgagtcagttgcagctatggtacaacgagcggccccattcgcgcgagcacatcgcccagcgatgccgccaacggcccaaaacgccccaaaagtagaaattaaggcatgtctctaaaatctgctgcactttagcctagcaaagtaacggcaggacgctacaatgtttcaacgcgaaaaactcggccgaaaggatactcatatgtaccagacgcgtaagatcggtgtggtcggccagggccacgtaggagcacatgtcgccaacagcctgcttatgcagggcattgccgatgagctgtacctgtgcgatatcaacgaggccaaggtgacgtccgaggtccaggacctgcgcgactccctttcgtttgtcccgtataacaccaagatcgtcaactgctacgaccactacgaggagctggcctgctgcgacgtcatcgtcaacgccgccggtaaggtcgcactggccgccggtaaccgcgacggtgagctgttctttaccaccgacgccgcccgcacctttgccaagcgcatcgtcgacgccggcttcgacggcatcttcgtgagcatctccaacccctgcgacgtcgtgtgcaccgagctgtggcacctgaccggctacgatcccaagaagatcatcggctcgggctgcggtctggattccgcacgcctgcgcaccgagatctccaagaaggtcggcgtgagccccaagtccatcgacgcctacatgatcggcgagcacggctttagccagctggccgcctttaaggccgcgaccatcgccggcaagagcctgactgagcttcaggccgagaaccccgacaagtacgccttcgaccacatggaggtcgaggagctcgcgcgcaagggcggctatgtgacctaccagggcaagcagtgcaccgagtacgccgtcgccaactccgccgcgcgcgtctgcgccgccgtgctgcacaacgagcacgccgtgctttccgcctccacgctcatgaccggccagtatggcgaggagggcatcttcacctccctgccgtgcgtgatcggtgccgagggcgtcgaggaggtctacacactcgacctgtccgagcacgagctcgagggcttccacaagagttgccagcacatccgcgacaacatcgcccagctcgactggtgggataccgaagcctacgacgcaaagtagggcaccgactgccgcaaccttgcgaatctaagcacgatcccaagcgggccgcgccggaaacccccggcgcggcccgcttttttgactcatgcggcacgcttgcaaatttaggtctaatacttttccgaccgaacaaattcggccgccacaacgcaaaacggggcccgcgctcagcgcagaccccgccaaaaaagataattcccgttacttagtactgctcgatgcccatgtagcggcggtactcggggctgtggtcgaagaccttgccgcgggcggcgcgcagctcgcagctcattgcgtagaagaagatcggctctaggaacgagcgcacgctagcgggcacctcgcccacgccgtactcgagcgcatcgagcaccatgagcgtgtcggtatgcgtgttgaggaacgcaagcgcgcgctcctccatggggcggcactcgcctgcgccgagctgcacaaagtagaacacgccgggctcggtggcctcgaaggggccgtggaagtactcaccggagtggatgtagcagcagtgctgccactgcatctccatgagcgagcagatggccatggcgtaggtctggctaaagttggggccggaacccaggatgtagaagaacttgtgctgttggcagagctcggcaaagcgggcgcccagctcggcgttgaccttctcgcgggcggcaggcagcagcgcgtccatctgcttaagaccctcgtacatgtcggcgagcgcctcgtagccctcctgctggtcgagcagctcggcggcaatcagagcaccgatgccctgcggcacctcggcctgcgacacgccctcaccccacgggtaaacccaggtggtccacttgccgctatcgatcttggagccctcgcagtcggtcatggcaacgacctcggcaccggcagccagcgccatctcgcagccgtcgacgacctcctgtgtgttgccgctgtggctgcaggcgatgacgagcgacttctcgccgaggctcttaggggccatcaggcagaactcgcgcgcagtatagaccgtggaggtaaacgtggtggcctcgcgcttgagcagctcgttggccggcatcaggtcgatcatcgaaccgccgcaggcgatccaaaagacgttctcgatcttacccttgcgctcgatgatttcctgaaccagatcatgtgcgttcatactgatgttcctccttgtgtggcaactttagacgacagctcgtacctgcggtcgttctatgttgtcctatttataccacgcaagcaatcgctcggaaagtcatttcggcaaatttgttctatgttgttctatctatgaacgttagatgtcgaacacgtagcgcgagcccacgatcttttggcgaccgagcagcagaggttgctcatcaaaatcggtaaagtacgtctccatgtagaagagtggctcgccgatcggaacctcgagcagcggggccgcctgagcatcggcaagcgcaatctccaccgtgcagggatcggatttgagcggcgaacgacccgaatgctcggcaacaagcgcaaagatggaattgtccgtgaggtccttgtcggcaagcgtctgcagatacggatggtcggcaagcacaaaggcgttgttctcgagcatgacggggacgccgtcggccgtacgcacgcgctcgaccacgataagctcgcagccgggctccacgccaaagaatgccgcatcctcgtgcgtcgccgcgaccaccgtgcgcgacaccaggcgcgcgcccgccaccatatcgttggcggcacagccctcggtaaagctctgaacatcgcctttctggacaatcttgcgcttgagcttgggagcgcacacaaaggtacccctcccctgctggcggctaagataccccgcgcgcgacagctcctcgatggcgcggcgcacggtgatgcgccccacgccgtaggacttcgcgagctccatctcggatggaatgcgcgagccggtcggatacacgccacgcgcgatctcgccctttaggtcatccataacctgctggtacagcggcacagcggacacctcagtgcgctcggttttatcgtcggatgccatcgttatgctccattccgtgcatgctcggactcaaactcttcaatcgccgccataaactgctcgccaaaggcatcggcctttttctcgccgatgccgttgacctggataagctcatcgcgcgtctgcgggcgtaggcggcacaggccgcgcagggccttgtcggagaagaccatgtacggcgccatctccagctcggtcgagatctccttgcgcaaggcgcgcaggcgttcgaacagctcggcgtcgtcgcccacgcgcgggcgctgatccagctcggcctcctcgcgcagcagatccaccgcacggcgggcgcgggccgaggccttgcgcttggacgcgcgacgcttaacggtaaaggcgaacgcctcatcctcgacctcgacggcacgcgggcccagcccaacgaccgggtactgcccctgcgaggtggccaaataaccgcggccgcacagctggccgatgatgtccttgatgcgcccgaccgattcgcttgacagctcaccgtagccgcggtcctcgtccagatgcatctggcgaatgcgctcggtgttgccgccgtggagcacgtcgacgatcagcgacttgccaaagcgcatgggacgcgtggccacatagcgcacggcagcgcgggccatatcggtgacgtcctcgacatcaaactgcgtgaggcagttgctgcagttgccacagccctcggcgtcgtccgtggcggcgccgcccgcaccagtcgctgacgcatgctcggccgcggcctcgtcgccaaagtagcgcagcatgtattcgcgcaggcagccggtggtattgcagtagccctccatctggctgagcagtcgatatcgattctggagcgcccacgcgcgctgctcgtcgtcgagcgcctcgtcggcagcatcgccgcggtcgatcaaaaagcggcgcatgcgaaaatcgttaccgttccacagcaagtggcagctggccggatcgccatcgcggccggcgcggcccgcctcctggtagtaggcctcgatgctctcgggcacgttgttgtgaatcacgtagcgcacgttaggcttgtcgatgcccatgccaaaggcgttggtggcaaccatcacctgaatatcgtcgtcgataaaggcgcgctggctttgacggcgggcgtcgttgcccatgccggcatggtagcggcccacgcgaatgccgctaggtcccagcgcctcggcaagctcgcctgccagcgcatcgaccgtcttgcgggtcgagcaatacacgatgccgctctcgctcgaatgcgcgatcacatagtcacgcacccacgcggccttggccttgtcgcccatctcctcgcagccaaagtagaggttcttgcgatcgaagcccgtcaccaccgtcgcggggttttgcaggccgagcatctgctgaatgtccgcacgcacgcgctcagtcgccgtagcggtaaaggccgccacgatggggcgctgcggcagcgaatcgatgaactcacgaatctgcaggtaggcgggacgaaaatcctggccccactggctcacgcagtgggcctcgtcaatggccacgagcggcacgccaatgccgccttcggccgcagcttcctgcgcaaaggccagaaagcgcggctcgagcaggcgctcgggtgccacgtacataagctggtagcggccctcgcgcgcccgcttgagcacggtgttttgctgggccggagtaaggctggagttgagatagctgggtcgcgcgcccgccgcgagcagcgcgcgggtctggtcctccataagcgacagcagcggactcaccacaaaggtgatgccgggcatcatgagcgcgggcacctggtagcagatagacttgccggcacccgtgggcataacgccgagcgcatcgcgaccggcaaggatcgcatcgaccatgcggtcctggcccgggcgaaacgaggtgtagccaaaataggcgccgagcgtgtcgagcgccatctgctgcatgctatcggtcatggtttcctaacgtccaagtcatctgccgccgattatacgccgccacgcggaccggcgtcgcccggctgtcagccacgctcattctgcgggtaatcattggagacgttcttgaatgactagtcgtttaagaacgtccccaacgactaaggagtgtccccaggtgccggcacaaaaggaacgtccccaagtgccggcccggcaacgtcaatgttttggcaatgtcagcgaaagcccaccagagcgagcaaggtgccttgaaacaaggcggcattgatcttttgatcatgccgccgaagttgaaaggcagattgccgctctggcgggcttgcagcgtcgatcggtccgccgttcgtaagaacggcggaaccaaccctacatgaccataacgtagcgcgatcccacgtagtactgcttacccatcaggaccggctcgccattggggcccgtgaagccggcacgcaggttgagcagcggatcgtgcggagcaatgcccagctcggccgcctgctcggtattggcacgaacggcctcgaccgtgcggtagccaaccgagacaatcggcgttccgccaacacgctcgacctcggcaaaaatcgacttgtcctcaagatcggccgtcaacagctcacggtaggcgtcaaacggcacaaagatgttctcctcaaagatgggctcgccgtcggccgtacgcacgcgcttgatatgcagcagcagcgcatccttctgcaggccaaagaactccatctcgttttggcgcgccggaacgatctggcgatcgatcacgtgcgcaccggccttcatgccgttgccggcacacagcgcggtaaacgtctgcagcgtcgaggcgtgaaactggcggttgatgtgcggcgtggagacaaaggtgccacggccctgctgcttaaccaggtagccatcggagcacagctcctcgacggcgcggcgcaccgtaatgcggctcacgtcgtactgctcggctagctcaagctcggacggaatacgctccttgggtgcataaacacctttctcgatcgcatccttgatttcgtcgtaaatctgctggtaaagcggtgcatttttgggcgcaggcatatctaatcactcttatcgaaatatcgaaataactaatacgtatataacgtctagtttcatattacctcataatgataaaacgatacaccctccctaccaaaaagcgacagcttcattttggtaggttttatctgggcaaacgagagcctctcgaaagcaacggggctttcggggggctcgttcggatgggttgcgcaggaccggcaaaatgccaataccctacttgccgtcgtcctgctgcaggctgtcctgttcgctgaggcgcgcctgcctgctggccatgcgtgcgggcttgtcgggatcgggaacggccgtgggcatgggctcgtcgacatgaccgccccaccagccgcccacaaagttgagcgtgtggaacacattgatcacggcgccggaatcaacgtcgcacaccagcttgataatgtcctgactctcgtaggtcgagacaacggtgttcagcaggtacatcttttcgcggctatatccgccgacgacctcggcgcagctaatgccgtgctgaaaatggtttacgtaggcagtcatgacctcgtctgccctacgcgtcgtgatctgcagcgtcacgcgatcgtagcgacgatagaaactgtcgatggtcttggtcgaaataaactggaacacgatggaatacgccgccttgtcccagccaaacataaagccaaagatcgccaggataaagcagttgaaaccaaagatgacgccccagatggtcttgcccgtgtggttggaaacccacagcgcgataaagtcggtgccgccggtggatgcgccggatttaagcgcgatggcagcgcccagacccgagaccacgccgccaaaaatgatgagcatgatcttgtcgcccaaaaacggcgcgaagtgaaagacgttgaggaacagcgatgagagcacgacctgcatcatcgagaagatgacgaagcgcttgctaatgccgctccagcataagagcgccacggggatgttgagcgcgagcatgccgagcgagatgtcgatatgaacgccacccagcgaggtaacgcgatcgagcaggaccgcgacgccggtaagaccgctcggaagcaggtcggcgggctgaatgaacgcctggatcagaaatgtctggagaacggcggaaatggtgaccgccacagcagtaatggcgcggcggacgatggtgaggcggccgagcacgagcactcggtccgtgagctgatcgatggcgttcgccacgtaggctcctttcgaaggcagatgtggttgtggggcatgcccgcgattgtagcatggagcgtgcgggggcgcttcaattcaacctccctcgacaaccaaaacgggaccagcaacccccacgaccaaagggcaaaattccaagtgagtagactttttacgatctgccgagcacacccaaaaccgccacccctgtgacctgcggttttacaaaggaagatatgcattgtgctcggcctgcgccaaaaagtctactcacttagtccgaatcgaagccaaacggatcaaaatcgaaaccaaattgagccagtccaccgcaaaaaacgtttgaacccgtgcttctcgcggcggattgacactacaaagcggccaaaatgtcggtcagattatcaataacggcatcggctcgcgattgatcgaggttgacgccctcgtgcggacgcagtgccaggacgcgggcgccggaacgtttgccagcctcgatccccaaaggcgaatcctcgataaccaggcactcggcaggctccacccccagcgcctccatggcacgcaggtagatctcggggtcgggcttaaacgcactgcactcgtgaccgctgatggtgtagtccagcacatcggcgataccggcaatctctaccagctcgtcaatgagctcacgataagacgagctcgcgatggcacacttcacgccgcgctcgtgcagtgcgcgcatcaccggctccgtctgctcgttgagcagctcggcatacggaacggggtggtccgggctgtagacctgcttgtactccacgcgaaggcgctcgcgcagctcaacatcgtcgggcaccagcgcctcccaaatggccggctcgttagaccccgaaagatcggggatctcgtcaaagtggaaccccttctcctccataaacgccacgcgacgacggttgtagaaccactcggtatcgaccagcacgccgtccatgtcaaacagcactgctttgatcatacgcatctcctcccacctgccaaatagagacaggtttattttggtaggttttatcctgggttttgcgacgcgacaggcgtgccctcccaagagcaaaaaaggggacggggcgcaaaccccatcccctctcaatcaacccgtaaggtctacttacttgtgattagtaggaaagcttccacatgtagcgacgcatggtcagcgggtgctgacgggcctcggcgatctggttgccgtactcgcgcataacggcgaggtgcagcagcgggttgaagtaggtgacgacgctcgcgggcacggcgtcagccaggccgtagtccttggagtcgatcagagcgaccttggcgcccatgcgctcaaggaaggtgagggcgcgggcgtccatcggacgggtagcgccatcggacatgaagaagacgtagggcttaccctcggtggaaacctcgaacgggccgtggaagtactcgccggtgttgtaggcggcggcgtcgatccactgcatctcggtgaacaggaaggcggcgtgagagtaagccatcttctcggaggcaccagaggccatgaagtaaatcatcttgtcgtccttgaagtcctcagcgaacttcttggcgagcttcttgcaggactgagcagcgttctcgcagagatcgaagacgttggtgaggccggtgatcatgtcgtcgtacttgtcatagccctcggtctgctgaaggatctcgagagcaagagcgatggcatagccgggcttctcgcacttggcagcgaagttggcgtggaagccgtgaacgatgacgtagtcggcgtcgacggtcagagcggagccagccttgttggtgagggagacgaccgggcagttgtgcttcttggcggtcttgttggcctcgacggtctcgggcgtggagccaccgagggagcaggtgatcacgaaggtgtgctcgttgacccaggaaggcgtgtcatagttgaactcgttagcggtgaagatctgaacgttcagcttgtccgtgttgttggccaggaagtacttggcggggtacaggtcggacatggaagcaccgcagccgacgaaggcgacactgtggatctcgtggttggacaggacgtcagcgacgatctgcttagggaggttaaggtcgatctcgtacatctgacacattcctttcgatttttgcggcgccacattgccgggcgctcgcagggttaccgtgatttggaccgagtcgccggcccgttgaggatgcgacaaagggactgtcccattgtcgcattttggggatggaagcctgcctggggtatgggatgccaggcaggcccccgggggaaagcggttaggcgcttggtcgcgactaggccagaatgccggccgcggagagggcgatgccgcccacgatggcgatcgcgagaagccaaccggtgttgacgttcttcttgatgagccagtacataaggccggtgaggccgagggagatcatctggggcatcatgccgtccaggatgtcctggataacaacggtgccctcagcgaactgcagcggggtggtggcgccgatcagcgtagcgatcatgccgcccacggacataaggcccacgatgccgcagacatacatgagcttctccatgaggtcgccgccctgaagcttgctcaggtactcgtggccgccctgatagcccatcttggctgcgaaccaagtgatcagcacagaggggacgatggagatgagcatggccaggatcgggcccatgatggagccctgctgagccagctgaacgcccaggccaaaagcgataacgcggatggtaccctggaagaaggagtcaccgatgccggaaagcggacccatgagggaggtcttgaccgcgttgatcgaatcgggatcgaagttctcgggatccttggcgtactcctcctccatggaggcggtgaggcccaggataaaggcgctcgtctgcggggtgcagttgtagaacgccatgtgacggtggtaagcctctttcttagcagcgagctgcttggggtcggactcgtccggatagaggcggtcgagcgtgggaaccatgccgtagaggaagcccatgttcatctgacgctcgtagttccaagaggcctggatggcccaggagcgccagaagaactggctgaccttcttgttcagggacacgtccttggttgcggttgccatagtgtgttcctccttagtcttcgtcgtcttcgagcggatcgtagtcggaatcgacaccggcggctgcatgggaaccgttgaacttgaagcccatgaagacgacagccaggcacacaccgatcagagcgaccgcgatgacggacaggttgaggtaagcggcgagcaggaaaccgatgaacaggaacggagtcatacccttcttgatcatcatggtgagcagcagggccaagccgtaggcggtcatgatcttggtcgaaacgttaagaccagtggacagccactcgggaaccatgttgacgatggcctgaaccaggtcggtgccaacaaagacggcgaggaagatcggcaggaagtacatgatggcgtacagaccggagccggcgcagatgtgcatacggtaggcggtcttgaactttccgttatcgatcgcgctatctgccacatgggtgagggcggcgatgatggaacggaacacgatgccgaggagctgacccaggacggcgaccgggatggcgatcgtcatggcggtctcggcggaagcatcggtcaggcacgcaaaggcagcggccacgatgccgcccaggaccatatcgggcggaacggcggcgccgacctgcaccaggcccatggacacgagctcgacggcggcaccgacggcaaggccggtgggcacatcgcccagcagcagaccgacgagcgtagcgccaacgaggggctgctcgaagttaagacgaccgagcaggcgggagtcccacatgcagaacacgccgacgaggccgacgagcaccgcactgatgaacgtattcatacccttctcctttcagtcaggcaaaagcctggttgattacagcttggcgtcgatgtcgacgctctgatacgtaggggtctgctggacatagagcttgatgcccatgtcgagcagctggttgacgtcggccttctgggtggcgtcgaggaagacggagctgtccttgccgccgacctgatcggcaccgtcgtggttggcggtggcgcccaggttgatggcgtcgagcttgtagccctgacagaactgcagcatctcggcagtgttgccaaagacgaacatgacgcgctcgccgagggtgttgagcttatccatcttggcgagggcacgctcgacggtgaagacgttcaggcgcacgccctggggcttggccagcttaagagcgcccttcttgatgtcatcgttggcggcagcgttgtcgacgacgatgatgcgctcggcctgaaccttggtggtccaagtaaagacgacctggccgtgcagcagacggtagtcaagacgtgcgaggacgatcttggcgggaccggagctgtgacgggacgccttggccttcttggcgggagccgcggcggcctcgaccggtgcgttggggttggtcagaccggtgcgggcctcgttgatgagggccgcgagctcggcgcccttgacgggggcggggctcatagcaagcgtgagcgccaacgggatgttgaaaccgctgacaaccgtgaacttcgtgccgttcttggaaagctcgaccatgttgttgttgaccgagctgccgagcatatcggtcagcacatagacggtgtcgtccgcgttgaacgtggcgatcatagcctcaaccttattggtgatgggctccttgtcgtcacgagcaagcgacacgacgtggacgttcgacacgtcgccgagaaccatctcgagcgtgtctttggcgcctgcggccaggccgccatgagatgcgagaatgatctgattcatcttgcctcctccttttcgttatggtcattataacgtcttatacgttgcttatattgctaattagtataaagaccgttcgcgggtgaaaatcgaccgttgacgggtttaacgtactcgaaacgttgggctgggtaggccggcgctagctggataaccccaggtcagaccctgcgcgcaatcccctatcgcacgaagtaccaggggctttcctgtacggtgggttccagcgcaatgccggtgcgttctttaaacagatccatgtcctgagatttttcggtccaccacgcgttgggcttaaaggtcatgctctcaatgacatgaccgacaaacacactgttgcgcagcttggagaagtcggtgttcataatcaggatggacgcgagcaccaacacgatgcccaggactttaatcgcgccggcgggctcggcgtagacaccaatgcccaccagtacggtgacgaccgtctcgaaagacattacgacgggaactttcgatgtctcgagccccatggacagaccctgcatatataagatgtaagcaacggctgtggggatgagtccaaagccaaggaacagcagcagcagctgtggcgacattgccgcggcgacatccggccacggagccgcgatagctgccataaccgcaccgccaaaaacaaagccccaaaacgtgacagccagcgggtggaccgtcttggttgctattcggctaaacaccgcgagcgacgcaccacaaaggcctgcaatcacgcccgacgtgacgccccaaaccgaaaaatgaaaaccggaaaggtcgccattggtcactgcaagcacgcagcctacgatgttaaagacaatggcaacgagcttgttgggggtcacgtcctcgcgataaagcacgcggccgagcatgacgccaaacaccggcgaggtgtagagcagcaccgaggccgtggacatgcccacctcgcccatgcactcgtaatagcaggtgttagcggcggccaaaccgacgatgccaacaagcgcacaaggaacaagctctttagggcttgccttgaacagggccagcggaccctgagccacggtagacccctcacccggacggcagcccataaacatcaggaccggcgccaagataagcgctccgaccaacaagcgaaaggcagccatgctctgggacgaaacgcccatggccgagatgccgtttacaaagattccgatgctgccccacataagcgcggcgatcagcaccagcacatagcccagattgctcttcttcaacgcagcctcctcggtattgtttccaatatgtttcgtactacgttatagtcgttatatacatttttcaagacacaaatcggcgagcggataagtgatccgttttcctccgcccccagcggattactgggcggttgcggtgaaatagttcctaaatagaggcttcaagcccccaagcaggaactattccaccgcaacttatgaggacatcgagctgttaggccgctctatcccctagtagtccagcttccacatgtagcggcgcgtcatgtagtccttgtgggtgacggcagagagcgcacgcatgtacacgttgttgaggatcggggcaaaaatcaggtgattgaagtactcgctcacgctgtccttgacgtcgttgaggccgagctccttggcgtcgagctgatagacgcgctcgccaccgtactggttgacgaagcggatgccgcgctcgtcgttgcagcggctgcggccgacgctgatgagctggaacagcgaggtgcgcttgtccaggatctcgaaggggccgtggaagaagtcgcaggtgttgatggtgcaggagtcgatctgcagcatctcctgcacgttgcagatgctaaagacgtaggcggcaccaaagagcggaccctgagccatcacgttgatgcagggcttgtcggcgttttgctcggcccacttggcggcgagcggacgggtgtactcgacggccttgcgatagatggggtcaaccaggtcgaaggcggccatagcggtctcatactcggcatagccctcggtctgctgcgtaagctccatggcgatcatggtcacgacggcggagttggtacggcccatgcaagactcgtcgacggccaggctgtcatactgaatcttgtagtcgcagacctcggtgaggccggactcatcgacatagatggcgatggtgctggcgccgtggtccttggcgacctgggcggcgacgatggtctccttggtgccgcgcatggacacgacgacggccagggtgttctcgttgacataggcgggcgtggcgtgcacgaactcattgctggtgtagctggagctcacgacctgcgtggcctcgtgctccataaagtactgggcaggatagttgccgccgttggatccgccggcgccaatccacacgacgcgcttgatgccgcccttgtctgccttgtcggccaaaacctgggagacgacgtccttaacctgttcctgagtagtcatcgtgcatcagcctttcttctcgtttgatgctctcgatggcatacaagttacatacatgttttggttatgtcgactagttgtatgctatatttgtcttaaaaaatttgctgatacggttttcgataacttgataccagcggttttgttgttgtattgaatacatgcttgattagatacgcatacaggttagatacaggttgatcgcatgaacgcttcatctaaaaagagactgacccaatacgagcgcttggcgggcatgctgcgcgaccgcatcgcctccggcacctacgcgcgcggagacaagctgccgtccgagatggaactcatggacgaatcggggctgtcgcgcagcaccgtacgccacgcccttaaggtgctcgttgatgagggcctggtgcgcaccgagcgcgggcgtggcgcctttgtggccgacacgccggcgctccacgagaacaacctggtgttttcgagctacacgacacaggtccagggtcagggtatgaagcccaccacgcgcacggtggactcgggctttgccaaggccgcgggcaatgcggccaagttcttcgatgtcgccgtgggcagcaagctcgtcaaacttgtccgcctgcgttatctggacgatgcgccgctgtgcctggagaccacctatctaccaccgagctttgaagcactcatcgatcgcgatatcaacggttcgctctacgccacgctgcgccaagaattccatcgcgcgccggcagaggggcacaagacctttgaggtgtgctatgcctcgcaaaacgaggcgtttttgctcaacgttgagcgtgggcaggcgctgatcctgatcaccgactacgtctacgacaccgacggccgcccgctccatgtctccaagcgcatccaacgcaccgaccgcgccaaatacaccgagcccatcggctaacctgtccctaaaaggtaggtttggggaggtcggggaaccaggtcggtttgggttggttgggcgtgcgctcggctaggaccaactccatccagcacatgtcgtaccagcggccgaacttttgggcgcagcgatcgaaggcgcccaccaggcgataccccatatgggcatggaagtcctggctgttgtgcgtcaggtactcgtcgtccttatcgtgcggcacggcgatgagcgcgcacatgttggtgatgcccatcgcaatcaggcattgcttgagcgtatcgtgcaacttgcgacccagcccgccatggcgcacatcgcgtgccaggtagatcgacgtctcgaccgaccagtcgtatgcctcgcggctgttgagcggactcacataggcatagcctatcggacgcccgtccagctccatcaccaggtacggatagcgcttgagcgtacgctcgatgcgcccggcgaactcctcaacgctcggcacctcgtattcgcaggtaatcgccgtctggcgcacatatggctcatagatggcaagcaacgccggcgcgtcttcgggcgtcgccaggcgaatcgccggctcggacatctcggtcatacaactcttctcccccaaaagcaaaggccgccctgcgccaaacccagcgcagggcggcccctcgtcattacatcaggctacaggacagccgccagcgcgtcgatgtcctcctgcgtcgtggcccagctggtgcaaaagcgcactaccgtatgagtatcgtcgtacttttcccagtactcgatcgccgcatgctcgcgaatgcgggccatatcctcgttgggcagaatcacgaactgctggttcgtgggcgtctccaagaagaactggtagccgcgctcgtgcagcacacgacgaagcgcctgagcggtctcaatcgcctggcgaccaatctcaaaatacaggccatcggtaaaaagagcctcgaactgcacacccatcaggcggcccttggcgagcagtgcgccatgctgcttaatacgcggaatggggtgcgccggggcgtgcatgccacagaacaccacagcctcgccgcagagcgcaccacacttggtgccgccgatgtagaacacgtcacacagctgcgccagctcgggcagggtaatgtcgcactcatcggccgccagcgcataggccaggcgagcaccgtccacaaacagcggaatctcgcgcttctggcacaccgcgtgaatcgccgcgagctcggccttggagtacagcgtgccgtactcggtcgataggctcacatacacggcacccgggaacaccgtgtgctcgtagctctcgttttcgtagaacacctggatatagttctcgaggtcctcggcgtgcatcttgccctcgtagccggggatggtgagcaccttgtggccgccaaactcgatagcgcccgcctcgtgacaggcgacgtggccagtctcagcagcaacgacgccctcgtagggcgcaagcagcatgtcgatcaccgtcgcgttggcctgcgtgccgcccaccagaaaaaacacgtcggcatcaggggcctggcaggcctcgcgaataagttgcttggcgcgctcggtgtgcgcatcggtaccgtagccgggctgcggctccatattggtgtcgacgagcgcctgcagcactgccggatgtgcgccgtgggaataatcgttgttaaacgcgagcatggcaatcctctcttaccgggtatcggccagatgattcaaacggagctattgtacgccgttgggataggcaatgcgcgcggcaaggcactcaagtgccagtaccagggcaaaaccgcagctcacgtcgctcaaaaagtgtgcaccgatcacgatgcggccaagcgcgacgagcgccgcgaccacagccgccgcccaaaagatcacgcggcgacgcgaagatttttccttaaaggctgccgcgggaagcccggcgagcataaggccaatcgccgcatgcgccgtgtgtccgctcgcaaacgacttaaagccgtccttgactacaccggcggcaatataggcccacttgtcagggttgccgatcacccaccacggctgaaactcgagtccctgcgtcacctcgatcacgcgcatgcgtgggcgcgaccacagcggcttgacaatcacgttgaggatgatggcctgagcgacccacacgacaagcaccatcaacgcccagcgcgtgagctcgtcgggctcggtcgtgcgcgtgagacgatagacgataagattggcggcgatgaccagcacaaacgtcagcaccaactgagccgcgatgagtttgccgccaaccctcagggacgaaacgatctcgtagccgagcaggcccacgttgatgaggatgccgagcacggcgagccatttgctccccctggagtcgggacgcaccgcgcgcacgagcataacgcccgcgatgctcgccgtcagctcaaacggcagctcgccggccgcctcgataaagcgaccgtacatgctgccgatattgaacagcgcgctcgagatctgataatcgaagaagctgcccacgcccagacaaagacacaggacaaccgcgataatggcgacatctttcttatagatgtatccgaacatgctttcctttcgatggagccagattgcccaaatggggcgtttgcagcgtcgacccgttagtcgtcgtcgctggcacccagctgttgcagcagcatgagcgcggccgccacggggccggtgccgtcgttggcgtcgagaccgcgacccaggccgctgcccgcgccggcgcccgccttgtagggcaccgatagcttgcggctcttggggaagttcaccgcgccatagcgattcttgaactcaaaggccaccttcttgggaacgtcaacccccaagaaggtaatgcgtccaccactgagcgtgacgctctcgagccccaggcgctcgccgcgaatacggatgcgcgcgcggttgaacaggttgagtcccgccaacggcagttcgccatgcgcggcctcggtctcctcctgcacctcgtcgatactctccaggtcctcagccgcagcgagcttgcggtacacgagcacgcgctggtccaccgccggcatgtactcctcggacaagaagtagtcggccggcaggttaatgcccacgctcgccgcctccacgccggcatcgtcgtcgccgcgcgcctcggccacggcctgccccagcatctgcgtaaacaggtcaaagcccacactcgacaggttgccgtgctgctcggcgcccatgagcgagccggcaccacggatctccaggtcacgcatggcgatgcgcatgccgctgcccaggtcctgaaactcggaaagtgcggtcaggcgtgccgtagcctcctcggtaagcggcagctcgcccgggaacataaagtacgcataggcctgcgtggcagagcggcccacacggcccttgagctggtagagctgcgccagacctaggcgctgcgagtcctcgatgatcagtgtgttggcggtcgagttgtcgatgccgctctccacgatggtcgtggcgatgagcacgtcgatctttttggtcgcgaactcgatcatcacgtcctcgacctcgcgcgggctcatcttgccgtgtgccacacccacgcgcgcctcgggcgcggcctcgtgcacgcgcgccacggcgtcgtcgatagtcttgacgcggttggacacgtaatacacctgaccgccgcggcccacctccaggcgaatcgccgcactcaccacgtcggggtcgtactcccccacgtgcacgatcacgggacgacgcccggtcggcggtgtggtgatcaggctcatgtcgcgcacgccgctcgtggccatctgcatggttcgcggaatcggcgttgccgaaagcgtgagcacgtcaatctgctcgcgcaggttcttgagctgctccttgtgctgcacgccaaagcgctgctcctcgtcgatgatcaccatgcccaggttcttggggttcacatcggccgaaagcaagcggtgcgtgccgatgagcacatcaatcgtgccctcggcaaacgccttaagcgcacgcttctgctgcgccggggtgcggaagcggctgagcacttcgacctcgaggccaaacggggcaaagcgctcaaaaaacgtctcgtagtgctgctgggccagaatggtcgtggggcagagcaccatgacttggcggccggagtccacgcacttaaacgccgcgcgcagggcaacctcggtcttgccgaaacccacgtcgccgcacagcaggcggtccatgggcttgggcgcctccatgtcggccttgatgtcggcgatagcctccagctggtcgcgcgtctcgtcgtaggggaagctctcctccatctcgatctgctcgggcgtatcgggcgggcaggcgatgcctgcgatcgacgagcggcgcgtatacaggtcgaccaggtcaaacgccagctttttggcattcttgcgcgccttattggtggcacgcgtccagtcggcagtgttgagcctggtcaggcgcggcttgtcgccgtcggggccaacatagcgtgtgatgcggtcgacctgctcgagcggcacgtagagcttgtcgccgtcggcatattccagcaaaaagtagtcgcgctccttgccgcccacttcctggcgcgcgatctcgctaaagagcgcgatgccgtgggtagcatgcaccacgtagtcgcccggcttaaacgggaaggtgatctgcgtaatgtcaaccttgcggcggctgcgcgcgcggttggcatccatgcgggcattgaggtcggcgatcgagaacacggccaaattggcgtcgggcaccaccacgccctgcggcagggcagcgtccacaaaggtcacgcgcccgcgcgagatggtgggcacggcagcgccggcggcagcctgcgcggcgcccgcctcgagcgagcgggcgttgagcgcgtcggccttacgctcgcgaatggaagcatgggcctcctggcgtgcggcacggtcggcggaatccgccgctgccacgcgaacgcggtcgccgatagcgccgacattttcgggcgccgcggtcagcgattcctcaaaggtaatgctctcgtcgccaaaggtgagctccatcgactcgcgcgccccgcggtcgggaatggcaaacacgcaggcgtagcgcttgcccacgacctcctggatgcgcgtcataaaacggttgtccgatcctgcgatggcaggctgctcaatcttcagctcggccgtcaccgcaccaccggcgcgaatcaggctcacatagttcaggcgctgctgagcaccaaaatcgagctgctgggcacgtacatacaggccatccagtcggtcaatccccgcctcgccggcacgcgcctcgatatcctcgtaggcgcgcaggcagtcgtcgaacagcgagcgcggctcggacagaaccacgagcgccttgccgctcacgtgtgccagcgggctcacggtctggccgtacatcaccggcaaaaagcggtcgagctcgggcgtgacgatgcgtgcatccaccatctcgagcagcgccgccagtttgctgtcgtcctggctggcgcgatagagcgccacatgcatgttgtggacggcttcgtcggtaagcgccagctcacggcaggggaagatctcgatactgtcctcgttgccgatggtctgccccgttgagctcaccatgcggcggatgcggtcaatctcgtcgccaaagaactcaatgcgcacgggcgccttctcctgcgcgggaaacacctcgacggtgtcgccgtgcacacggaacaggccgggcgcgtcggcggcgccggcattggtgtagcccatgcccaccaggcgctgcggcacctcgtcaaaaggaatctcctcgcccgccgcaaaagtggtggactcccagtagtggctctcgaccggcggcacgcagcgcagcagcgcacgggctgaggcaaccatgatgcagttgtccccacgcacgatgcgccccaatgcctcgcagcgctgcgccaccacggcgtcgtcgggcgcctgctcgcgccacggatagtccttgcgctcgggaaaacgacacacgtgcgccaggcccacgtaggcggcaaggctacgcgcggcgcgatcggccgcatcctcgccgctcacgatatagaccgtcgggcgcggacggcgcgcaaactgggcggccgccataagcgtgcggcccgactgcgacacagccagcgtcacgtcctcgccagcatcgagcccggcctcgacggtctgcaaggcctcggcagtgtagagctgcgcggctatacggtgaatgagcatgctgttcctccggcattgcaacgccaaaagcccgccggggcaagctcggcgggtcgtacgtcaaatacattgtctgtcatggtaacgcatggagaggactccggttcaagggcaaacccagccccgcaaaaaacgccagacgaaaatgcgttccgccctaccccgccacgcgcacgctggggcacaaatccgccagcgggcactcgtcgcacttaggtttgcgggcgtcgcagatctcacggccaaaggtaatccactggtggttgaccgactcccaatactcgtgcggcaaaatcttgagcagatcttgctcggtcttgagcggctccttggcatgcgtcttggggctcagcatcaggcggtgtgcgatgcggttgacgtgtgtatcgaccgcgatgccctcgacaatgccaaaccccacgttgagcacgatgttcgccgttttgcgtcccacacccggcagcctgacgagttccttcatgtcggcaggtacctcgccgccgtaatcggcaacgatcatctgcgcggcctccacggcgtgcttggccttgctcttataaaagccaagcgacttgatggtatcggccacatcggccacgcttgcctgtgccatggtctcgggcgtgggccactgggaaaacagcttcggcgtcaccttgttgacctgcgcgtcggtcgtttgcgccgagagcaacaccgcgatcagcaggcggaagggattctcgtggtccaaaaagcactcgaccgggccatagcgacggttgaggcgctcacacacctcaacggcgcgctcgcgtttggcggcattggtctcgcgtggcataacgactcctcggctcaacggcacaataaacttatgggcacaattgtcccacgtccgagacgcttacacctccaagaatgcgccggtctgacggctccacaggctcgcgtactcgccacccgcctcgacaagctgcgcatgcgtgccgtcctcgacaatctcgccatcggccagcaccacaatgcggtcgagcgccgccacggtggacaggcgatgtgccaccacaatggaggtgcggccgcgcatcaggttctcgagcgcctcctgcaccagcgcctcggactcgctgtcgagggcagaggtcgcctcgtcgagcactagaatcggcgcgtcggttaggatggcgcgagcgatagccacgcgctgacgctggccgcccgagagcttgacgccgcgctcacccaccatggtgtcaaagccacgaggcaagcggtcgataaactccagggcgttggccaggcgcgcggcctcgcgaatctgctcatcagtggcgtcgggacgaccgtaggcaatgttttcgcgaatggagcgatggaacagcagcgcctcctgcggcacgtaggcaacctggcggcgcaggctctgctgcgtgcagcgcgagacatcctgaccgtccacgagcacgcggccgccctgaacatcgtccaggcgcagcagcagcttggtaagcgtcgtcttacccgagcccgatttgcccaccaggcccacgcgctggcccgccgccacatgaagcgtcaggtcatcgaacacgctctcgcccgccgcagcgtcacggtacgcaaagctcaggtgctcaaaatcaatcgcgccctcggtcactttgagctcaggggcgtccgggtcgtctgccaccaaacgtggctcgtccagcacgcgcgtcatctcggccgcatcgcccaaagcgcggttgatgcgctgcatcatggagcttatgtagttcaaacgcatggtgaggttataggtgtaggtaaagatcatgacgagcgagccggccgagatgccaaaccacgcgttgccgcccgccacgaacacactcaccacggccatggtgatgacgataaggcccgaggtcgtaaagttgcgctgcatcatggcgtgcatcgagaccgtctcggcatcgcgcgcggcacgatcggcggcgtcgaacagatcgcgttcaaagtcctcgcgcccgcaggtcttaacggccaagatgttcgtgaccgcgtcggagagcacgcccgagagcttgttctgcgcggcggacgtcgcggccgaaagcggcatgatacgcttgtacataagccagacaaacgcgatgtagacgaccatgatgcacaccaggatcacggtaaacgtcggcaccaccggggcgagtgcggccacggtgcagatgaccgaggtgatggtggggatgagcgaatacaccgtcacgtccaccagccccgtgtagccgctcataaaacgactcgtctggctcacgagcgatccgccaaagcggctggtatggaatgtcatggattggctggagagcgtgtcgaagcataggcgcgccaggtgatagttgcccgcgatctcgagcttgtagacggtgtagtcctgcagcttggagaggatttggcccaccaggttaacgagtacgagcgccaggatataggggccgaagacctcaaacacctggtcacccgccacgggaccggcttgaacgcggtcgacaatgagggccatcacataggtattggcaaacgtcagcaaaaagatgtagcccgccgacgagaacaccgagagaaagacaatcagcgactgcgtgcgcgtgacgccccaaaaccgctgcagcgtgcgacgcacggtggagcggctgagcgggctggcgcttctctgagacatgggcttcctttcgcatctgattgggcgaaacgccattgttgcatactaaagcgcacttcaggcaagtgcgacgcgaaaagcgcccgcgccccgcgcttgcgcaggcgccccgccgtcttgttgcaattagtcctcgtcttcttggtctgtgggaaggcccgcggacgtgagtcccaagatctcatcggcttggtcgacgtcttccagtgcgtcgatgtccttgagcttgcgctccatgacgttggtgcgcgtggtgatgatgccctcgaccgttttgcccgcggtctcgatctgctgctgggcgcggcgcagcgccttttgatagcgcggcagctcggccttgacggcggagagcacgcgcagcacgtcgtcggtacgtttttgcaacttaaacgtctgatagctcatctgcagactgttgaggatggccgccatggtgctgggaccggcaacgttgacgtgatagtcgcggcccagggtctcgataagcccggggcggctgacgacctcggcgtacagtccctcaaacggaacgaacataatgccaaagttggtggtcgcgggcacgctcaggtacttctcgcaaatgtcctttgcctcgcgcttgaccatggtgtcgagcgtcttgcgcgcagccgccacggcctccgcatcacccgactcctgcgcgtcgagcaagtgcccgtacgcgtcgcccggaaacttggagtcaatcggcagcagcacggggtcgccctcgtccaccggcagcttgacggcaaactcaacgcgctccgaggcgccgggcttggtggcgacgttttccagatactggtcgggtgtaagaatgtccgccagaattgcacccagctgcacctcgcccaaaataccacgcgccttcacgttgcccagcacgcgcttaaggtcgcccacgccggtggcgatggactgcatgtcgcccaggcccttgtacacggcctcgagctggtcgctcacctgcttaaacgatgccgacaggcgatcgttgagcgtgcgggagagcttctcgtccaccgtcgcgcgcatctgatcgagctgcacgttgttgtcttcgcggatggcacccagctgagcatcgaccgtctcgcgcaccttgtccaggcgatgctcgatgccctcgcgattggcgccgagctgttgggcggtctcgcggcgcagatcatccatccggtcaccggcttgcgagaactcgcgcgcgatggtcaggtaacgttgctgctctacggccgcatcggtcgtctgctgctgcgcgatggcattggccgtgcgacgggtttcggccagcgcgacgttcagggcatcgagcgctttgttagcctgctcgagtgctgccagcgtttccgcgctactgtcgccacgctcccgcaactcggcacgcaggctcttgagttggagggcgcaagccacagcaacccccaccgccaccaaggcgatcacaacaagcacaatatcaatagcagacataaactccgcccaacaaacccaatcgagcaccaatcaaaaccgcgatcaatcttaccccgccacacgcaccgggcgcttcacggcaatcgggcaaatggatttggaccacagacatcaaaacgctaagtctcccagccggcgcggatggttgttgcgacatcgcccaggcgctggccgagagctgccaagtgctcaagcacctcgctgggcgaggcgccgttgagaatgcatgtgagggcatatgaggccaagaagattgccgcgagccccaacgggattagcacgatcatcgccagcgtacgcaggcgctgggcccagcgacggcgacgcgcacgacgtttatcgaacgcgagctcctgagcatatgaatcctgctgtacggaataggcctctgggaccgccccgcccgcaggtgcggcgttttgcgcaggaggctggacggccgtcccttgcatttgcatctccataagccgttgctgctggcgcaacatgcgctcggcttgttgctgcggggtctcaagaaacagatccatgttggcctcctcaataggagcattcgacgcttgcgcccagcatcccgcaccatcgcggccgcggcaacgaaatccgcggcaatagccgcaaagattcttttgtcagaaaactgtcaaaaagctcaacaactcccctaccagcactttctttgagcttttttcgtcagcaatcttttgccctttcgcccttgcgccatccgaccaaaacctaaccaaaagcttgacggaaattgtgaagacagggaccccacacaaaaagtgccgccccaaagggggcggcacacaaacttcttatcagcttttctgtagtgagcacgcgacgacccgaagccggagcgcagggcgggaggccggactaccttccctcaacgcgaccctgcggagccgtgagcggggagggaaggtagtccggcctcccgccctgcgctccgcagcagccagcgccacgcgctagtagttcaccacctgctcctcaaagtacgccttcgggtggttgcaaaccgggcacacctcgggcgcctcggcaccaacatgcaggtgcccgcagttcaggcacttccacaccttcacgccctcgcgctcaaacacctcgcccgactcaatgcgctcgacaagcttgttgtagcgttcctcgtgagcctgctcgacagcaccgacgccacggaactttgcggcgatctcggtaaagccctcctcctcggcggtcttggcaaactcgtcgtacatcgtggtccactcgtagttctcgcccgcagcggcatcacgcaagttgtccagggtgtcgggaacggcgccgtcgtgcagatacttaaaccacagcttggcgtgctctgactcgttgcctgcggtctcggcaaagatattcgagatctgaacgtagccgtccttcttggccttggatgcatagtagcgatacttagtgtgcgcctgggactcaccggcaaaagcggtctcgaggttcttcttggtttgagagttctcaaaatccataggtgtacttcccttcaacatgccgcccgtaggcttcgagcggccttgtctttaggatgccctcaagccgagaatttaaaccttacaatcctcttcttcagattcgggttggctacacgcttagccagcgatcaccctcggagcggcaaaagccctcgcgctccaagtcggccaaaatgtctgcgacaagatcgtgatcgaccggctctcggccggctgccgtctccatctcgttaacgcctgcaacggcttcatcgagcgtaatgcccgacggccgcccatcgcgcgcagccagcagcatgcgcacaatatgggcgcgcttttggcgacgcgagccctcaaacttggactgacggctatagctcgccgagcgcctggacggattgggcagcgtcttcttaagatacgcgccataatccagcagcgcgtaataccatgcgcgcggcgtgtcggcatcatctcgaggcgcggcaaagggcgcaatctcatccgccgtcgcaccaggggccgccggacaggcggattggatcagcggcaccagctcgcgatcgggaacggccggcacatcgggaaagaaatgatgcagaaagaccgtgcgcacgttggtctccagatacacacccggtagatcgaacgcaaacgaccgaatgccctgcgccgtcgccgggccaataccgggcagagcaaccaggtcgcgcgtctcacgtggaaactccccaccccagtcttccataacgcactgagcggctctgtgaagcgccagggcacgccggttgtagcccatcccctgccaagcatccaaaacgtcggaaggagcggcctgagcgagcgcctgtacggtcggaaagcggtcgagccacgcgggcatacgcgtctccacacgcggcacctgcgtttgctgcagcataacctcagaaagccaaataatgtacgggtcgcgcgtgcggcgccacggaaggtcgcgataacgcaggaccccttccgaacgaatcatcgaacgaaagggatcctgaatcatggctatgctccttatgcggcgttattcctcccggcaagcgcacgtacaggtggcgtactcgggaaacgcatcgcggtcggcgaacttagaatcgacggccggaaactggcggtgagcgacgatatcgcccagcgaaacggaatcgaagtagtcgcgcatcagcgcttgagctccggcccacaggggatgatagcagcacgtacccatgcgtgcacagtcgccatcgggcgcggtgcaatcgttcatgaccatggggccctgaacggcctcgacgacctggcggatggtgacatcgtcggggctgaccttaagacgcatgccgccatggacgccacgcaggctctccacaataccggcctgaaccaaaccatgctggatcgaacgagcaaacgaatacgggacattgacctcttcggcggcggtgcgaacagaaagcagacgctccgggtcctcggcaagcatcgcgagcatgcgaagggcgtaatcagtcttcctcgatatgtccatttttcccctttcaaggaataggaacagctcgaacgagctccgggaccgagcttgcgtcgagacaccaatggccgtatggacgcccaaatagcaaaacgggtgcccactgaatgccgtgtttgaagcctcttgcatcaaaaacggcattcagtgcaatttagtataacctaaccccctgcttcgctgaacaggtgttgtgcaacaaacgctttgtttgaacacatgtctcaaacggagcttgtccggaaattgggaggatttggttttgggcgaaaggggccgatgggatcaaggtcctatcaaacgcaaaaagccacgtccgaagacgtggctttaattgcgttggcgggaagtacggggctcgaacccgcgacctccgacgtgacaggccggcgctctaaccaaactgagctaactccccaggcagtcgttcgcgtttgtttccgctcgcgtgcgctgcggggattagtatacacagaagtctgtccggtgcgcaacaacttttttgaaaatattttttgggccctccgggagggtctccggggccggctggcgcgggttaagtttgctgctctacagtcctgcgcaagacggaaagcacattaagtgctttcctttgcgtgcggaactcgcgacaaacttaacccgcgccagccggccccggagaccctccctgccgtcacattgttcgagccgttgttgttcctcgccgcttccgcggctcggcggccccgttctcctcggcgaggttggtctgattattcttgttgaacttcggccttttgctgaaagaaaaacgggagatgcgatctgcatcccccgtttttgttgcggttagtctaagtcaataaatttggtgctcaggatcttgccgtccttgacgagcattctggccatggtggggcctcgggtgcctctggggtagctggcgctgccggggttgaggaccaggcagcggcctacttgggcctctttggttacgtgggtatgaccgttgatggctacgtctacggatcccaccggaaggtcttcgcggtggtgggctacggcgaatttgagtccttcgtaggtgaagagggccagacggtctacatccgggccgtagtcgcggtagtagtcgttgtttcctaggaccgctcgcacgggggcgatggtgcatagatgctcgtaatccatctctgaggtgaggtctccggcatggatgatcagatctgcgcccttgagctcgtccagaagcgcgggcgaaagatagccgtgggtgtccgagatgatgtcgatgcgcttggcgcttgcactgttcatgggatcccttctgcaaaaccgattcgacgtatatacaaaaagccccacggctccgcagacaattggtctacagggctgcggggccagtgtgctagaggctcagggccttcttgagcggcacaacgcggcggcgcgagaccggcacgcgttcgtcgacgcccgtaatgcccagttggatagcgcccgagggcaccgtctcgacatctgtgacgcacgccaagttgacgatatagcggcgatgaacgcgaaagaagccaaagtcgcaaagcttggcctcgaactgcgccaacgaagtcgtcgatagaaaacgatcatcgacggtatagatacaggagtaatcgtccttggccatgatgaagcgaatgtcatccacgggaatgaggaccttacggccgcccttttccaccggaatgcgctcgatggtggctttgctgtccgtgacgggcttggcgtgttgcatgaccttctcgatcgcgcgatccagacgtgcctcctcaaccggcttcattaggtaatcgacggcatctacgtcgaacgcctcgacggcatgatcgctatacgcggtcacaaacacaatcgccggcggattcttaagcttatgtagcgcctcggcaagctgcagaccagaagcgccgggcatcgagatatcgagaaagacgacatcgacgcggctttccatcagcatctcaatggcggagcggacgctcgacgcctcagtgatcgtgccgatcttgcccgtctgctcgagcaagaagcgaagttccgaacgggccggggcctcatcatccacaatcatcgcacgcagcatagggattaaacctttcgtcaacaaactacgctgggcatccgccgcttggcgttgagcccatagccttttattttactcttgaatgtcaaagatgctctctgacaaatcaagatgcaggagcactttggtgcccttgcccggcgccgattcgacgcgcgtataagagtgcggtccataaaagcgatggatgcgctcagaaatattgtgcatggccacgccggcgccgccgccttgcggggaactggcatcggggcgggcggagcgctcatcaaacagcctggcggcggtgccctcgtccatgcccacgccgttgtcggccacggcaatcaggattgcgtcgtcgccgtcttgatggacggtcacatcgatctgcagggcatcgccatcgcccatgccatgccgcacggcgttctcgacaatgggctggattacaaaggccgggaccaacgtgtcctcgacatcttcggagacatcgaaggtcgccagtacgcggtcctcgccaaagcgcgccttctcaaacgtcaggtagcgcttggtctgggcaacctcgcgcgagaccgggataagcgaccccgagttgtcgagcgtggcgcgatagaacgaggaaaactcgcgcagcagctcgcgggcacgcagcgggtcggtacgcgtaaacgacgcgatggtgttgagcgtgttgaacagaaagtgcgggttgatctgcgcctgcagggcacgcacctcggcacgggccgtcagttccttttgcacctcgagctcgtggatggcgagctgcgtggacaggatctcggcaaaacccgaggcgagcgcatactgggtacggtcgacggcacgcggggtcttgtagtagaacttgagcgtgccgacggtgcggtcgcccaccttgatgggcgcgatgatgccggcgggaacatggttgtgcgagccatccgaacccaccacgtccaccacgcggttgaacgactgcacgatgccgtgctcaatgacgtagcgcgtggcgagcgtatggatgggcgaatcgggcagcagcttttcctcgaactcgcccgcgcaggccagcacgttgctctcatcggtgatggcaacggtcatggcacgtgtctcgggcagaatacgccggcacaccaaaagcgccgattcctgcgtcaggccgcccttaatgtcctcgagcatggccgaggcaaccgagagcgtctcctcggtgtactgggagcgtaccgaatcggggttgagcgtcaaatagataaagatgcacaggaagatacacagcagcgcacaggcgatcaccgtggcaatcggctcaatgccagtcgccagggcaaagataaagtacaccaacacgcaaacggcgcagacaacggcgatgatgcgaaagattgaaattgaattatcgcgctgggcgcggcggtcgatcattcagccccctccaggatgctaatcagttgtgcgtcgcgccaaagttcatccatgatcttgggccagaaactctgaaaacgcaggtagcttgcggcgttttggcgggcataggtcttggcctcgtcaataccatgacgccagatgcgcagatacccctcgtgctcgcgggtaaacatgctgcgaaccatggcggtcttgcgcacgcggtcgtcgagctcgcgcgagatccacggacccggatagggcatgagtgatgcggccgtaaccggaatgagctccttttggtgcgcagcgaacgtcagcttggcccgctcgtagtaccaacggtacacgtcctgcataaagcgcggcgagcgcttctcggactcgggcggcaggtggcgcacggtccactcgttatcgaaccacacgtcgtagccgaacatgcgcatgttaaacaggtagtccagatcctcgccgcgggtgataaacgggtcgaaggccacgcgtgtaaaggcgcgggcgtgcagggccatcaggccgccgcatacgtaattggagcgcgagatgcgggtgcccgagagcgcctttttcatccagcgattgaactcgatacgcttggtccaccagcgatggcaaatgcccgctttgtccgtgggagccagcggcgacccgtcgcgatcgtaaaagtatccgctcttgactaaaatcggcaggccctgacgtgtctgttgacccagtgcataggtcgcacgcttcataaagtcggcatcgatgacggtctcgtcgtcatccaaaaacacaaccgcgtcgtgccccagcaccgccgcgcaggcaagacccatgttgcggatggcgccgtagccgcgcaggctcacgcactcgcccgaacctttgggcgcaatctgtgccacgcggtcggcaacacgcgaagcctgagtattggtaacgatggtgaccttaagtgagggatgcgcattaacgatttcgtgcacgcgatgggatacgtcggacgtggcagaaaccggacagaccaccaagagaatgatgcgcggaatgtcgcgcacctgttcgagcgaagtcaggcagcgatcgagttccgggttggcggcattgagcgacgtcgagtgatcgtaggtgccgggagcgtttgcttgggtatcatcgcctgcccaatatgttgggatcacaaccgtggcgttcatacctttgccctccttgcaacacaaaaacggggcgccgccaaacacaggcgacgccccgcgacctagctgtttccatcatacccacttgggctaaacattgttcggaagtcagaatgatttatgcggctacttccaaaagagtactgcagataggcacaattgcagtactgagcccggttgccttacgccgccgcctgagccatgcgggacagacggaccagcagcacaaagccaacaaccagcagaacaccaatagaaaggacgcccaacgacgggttgccggtcagcgaggtgacaaccgacaccaggaaggtgcccatcacgcttgcgtagcggccaaagatatcaaagaagccgtagtactcgttggacttttccttggggatgatgcggccaaaatagctgcggctcagcgcctgcacgccgccttggaacaggccaaccaaaatagcgagcacccaaaactcaaaggcggtcttgaggaaaaacgcggcaaagagcacgatgcccatgtaggcggcgacggccaccatgatcatgttgagcgtgcccacgcgaccggcgagcttgccgtagatgatggcggacgggaaagcgacgaactgcgtaacgagcagcgccagcaccagctgggtcgaatcgatgcccaaagccgagccgtagctggttgccatggagatgaccgtatggacaccatcgatgtagaagaagaacgcgatcatgtagaccagcacggtcttgttgtgggcgatctcgcgcatggtgtgtccgacctcggagaacacgccgcccacgatgtggccgatggtgtcctcgggaccgcgctcgcgaccgtacttttgcttataggtgcgaatgagcggcagggtaaagatgagccaccaggcaccggtgatgacaaacgacagacgcgttgccagcatggtggggacgccaagagcggggccacccatgataagcgccaggcagatgatgaacggcacggtggaaccgatgtagccccaggcatagcccgagctggacacggcatccatgcgctcgtcggtggtaatgtcgggcagcatagcgtcgtagaacgtcatagaagagttaaggccgatggtgcacagcacgtacacggtcaaaaatgccatggcggacatggggatagcctgcgccaggcaaagaaccaggcccgtgaggaagaagcccaagaagaacttgatcttgttgccggcgtaatcggcaagcgcgcccagaatgggcatgagcatggcaatgaccagcgaggcaatcgtctgcgcgttgccccaagcgaccaccaggtctgccgaggaagcaccggtattgatggcgttaaagtagatgggcaccaccgaggtattgagcagcacgagggccgagttgcccacatcgtacataacccagttacgctcgagcttggtgtatttcatggacagggccccttcgtattcgcccgatatgcagttagttcatcgtaccccaattgcccagaggcgccggtaaggattcggcaaaggggcacgcacgagccctactcctcgcggtcgaactcttcgtcggcgccgagcacgcgaccgctgtaattgacgtggttggtcacggcttccatatcgccggtctcgataaagcgggcgacggtgagctcgtaatcgagcagtgcgcggtcaaagacctcggggaagctctcggtcgagatttcatcggtaaaggggcttttccatgccaagtggcccaggttgccggtacgctcgggcagctcggtcgtcacgcggtgcgcaaggccgtcgagcagcgaataatcgtgcaccaagccctcgagcagggcaatcgcgcgcgtcttggccgaaccggccggctcgatagtgcggtagagcagctgcatgtcgtctacggcgccgccgtactcccccaccgggatatcgatgccgtacacgcgtccggcaacatagctcatcagcacgccggcaacgcgattgatgcggtcggtagtgacgatctcgcccgccggcggataatcctcgaccgttgccccatcgcgcttgagctgcagcatcagcacgtccaggtcgctttcgagcacggcatgaacttgactgcccgaagcctcgagctcgggatcggactcgacaatgccaaactgctgctcgtagacaaagggatgggcattgcgatcgagcacatagtgcgacagcaggcccagcgcaaaggcgcgacccagattggcatcgcgcggctgcaggtgtgacacgccgtcgcgcaggcacgagaactggcgcgacatgcgcgagcggtgcatgacctgagcaagcgacatgcagtcggaaatgcgcggcgtgagcatgtgaaagaagaacgggtcgggaccttggtttcccaggataaaggcgatgcgctcctcgtcggacgtgataacgcctcgcggaagacggtcgatgctttcctcgccaaacagatgatgcgtaatgagcgcgggcataataatcctttcgatttcattcgatgcaatccattatgcccaccgcacagtcatgccaaacctgtaacggcaaacgatggcacaccgacccttacgcaagccccaagtgcgatttgacctcggcagcgcgacggcgggacacgggcaccgtcgaggttacgcgatcgagcctgagctccatcaggcccgtggagccgatctcgacattatgtacgtcttccaaattaaccagatagctgcgatggacgcggataaagccctcggaggccaggcgacgctcgagcgaggaaatcgactcattgatcagatacgtcccctcggcgcagacggcgttgcaaaaatcggcgcgcgcctcaaagtagcagacatccgccacgggaatgaacacctttttgcccccgcgatccaccgtcaggcgcaaaggctggcgcggagcatggacgacacggcgagcgcccagggcagtctcgatcttgtcgagcgcctttgacaggcgggcatcctcgaccggtttgacgatgtaatcgaccgcatcgaggttataggcatcggccgcatactcggcaaatgccgtcacaaacaccacgaccggcggcgtctttaggttctgcagcgtctcggcaagctcaattcccgagcgaccgggcatggtaatgtctaaaaacagcacgtcgggcttgttcgacagaatcgactccacggcttcggtgacattgcccgcctcggcaatctgacctacacgcgtatccttttccaacagatagcgtagctcagccctaatgggaggctcgtcatcaaccaccaggatgttccagccttcggacatatgcgcttcccctctttttctctcaatccaaccgcgtgctacaccgttagcggcgctggctcatgcggctcgccgttcagctcgacgatgacctgcgttcccacgccctcctgggacttcacgcgcatgccagaatcttctccgtaaaagaaatggatgcgctgaagcacgttgaagagcgccaggccgcaacctcgcttgatggagccgtcggcggtaatgctctcgggctcctctcggcgatgctgctcaaacagatgcgcgcagacttcttcgctcataccgatgccgtcatcttcgacgatgatctccaagccgtcatcggtctcaaaagccctaacacgaatagaaagcggctcggtctcgcgctgcgcatgcttgatgcagttttcgagcagcggctgcaagataaacggcggtaccaggctgtcgcgcacctcaaagtcgatgtcgaccgaaacgcgcagacggccgtcgccataccgggcctgcataagattgatataacgagtgccctgttccacctcgtgctcgagcgtggtgagcgtatcggaatcagaaagcgtctgacgatagtagttggaaaagtcgatcaacagcgatcgcgccttgtcgggctcggttcgaacgagcgacacgatcgtgctaatggtattgaatagaaaatgaggatcgacctgtgattgcaaggcacgcagctccacgcgggccgtaagctcgtcctggcgctcgagctcaaagctggcgagctgcgtggaaatgagatcggcaaagcccgaggccaacgccgtctggcgcatatcgatgctgctcaggcggggatagtacagctcgagtgtgcccacgcaatgcccgcgcacggtaagcggcgcgacaatgccggcgcgcagacggggaaaataaccgcccgtctcattggaggtgtcacgcgaaaacacactctgctcgcccgtctcaatcacactgagcgtggtcttgagcacgaccggggtgccggcagggcactttgccgagtcctcgccccagcttgccaacacctgtttgccatcggtaaagcagatggcagaggcgatggtctcggacaggatgattttagaggcgcccaaggccgcttcgggcgtaaggccgcgcgacgtgtaggcgaatatttttgatgcgatggcgagcgtacggtcggttgcactcgatgtgaggtcgtcggggaccacaaagacatacgagaaaaagaagcacagcatgaccatgccggcaataacgacaacgcccggaacgggattggggttatcggttaaatcccagataagcagcaggataagcgccggaacgacaacaccgagcaggatggcctggaccacatgctgggccgtacgaaagaccttggtagagttgtagctcttgcccagaatcagcctgtttaaatccaccgtcatccccttttatctatcgcacccatagcaataaagagggccgcaagcgaccctctccattgcattatgcaatcaaatactgtgttttacatccagtcgtcgatgaacggtagtttaggcgctgtatttgttggcctcgccaaaggtgcccgcctcgacgatccagccgtccttcatgatgacgtccatgttgtcggtgttgagcacgtggatgtcggcggcgacgtcaccgttgacgaccagcaggtcggcgcacttgccggcctcgatggaaccggtctcgtcctcgatgtggcacatcttggcaccgttgagggtggcgcaggtgatggtctcgaccggggtgaagccgatcttgtcgacgaactcgtacatctcctcgatggagcaggtgccgtacggggtgacgaaggagaaggagtcggagccgatcgtcatgacgacgccgcgcttcttggcctcgcgcaggcagtcgtagttgcgctgcagctccttctcgaccagggtgccctcgtacttgtcgtgcagctcggggacgtagacgggcggataggtggcgtaccaggtgggcaggaaggcgatcgtcggggtgaagaaggtgccctgctcggccatgaggtccatggtgcgctcatcgatatcgaagccgtgaatcagctgctcgcagccaaagcgaacggaatcgtaggcagcggcgtggttgttgtagcagtggctccacacggggatgccgaccatctttgcctcttcgactacggcctggatctcctcggagcaatagtgctggtcgcgaccggagtcccagcgccagatgccgccaccggtagcccagatcttgatggcatcggggttctcgcgcaggcgacgacggacggccttgcgcagatcccaaggaccgtcgacctggtcgccccagggatgggattccttgttgagctcctgggtgcagtggtgggagtcaccgtggccggcaacgcggcagaagccgaggccggtggccagaacgcgcgggcccttaaagacgcccttgtcgatgcagtcacggatctggataccaaagcggccgatctcgcagacagtggtgaggccgtgagtgaggcagtcgtaggcctgcttgacggcgacggcctgcttctcgaggagcggctgcatgacccaatcggtatcatcgtcggtcaggttgcccgagaagtgcagatgggtgtcgatcaggccgggaaggacggtcttgccggcggcgtcgatgacctcaacgccctcgggaaggtcctgcatagtgccggcgtactcgatcttgccgttgtcgtcgacgagaacgagggagttctcgaccggctcggcaccggtaccgtcgatgagcttgccgccaacgattgcatacttagtggacatggttcctccttatggatccatatagtgggcgaggccgtgttgggttaaggcctcacaaagctacccaagtggtgccgggttcggtgcgcgggagagagggccccacgcacccgatccgccccggctaggcgttactttttgcgggaattggtgaaagccatgagggccaggccaatagccaaccagccgatcacgatgctccactccaccatgttgagggaggcgggagagaacggaatcacgagcaggccgatgatgatggcgcaggcagcgatagcgaggccgatgccaaacttgccgccgggcacctcgtagggacgaggcaggtcgggctcggtgaagcgcatgcgcaggcaggcgagggcgaccataccgcaggagaaaatgaaggcgagagccgacacgttggtcagagggatgagcatgttcttgcccaggaacggaccgatgacggtgataacgcccagaacgacgcaggcgagcttgggagcgccggacttggggtcgacctcggcgaacttctcgggcagttggcccttgcggcccatggcgagcatgatgcggctcgtggcgccgtagaaggagttcatcgggcccatgggtccaagcgtggcgatgacgagcatggccaggtacagaagcatgttgatgcccttgaggcaggcaagcgcgggaaccgggctcttaacaaactcatgccagtcgaggatggtgccgaacgagtagatgcagaccatgtagaagccgccggcggccagcagggccagggagatgatcttgccgaacttgttccagttgaggccctcggctgcttcctcagcctgctgaggaatggtgtcgaaaccggcatagaagaacggagtcagaaccaggaccgacacgatgccggcgaacaggctggcgccctcggtagcggccttgccgccgccagcgccggtgacccgggagaacacgggcatggcgttgtccggcgagccggtgaacagcgagacgcccatggcgagcagcatgccgcagagcagggccttggtcaggaaggcctggagcttggcggccgagctggcaccgcggaagttgaggaagatgacgtaggctgcaaagccgagcgcgatcagcgtcgggaacaggtaaacgtcggcgcccaggatggtgtagagcttgacggcgcgcagccactcaagaccaggcaggctgccgaacatctcggacacgagggtcgaaatggcgatggcctcccacgggcacaggataccgttgcccagagccaaaagccatccggtgatgtagctcagcgtacggccaaagctacgatcgacatactcgacgatgccgcccgagatggggatagcagccgtgagctcaccgaaaacagctccgacgggcacgaggaagattgcacccaagaggaatgcgatcatagcgggaacgggaccgccgcccacgaccatccagtcgccgacctgcagaacccaaccggtaccgataatggcaccgaaaccgatggtgaagaagttccagagcgaaagcgttttcttcatatcgccgttatcctcgactgcaacttctgcattcttgtccgccattgttcccctcctttcctttttgacgccccttgacgtcaccccttgcgcggtctgttttgccgcgcgcttttattccatggctttaagatacggccttggcgcagcagctccgctcgcagctcgaccgaaggcagaactgcaaaacgagcggcaccgtttttgggacgaacggcgggagacgtcattcgtcttggacgctttcatcttgtctgcttttgaagacctgttgccgtgacgcttggcgcgcggcgcggcaacgttcataccatttgtcaggcttttggcgcacatacccatgtgtcgtgcatctttttatgtaggatagacaagttacacatgaggcaaggtgattcgaatggcatacggatacaatgacggcgaccaacggccacaaagcgtgcgccttgccggccgcaccacgccaacgcccagaagcacctccgacaacgacaacccgcagcgcccccaagagcagcccggggcttcttcgcggcagcaaagccgtaccgtgcagcagtcagaccgcgtgagtacgagcacacgccaacgtcagaccgacacatcgcagccacgccgctacgatcgccgtaagaccgactactacgtcaagcgttccttttcgcgacctcaacgcgatcgcggcaattcctcccctcaccccgcgtcgcacaccacaagccacgcgcttccggcccgccgcctacgccttgcgctttgctccatcgccgcctgcctcgtctttgtgtttttgggatcctgtatctcccacggatcagccggtcttgagcccactgccgaggacaagctgcttaaagctcccgtcgcgcccggttactcctttgcgttctcgaccccacgctcgcaatgggaggccggcaccatgccccacatctaccaaattgaccccgcatggtcggagctgccctatgccggtggcactattcgcgaaaacgcttgcggtcctacctgcctcaccatggtctatatctttaagaccggccataccgataagacgccggtcgatatatgcgcgctggccgaagccggcaactacgcccccactggtgccaccgagtggtcgtttatgacaggcggtgcgtggcagctggggctcaacggaacacagctctataacgatcgcgaatcgattactcaagcacttcgctcgggtgcgcccgtcatcgccgcagtgcgccccggtacgtttaccaacgtaggccactacatcgtgctctacggcatcgacgatgccgaccagattggcgtctacgaccccaactcggccagccgcagcgcccgtcgctggggcgtcgtagaggtcctcaacgaagtcgaagccatgtgggcctactactagtcattggggacagacttaaatgagtggtcattggggacgctcttgtttgactagtcatttaagaacgtccccaatgactaggtgaatagcaaaagccccgcagtcggagcggactgcggggctcatgaagagaggctagtttgcgggcgctttgcctggcgcccacgagagaggcaacagagtagagactactcgtggatgcgggtaccggagaggccagccatggtctcggcggccttgtccagagcgccgatgatgcaggtgcggcccttgcgggaacgggcgaacttgatggcagcgcggaccttgggctccatggaacccttgccgaactggccctcgtcggccaggcgctcggcctcgtcggcggtaatgtcctcgagctcctcctggttgggcttgccaaagttgatggcgacatgctcaacggcggtcagcaggaacagaacgtcggcgtcgcagtcctcggccagcagctcgccgcccaggtccttgtcgatgacggcgggaacgcccttgtagcagcccttgttctcgtagtcgcggacgacggggatgccgccgccaccgcaggcgatgacgatgaactcgttgtcgagcaggttgaggatggagtcggcctcgacgatcttcttgggatcgggggaagcgacgacgcgacgccagccgcggccggaatcctcgacgaagaccttggaggggtcctcggccatgaactccttggcctgctcctcggtgtagaagggaccgatcggcttggtcgggttcttgaacgcgggatcgtccgggtcgcactcgatctgggtgacgacggttgcggcgtgccaacgcttatagcgcttgtgcatctcgcggccgatgccctgctgcaggtgataaccaatgtagccctgggacatagcgccgcactcgggcagcggcatctcgggggtaccgatggcatcgtgggcagcggcgaaggcgttctggatcatgccgacctgcgggccgttgccgtgggtgatgatgatctcattgccttgctcgatgagaccgaggagagcgtgggcggtgttgctcacggcctcgatctgctcgacggggttgttgccgagggcgttgccgccaagggcgacgacaatacgatcgggcttgccaagaggcttagacattgctggaatcctttctgtaaaaggcctacaacccattaataacccgcgtccgtgcgatacgcgagtttattaaggtttatattctctttatcgctcattttattcattttgaaaatagcggaacggtgaacggtcgtttttgtccgctcagcgtacagaactccagctcagacatatctacgtaatttacgtgcgactttatttaaatgaagcgaggattatgtcggattatgcaaactacatctctgctaaacacaaaacggacagcgcaatatcttactcgcgctatacgagattctatgcacttataagtcgagtatgcacccctgcaaaaacaaggggcttttcatccagcaaaaggaataaagaagcgctccgaaaaggcggcaacagccaagtcccccatccatccccaaagtggcgcgaggtttcgcggcaaagccgcgaaacagcgaaagggacggaatacccggccaactacgtccttcatccgcccacacaatctgaggacgtagtcgtagcaggatctgagggctgaccttcgcggacactccgcaggacgaaagaacccccgccgcacataatgcgcagcgggggttctttcatgtccgaggacgtccgcgaaggtcagccctcagatcctgcggtgggagacctaggcctcgttatacaccgttttgagcttcagcaggtgctgatagcggtccatagcagcctgctcattctccttgaagagctcctcggcgcgctcggggaaggaacgcgtcagcgaagcgtaacgggcctcgttcatcaggaactcctgataaccgcccgcgggctccttggaatcgagcgagaacttcttgccggcagcagcctcggggttgaagcggaagaggttccagtaaccgcactcgacagccttcttcatctcggcctggcagttctgcatgccacccttcttgatggagtgcatctcgcaggggctgtagccgatgatgagggacgggccgtcgtaggcctcggcctcgtgaatggccttgagggtctgagccgggttggcgcccatggcgacctgcgccacgtagacgtagccgtagctcatggcgatctcggccagggacttcttcttggtcaccttaccggcagcggcgaactgagcgacctggcccaggttcgaggccttggaggcctgaccgccggtgttggagtagacctcggtgtcgaagacgaagacgttgacgttgtggccggaagccaagacgtggtccaggccaccgaagccgatgtcgtaggcccagccgtcgccgccgaagatccagaaggacttcttggtgaggtaagccttgtcagcgaggatcgccttggaagcgtcgcagccgcacttctcgagctcggcaacgtaggcagcagcagcggtcttggaggcctcggcgtcgttgacggagtcgatccaagcctggccggcggccttgagctcatcggacggaccatcggcagcgatgatgtcctgggtagcggcgatcagcttcttctggacggcctcgtaaccgacggccatgcccagaccgtgctcggcattgtcctcgaacagggagttgttccacgccgggccgtgaccgtccttgtccttgcagtaaggagcggtggcagcggggttgccccaaatggaggagcagccggtggcgttggagatgaacatgcggtcgccggcaacctgggtcaccagacgtgcataggcggtctcggcgcagccggcgcaggagccggagaactccaggtagggctgcttaaactggctgcccttgacgttggccgcgatgagctccttcttctcggagacgttctcgaccatgtagtcccaaacgggctgctggtccatctcctgctcggtgggaaccatctcgagggcgcccttggggcagaccttgacgcagttggtgcaacccatgcagtcgagcggggacacggccatggtgaacttcatgcccttggccttggggcccatggcgtcgagcgtgcgggtagcctcgggcgcggcggcggcctcgtcctcggtcatcgcgaacggacggatggtggcatgcgggcacacataggcgcactggttgcactggatgcacttggtctcgtcccagtggggaacgaccacggcgacgccgcgcttctcgtatgcggaggcgcccagctcaaactggccgtcagcgcaatcgacgaaggcggaaacaggcaggctgtcgccatccatgcgatcgatgggctcgagcaggttcttgacctgctgggcgatggcggacttggtctcctcggagagctcgacgggagcggcatcctcggcggtagcccagtcggccggaacctcgaacttacggaaggcggtagcgccggcatcgatggccttatggttggcgtcgacgatggcctggcccttcttcatgtaggacttggtagccgcgtccttcatgtactgcagggcgtcctcggcgggcaggaccttggccagcgcgaagaaggcggactggagcaccgtgttggtgcgcttgcccatgccgaccttggcggccaggtcgatagcgtcgatcaggtagacgttgacgttgttgttcgcgatgtagcgcttggccacggcgggcatgtgctcggcgaactcctcgtcgctccactggcagttgaccaggaaggtgccgcccggcttgacgtcgcggaccatcttgaagcccttaacgatgtagctggggttatggcaggcgacaaagtcggccttggtcacgtagtacggcgagcgaatcggggaatcaccaaagcgcaggtgcgagacggtgacgccgccggtcttcttggagtcgtactggaagtaggcctggacgtacttgtcggtgtggtcgccgatgatcttaatcgagttcttgttggcgccgacggtaccgtcgccacccagaccccagaacttgcactcgatggtgccgggggctgcggtgttgggcgcatcctcggcctcgggcaggctcaggttggtcacgtcatcgacaatgccgatggtgaactcgcgcttgggctcgtccttcttgagctcctcgaagacagcgaacgcggacgcgggaggcgtatccttgctgcccaggccataacggccgccgacgaccttgatgcccgtcttgccggcctcgtagagagcggagacgacgtcctggtagagcggctcgccgatggaacccggctccttggtgcggtccatgacggcaatcttcttgacggtctcggggagaacgtcgacaaagtgcttgatggagaacggacggaacaggcgaaccttgaccaggccgaccttctcgccgtgagcgttaaggtagtcgatgacttcctcgagcacgtcgcagaaggagcccatgcacacgacgacgcgatcggcatcgggagcgccgtagtagttgaacaggccgtaatcggtgccgagcttctcgttgatcttcttcatgtagccctcgacgacggcgggaagctcgtcgtagaccttgttgcaggcctcgcggttctggaagaagatgtcgccgttctcgtggctaccgcgggtgtgcgggtgctcagggttgagcgcgtggtcgcggaaagcctggacagcgtccatgtcgcacatctcggccagatccttgtagtcccacatggcgaccttctggatctcgtggctggtgcggaagccgtcgaagaagttaaggaacggagtcttgccctcgatggcggcaaggtgggccaccggcgagaggtccatgacctcctggacgttgccctcggcgagcatggcgaagccggtctgacggcaggccatgacgtcggagtgatcgccaaaaatgttcagggcgtgggaagcgacgcaacgcgcggagacgtggaagacgcccgggagctgctcgcccgcgatcttgtacatgttcgggatcatcaggagcagaccctgagaagccgtgtaggtggtggtcagagcaccggcgcccagcgaaccgtgaacggtaccggctgcacctgcctcggactccatctcgacgaccttgaccggggtgccgaagatattcttgcgaccctgggccgcccactggtcgacatggtcggccatcgggctggacggcgtaatgggatagattcccgctacctcggtgtacgcatacgaaacatatgcggccgcctcgttgccgtccatagacttaaacttacgcgccatatacccctctcctctcatataggtatacaggccccggcgatcgccgggatgttggcgtgatgggatttacgctgttgcttccaatcatctggcaggcaggctcagcagcaggtacgtggcgtggagagaagacatgccgaggcgagggccagctgatgcgccccacagacccgaccgcccgtcttgcacatgaccgagcgccgcaaaggccgcatgccggatgctcccgggcacgccccggcgatgggaagcgcccgcaacggaaatccgcatgcgggtttattgtaccccgccgtcaagtgtaatttcggcaaatataggcgggcggtaaaggtttacctcaggtgactgccgggagcaaaatgatcccttggggacggagggaccatttggcaggactggctagagggcaccgaagagaatggcgtaggtagtggattcgccgagcttgagctcgtcgccgggattgagttgggcggaacggccgggctcgacctgaatgcagacgcgcgtggccccgtttaccaccacggttccgttggtggacgacaagtcctcgacgtgccagatattttgagcatcgcaccagatatgggcatggcgggccgagacatcgtcgccgacgtcggtaatatcgccctcaccagtggccagcgcgccaatctcaacaccctgctcgctcggctgaatccagcgcggggcgctcacgacaaaactgttttgcacgcgcagcaagcccaaggggtgcgccggggcgggttcgcgttcgcccgcggtcatcgacatgccaagcgaacgcggcgtggatgttcctccgccacaggtcgcgtgcgcgtagtcgatggcatagttcaccgaggaccgcacatccgccgaacaaccgacagcgacaaacagcaccagcacggcctcggcgcgctcggcgggcatgagttccgccgcctgggacaggcgatcgagcgcgttgcgatagagattcgtgtcctggtggcactcttcgagcgcgcgtaccatcggttcacctgcaggaccgcacgccatattgatcacagccgtggagtccatgggatttcgctggcgcagggccagttgcgacataatacgcgcagccgaggtaccgtattcggcaaagtagcgctgctgaagcgtgccgaccggcgcgcgaacgataaagcgggaaacccaagagcgatcggcggctcggctctgcgggctgcggccgtcggcgagcggacgggacgaaagcaccaggccgcacagctcgatatggctcagatgcgccgcgcgcttaaagatgtcaaacatggccccgcatggggtgagctcaacttgagatgccatgacctaggcctccttggtcgtagaaatagaatcggacgatacttcgacaggtccgccaaaagtacgggcagctgcggctccaccggcaagcggagtcgccatctgggcttttgtgcgtcgcggtgccgaaacgggaagttcaaaggcaaagcccatcgcaagcaaaaaccacgtaagcgtataggttgcaaccagagcggcaacaaggccgcccatcacggcgcgttgggaaaatacgctacatgcagccacaaccagcaccggaacctcgcaggcagaaagcgcaagcacaccctgcaggaagcccgagcgccgatcgcgcgcaagtgcccccgcggcaacgccggctatgcctggcagcgccaacgccagtgcggcaataatacccggtagcgacccagaccacacgagcgatcccaaagtcgccgtcacgcgagcgcccgacgccagcagcgcggccgaaaccacgaccacagcccaaaccacgccacagacgaccgtcgcgccgaccatcagcgcgcgacgcaccgcgcggccagacgcatccatggggcacggcgtgagcggctcgccgcggagcgaacgaccgacattttgcgcatagtggtcacaaaacgccgagagcgccgcctcgaccgccgccggctcgggacgatctttttgatggctggacagacaggccatcaccacgtcgaacagctgggcatcgacaaacgccagcgcatcgcgtagctcttcggaatccggctcaagccctagctgctgggcctgctcggccgcggcgagcgccacatcgggctcacgacgaagcagctgagtcaaatcacaaccgggcgcatgggcaccaatgggatagtcgggccgcgtgtccattttgagacggtaggggctcgcgatgtcgcgcgtccttttgcgcgaacccgaggcgcccgaagtgctcggcgcggcttcgtatggcgcgacgccggcaatgagctcgtaaaccgtgcttgccgcggcatagacgtcgatcgccggcgacatacgcaaagcgcgcaggtcgggaatatcgtcggtgagcatctcgggcggagcgtaggccaccgtcgcgcgacgcagcgtcgcataacgctccgtaaacgacgccttgccgccggtaccggccacggccgacgcaggctcaagcgccagcgacgagccaaagtcgatcaggcacaggtcaaaggtgccctcggcaagctgccggtcaagcggtagacgcgccgtgcgcaccataatattagcgggcgagatatcgcgatggacaaagccctcgcccaccaggctcatacggcagagcagatcgaacaggtcgcgacccagacgcgccgccacaagcggcgacaggcgtccggcatcgtccacggcgagtcgcgaacgcaagcgggcaagcgtctcgccctcgacccattccatgacaattgcaggcacaccgtcgacctcgccccagccatagaggcggggaaagcccttaaggcccgaaagggcgcgatggcattcgtattcctcgcgaaacgccgccttgaacttggcgaccagcgcctcgtgagcggcatcgtcgtcaaactcatcgcgcgtcggcaagatgagctgcttgagtgccacggcctcgccttgggcgttgacggcacgcgtcacgcggccgataccgccacggcgcatggtggcatcgtcggcaaacagcatcgtaaaacgacgcagataggcaggcagttcgtcctgaccgagcgcaatggccggctcaaacccgtcgacacgcgccaggcgcaggccgaccatgggatcgcgaccgagtgattgtggtgtggtggatgcaagatcggtcatcatagggcaagcgccgccacgttattgttgaagttaccgagcgcgacgtcatcatcgccgtaatggccaacccattgacataggttggtgtaacagccccacagattggcatactgctgataccactttgaccggggcgagaatgtctgacgaccgaactcggctcgaatgacaaacatctccccgaccaggctgtcgcacggcctgggatctcccgtagagttataggtcgagaccacgtcattggcacgagaaacgtaactgtcgagcatgttgtacttggtcacaagccaactgtgaatgccctcttcctcagcagcggaaaggccgccggagtttgcatcgttgtcagtgttgccgcccgtcgagccgccgtttccaggccctccggtagaggaacccgacccagagccgccgcccgaactcgatgaatccgagccggagccagaagtatccgagctaccgggctttccggactgctgggcgtcctgctccttttgctgctcgaccttattcaccgttgccgccacgctattgttggacaatcgatcgatgatcttggtgttggtgagcacgatggttttgccattggcaagcgtgacttcgttgtccggggcctcggcgccgtccgcatcgtcggtgccaaacacaatatgcgcgaccacacttgcccaagcatatccagtcgtggtacccagatcacttttgacctcatgccccacgcgcggttcgcgtgcggcatgcgcctgcatcatggacggcacggtcatgccataggcagaaacgccagccatgaccagcaccagcgagcacgatagcagtgcgtacgcccgcggcgccaagcccagtcggcgtcgtatgcgcaccgcggcgccgcgctttgtctgagtgccaccgggccgcatgcgttctcctccaacaaaaacacgccgctcgggagcggcgcattcattcgaatccatatttgagtgtatcagcgaaccaaaaaggttgcgcaacgaatggacaaattaaggatgcgagcggaagcatccatgcgataagcggatacgaagcatctttgttgcacaacaaactcacagtcgcacggggaaattatgactaccccgtgcgtcgcgaggaaaacatacggcaggagcaggctcgccacctaaatcgcgcggcgggcctcgatggcgcggccaagcgtaagctcgtcggcatactccaagtcgccgcccacgggaaggccgcttgccagacgcgacacctcgacgcccaacggcttgatggtacgggccagatagctcgccgtggtctcgccctcaatattggggttggtggcgatgatgacctcgtggatgtcctcgtggcccaagcgtgccagcagctctcgaatgtgcagctgctcggggccaatcttgtccatgggactgatcacgccgcccaatacgtggtagaggccgtggtagctgcccgtgcgctcgatcgcctggacatcgcgcggctcgcccaccacgcaaatgcgagtggtatcgcgcatcgggtcctggcagatggagcactcgtcggccgtggcgtagttaaagcagcggctgcaaaagtggacctcctgcttgacctccaggatggcctcggccaggcggcgcgcctcctcggcgtcggcctccaacaggtaataggcgatgcgctgggccgacttgggaccaatgcccggcagacggcccagctcatcgagcagtttttgcagactgtggttggcactcatatatatgcgtgtcttagaacggcatgcccgggatgttgaggccgccggtgatggcgcccatctgcttgttggcgagctcgttgacgccgcgaacggcctcgttgacggcagccatgatcatatcctgcagcatatcgacgtcctcgggatcgagcgcatcgggatcgatggtgaggttgacgagctccatctcgccgttaacggtcaccttgaccatgccgccgccggcagaggcgtcgacggtctgggacttgaggttctcctgcgcggcggcaagctgctcctgcatcttgcgagcctgcttcatcatctgctgcatgttcataccggccatgatggctcctttacgtgcggccgcacgccgagctgcaagggcagccggagcacggcgggactttcaaactcaaaaatcgtaccacggcgcgcggcgagagagcggggcggacgtgttacctcagtcgatatacatgtcctccaatacaaaccgcactcaaagattatgcaaggtcgaattatgcaaggttgcataatatcgcacactcaatctagtagagccgaatccggcatttcatgtgcgccactaaatagctaaatgccgaaccgctgctcgaggcggcgcacatggcggcagggtataatttgattgccatagatagtaatttggaggtgccccatgaatgcccccaacgcgctccaaaacatccgctcaaaacaccccgttgcatatgtggttctctatctctttgtcggctgggcattgctggttgtcatcacccatgccatagcttttggagcagaactgctgatagccagctcggaccagcccgtcgtcaaatgggagacgaccgatgagtgcaccgacggaacccgaaccgtctactacaacagcccgtccctctatcaagagttcaaggtcaagataaaggacttcaagattgtcgatgccgagctaggcgtttatttggcaatcggagcaaccattaacgccgagcaagtcgagtacacggacagccatgcgacgtatcgtatcgacctcagcatcctaggccgaccgtcacgcacctgtctgctcaaatgcgacatacgcggcaccacactacacatgtccgaaatacagatgcgcccggacaaggggtcctcttcttgagcagtatacccgcctacgcagctactccaccggcttgaagatggtggcctggccaaagacgctgcggatgagggccttggcctcgtcctcggtctgcgggatgctcggggctgcgccctgatggccgaaggggctgccagcaccgggattggattcccagggagcggcggggacgtcgtcgtttgcagaggctgcgggtgccacagcagcggccttggtcgcggacgccgcacccggcacgtcgaacgggggcagatcgtccccgccggcatcggcagcaaaaccaccgaccatagcatcgtcgtagggcacctgctcggattcccatggcgcagcctgcgcaggcggctgagccatggggacggacgcgcgctcgggcgctcggggcgcgggctcggtcgggagcttgcccgtggcaggagcaccggcagggttgtcggagcgcagccaaggggccttggccaggtcggatgacttgggcgcaggcgcggcagcggacttgggcgcggggatcggagcagccggtttgggcgcagcgggttcaggcgccgacggggtcggtgccgctaccggcgccgcttttggctgcgtcgcgctggcgctcgaggatgcagggggcaccgaggacacgggttgcgggtccgcagataccgcagcccgtgcagatggagaatgctcctcatgttgaggagccggcgtgccacccccatccaggacatagtcgacggtacgacgaccgaagaccgcgcagaccgtcggcaggaccaccgactgcgtatcggcgcgaccgagcatcttgatggcaaaagtcgaacccgcggggaacgagaccgtgagcttggagccgtcgtcggccgtggcgcgggcgttgagcaaaagccctgcgtaggaagcctgacgcgccttgacacgctcgacaacctcggcccatttgcgctgcagctctccggcatcctcgaccgcgggcgtctcggcggcaccggcggcggcaacctgggcggcgttgttggactggggcttaggtgccggagcggtggcaggcgcgggggccgcaacgggctgaggcgtcggagccggcgcaggctgaggtgcaggcgctgcaggcttggaagctgacacggacgcagaacggggcgcaggctgagccgtcggagcggcagcaccacggtcccaaggcataccgccctggcgcgcggacgtagcagcgggggcagcggatgccgccggggcggcagcgcgggcgcccgaaatgagcgtcggctgttgggcagcagcgggtacggatgctgcaggcgcggcggcctgagcagcagccacgctcgccggcacggcggcgttggcaaccatggcctccaggcgtgccacgcgctcggccaatgcctcaatcgttaaatcagcctcgggacgcgccagacgcgtgcaggcaatctcgagcaccaggcgcacgtcgctcgcgcccctcatctccagtgcggcatcgtcgagcactgtcagcacacgagccaggcggtcggcaggatgctcgccaaaggcagcggcctcggcagcaagcgcctcggcctgctcggagccgccctcaaacaactcggcacgggcacgggcaacgcaggcaacatacacgtcgcgcacgtgcgccaccaggtcgcgcgtcagttccagcagatcgttaccttcctcgacctgcgcgcgaatcagcccatagagctcggcgacatcacgatcggcaatggcgcgcgcaaactcgcccaggatctggtccgaaacctcgcccaaaagcgagcgggcatcgtccgcatgcacggctccgttgccaaaaacgctcagctgctccagcgtggaaagcgcgtcgcgcatgccgcccttggcatggcgcgccacgatggcgagcgcctcgtcgtcgtaatcgaagccctcctgctcgcacacgtaggacaggcgatgctcgatatcctcgttaccgatgcggtggaaatcgaagcgctggcagcgcgagaggatggtctccagaatcttttgcgggtcggtggtgcacagcacaaagatcacgtgcgccggcggctcctcgagcgtcttgagcagcgcgttaaacgccgccgtcgtgagcatgtggacctcgtcgatgatatagatcttgtacttgccacgcaccggggcaaagttgacggagttgatgatctcctcgcgcacgttgtctacgccggtgcggcttgcggcatcgagctcgtagacgtctgggtggttgccctcggcgatgagctcgcattcctcacaggtgccgtcgggcatgcagccgctcgcaccctcggcgcgcgccgcctcggcattgcggcagagcagcgccttggcaagaatacgcgccatggtggtcttgcccgtgccgcgcggaccgcaaaacaggtacgcgtgggacaggcgcccctcggtgatggcgtgctcgagcgtcgagacgatatgctgctggcccaccacggagtcgaaggtgagcgggcgatactttcggtacaacgattccatgggtgctcccccgggtatactgagtcttgttgccgcggcggccatgcggtcgcacggcatactgcatccataataacccgtacggcgagcccgccgcgataggagtccaaagagcatggcagacgcagagagcaacctcgttccctccgaagcagccgaccaggtcgaggtcgcgctcgagaagcaggccgcagccgacgacggcatcctgtacctcaacgagtatcagtacgaaaacgacctcgtcaccgatttcgcccgcttggttgcctcgcccaggcgccgtggctccctgtacgtcgccgccgcgattgccgcgctcatcggcatcggcatgctggtggccggcggcagctggatcaagttcggcgtcgtgctgatcgtgttcggcgcctttttggcctggtggagcaaaaatctgcaccatacgctcgcgcgcgactttatcgaagccgtcgaggccgacgagtccatgggcggccgctaccgccgcgtcgccgccaacgaggacggcctgatggtctggggcaagagcggcaagtcgcagttcttcccgtttgagaagctcgaccacgtgctcgacggcgagcgcatctttgtggccatgttcgccgagcagggcgtgacgatccccaaggacacctttgtacgtggtgatgccgagcagtttggctccttcctcaaggcgcgcatcaacaaaaagctgcgcatcgagaccaaacgcaagaagatgaaggccgaaaaggccgctgccaaggccaagcaggaaagcgagcccaagaacgcaaaggccaaacagcgcaagcagaagaagaacaagaagaagcgctaaggccaagtcagataggccacctcgccccgctaccttcaccatgcgcccgagcgtgctaaactagcagcatctatgccaccgcgaacggcttgaccctggcccgccgctcgcaaacgaactttaaacgcacgagggttggccatgccgcttttctcgcaacataccgcccggttctcgccggacgttcccttggagggcaccagctctcgcgagctgctcaagcggttccagccgctcgagacgcttgcaaccggcggttttggctccatcgagatttgccgcgacacgcacctgcgccgtcgcgtcgccattaagcgtatccccctcacaagcggtgccggcatgcccgccagcgacatcatggatgtcctgcgcgaggcacacaccgccgccatgcttcaacatcccaatatcgtgcaggttatcgactttacgcacgataccgcctatgcctacctggtcatggagtatgtcgacggcatgtccctagccgagtttttgcatcgtgtggacggccattcgctcacctttgacgaggccgcggcaattgccgacacgctgggccaggcactcactttcgcccatagcaacggcgtgctccacctggacattaagcccgccaacgtgctcatcgaccactcgggcaatgtaaagctcaccgactttggcatggcgcggctgtcgtctgccggcggctttggcggctcgcgcggcggcaccatcggctacatgccacccgagcagctcgacatcgaaactggcacggttgacgagcgcgccgatgtctttgccctcgcctgtgtgatctacgagggcctgtgcggcagcgctccctttatggccgccacgcccggcgactcgctcggccgtatcatcggcggtgccacctatcccagcgagctcatcccgcactttcccccgggagccgaggctgcgctcatgagcgccctctcccccatgccgcaagaccgccccaacagcattgaggcattttgcgaccagctgctcgacgacttgggcagcgtgcgcgagggccgtcgcagcctggagcagatggtgggcgagctgtcggatgacgagcgcgcggcagacgatatcgaatcgctaccctatgaggacgacaccatcgaggtcgaccccgcactcggctgggccggcacgcgctggagccacgcacgcgattacaccatgcgcgccatctcggcgctaacgtgtggtgcctttagctttttgatcatgcagacggctggcgtcgcggcgcttcccggacttattgccgcggccatcgcgattggggcggccgccggcctggccccgcagattggctcggccatctcggccgtgggctttttggtacttatggccaacgccaccatgcagacgcagggcatcctgtcgatgctacccgtcgcggtgctctttgccgccaccatgtccggttggtggatcgcctggggacgcaccgaggcggccgcgagcgcggcgctcacctgcgcggtggcacttggctgtctaacgggcgacgtcctccttgccgccggggtcgccgccggcatcgcggccttttggctcggcccggcaagcgccgcggccgccacggggatgggcgcgctttttggccgcctggctacggttgcgctttccgccggaggcgcgctggggctcggcaatgttgccgcggcgctgggagacatgctcttctgggctgccgttgtgcttgtcgcggcgacagctgcactgacatctctgctgctcaacgcccatgccaagcgtgccgagcagggctcgaacctggctgcaatcgctgccatcgccggctgcggaataggcaccgcgacgtcgctctgtcttgcacaccatatggaaattgccagccttgcgggcgcggtcgtcgtcaaggcggcggttgcgggaaccctatcctctataatcgttgggatatgcctatatttgctcggataccaaagaacctatacggagagtgatctttcgtgaacttcctgaacatcttcgaggaccacgtggccggcatcttcggtgccacccgtgccccgttctcctttaagaagcttgccaagcaggccgctcgcgacatggaggatcagactctggtgatcaacggcgtcaacaccgcgccggcactctataccatcctgatcgccgccgacgacgatcccatgctcgccccgttctaccccgagctttcgcgcgaagtccgcgagtttgtgaaggcacaggccgaaaagcgccgctatgtgtttgtcggcgaacccctcgttcgctttatgatcgacccgcagctgcgtgccggtaagttctcggtctttgccgagaacgtcgacgcccccacgctcggtcgtttgtacgaggaagaacgcgcttaccagaatggcctgggccagaacaactcggccgcaagccgcgccgccagcgctccccgcgccggcaagcagcaattcgccgctccgcagcaacagcaccccgccgccatgccccagcagccgtcgccccgtgccgccgctcccgacccgctcgccgtggccgatccctttgcgcccagcgtccccgaccccgccgccgcgcccatccccgtgccgcagaccgtctctcgtgacgccctcgccggcatgggcggagccgccgcgaccggcgccgccgtgggccttggcgccgcggccggtattgcctccaacatggcgagcacccgcgccccgcagcgcccgctcgcccagctcgtcgacgtcgtgagcggcgagagccacagcatcacttccgcgcaggtgaccatcggtcgcgagcgttcggtttcggacatcgccctgcgcgaccccaacgtgtcgcgtcgtcacgcccaactcacctttaccggttcggactggtcgatcgaggacctcaattccaccaacggcacgctcgtcaacaaccgccgcatcacgcgctgcccgctgcgcaacggcgacctgctgacgtttggcctgagcacctttgaatttaggggatagtcgcttatgaacatcgatatcgtcctttttgcaggccgcatcgtcctggtcgccctgctctacatcttcctgttcgccgtcatgaaaaccggcgtgggactcgtacgcggccagcgccgcgactccgctatctggacgatcgatgtggacaagggtccgcgcggcatccgtggcatccatgtagacatgctcggccccgtcatcgtgggccgctcgccgtcctcggacatctgcatcaacgaaccgtttgtctcggcctcgcacgcacgcttttcgctgcagggcccggcactcatcatcgaagacctcaactcgctgaacggcacgctcgttaacgggcgtcagctggtggagcccgcaacgctgcgcgagggtgatgaggtccagattggcgacgtggtcatgaaggtgaaccgtcgatgatcgacgaggagaacaagtccgcaaccatgcccgagacgccgactgcccccgcagctgcgccggctcatgccgctccggcgcgccctgcgaccgtggagcccgaggacaccgtgttctccctgcctctttcgcatgtaactcaagaatatccggcactcgtcgatgacgaggacgccgacaccgagcagctcgatgcccccatcggcgcgcacgctgccgagcagtccgcggaaccggaggcaacgcccgcaccggctcactttgccgagcccgtcgccgaggcgattaacgagagcgctgccgtgtttgcagcccccgagcctgccgcgccggtattccccgtcgccccggcaagcgaggcggcacccgcatccgcaacgcctgccgaagtcgagcagcccgttgccgcgcccgccacagctcccgagccctccgctcaaccccagagcacgcccgcgccgtcgcactttgcgacgcccgagccgacggctgtcgagccgcagcaggacggcaatcccgccgaccgcgtaaccgaagatctcaaccttccggacgtctccgacgtcgagtcgggcaacgatgctgacaccgtctcccccggcgacaccgccgagatcgatgtcgcggccgtggaggcaaagctcaaagatcccggctcgaccatgagctttgagccgctgaccgacgagcgcatcgagaccgactcgacctacgacgccggcaccaccacgcagcttatgtggggcgcccgctccgacgtcggatgcgtacgcccgcacaatgaggactcctatctggtgcagtcgccgctcttttgcgtgtgcgacggcatgggaggacacgccgccggcgaggtggcatcctccatcgccgtcgagaccatcgccaagacggcgccgcagtccgccgacgccgcgcgcctggccgcagccgttgaggccgccaacgccgccgtgatcgaggccgccctcaacggcctgggcaaacccggcatggggtgcacggccacctgtgcctacatcgaaaacgacacgctcgccatcgcccacgtgggcgactcgcgcgcctacctgctccacgagggtacgctcatccgcgtgacccgcgaccactcctacgtggaggagctcgtggatgccggcgagattacggccgacgaggcccgcgtccaccccaaccgctcggtcatcacccgcgcgctgggctcggatcccgccatgtatgccgaccactttaccctgcacatcgaggaaggcgaccgcctgattctgtgctccgacggtctttcgagcatgattcccgatagcgatatcgagaacatcgccacgcagtcttcgagcgcacagatctgtgtcgacaacttggtggacgcggcgctcgccgccggcggccacgacaacgtgaccgtggtggtcgtcgatctggtcgacgacggcgtcatgcgcgaggcaaaacgcgtccgacgccgcaatgtcaccatcgcctccatcttggcccttgtctttgtgctggtagcaggcatctgggcatacacgggcgtcaccggctcctattacttgggaacctaccacggcaatgtcgccgtctggcgcggcctacccggcaagacgctcggggtcgagctccactggctcgagagcgaaaccagcatcaagctgtccgacctgcccgaagacacgcaaaaccgcctgaaggcaggcattccacaaacgagcgtcgacgatgcgcaggacaccatttccaagtaccgccatcagattgacgaggagcagacccgtcaggtgattgacgcgcaaacgattcgcgacaacaccgatcaggaatccacatccgagtcagattccgagaaaaccgccgaacagtcagccgaggccgaagcctccgataagaattagaaagggagtgccgcttatgagtcgccgcaacaccgaactgctcttgctcatcgcctcggcgttccccgtcatcctgctctatgcgatgtacgtgctcaccgcgggtgccacggtttcctttgagacgctcgccgtgccgatcggcctgttcgccgccttcgccgcggcgcatatcgccgtgcgcatcctggcgcccggcgccgaccccgccatcctgcccatcgtctttgtgctctcgggcatcggcatcacattcgtgacgcgcctggcccccgacctcgccatctcgcagctcatcatcttgtttgtctcggtggcgctcatggtgggaacgctcgcactggttaagaacctcgacgtggtcatgcgctacaagtacacctttggcattatcggcatcatcctgctgatgctgccgatctttatcggcaccacgatctcgggctccaagctgtggattcgcatcgcgggcttcaccatccagcctggcgagttcgccaaggtcttcatcgtcttgttcctggcaggctatctggccgagaaccgcgagctgctctccatctccaaccgcaagatcctgggcctcaagattccgcgcttccgcctgctgctgccgctgtttgccgtgtggggcgtgtgcctgctcatcgtcgtcttcgaacgcgacctgggctcggccgtcctgttctacaccatctttttgctgatgctctatgttgccacgggacgtttttcgtacgtcatcatcggccttgcgctgctggccgttggagccgtgggcgcctacaagttcctgtcgcacgtgcaggtgcgctttcaggtctgggtcgatccgtttaaggacgcccagggccagggctaccagatcgtacagtcactttactcgctggctgacggtggcctggttggcgtcggcatcggcaacggcatggcaaacaacatccccgtcgtcgagtccgactttatcttctcggccatcggcgaggaaatgggccttttgggcggcggcgccgtgctcatcctgtttatgctttttgccgtgcgtggcctcaccacggccgcccgcgccaagtccgaccttgccgcctttagcgcgaccggccttacggcggccatcagcttccaggcattcttaatcgttggcggcgtaacccgcctgatcccgctgactggcgtcaccctgccctttatgagccagggcggctcctcgctgctggcgagctttatcatcgtcgcgctactgctgcgcgccggcgacgaggcaaccggacgcgaagccgagctcaccggcaccggcaccatggccgccatcaccgatgaccaggtcgcatccgccgtcgccccgaccggtacgcgttttgccagcgcaccttcctacagccacggcaaccactccgcgggctctcgcatgcgtcgtcgcctgctcgacacgccagagtccggcgtgctcggccgcgtggcacttgccaaccgtctgactcgtgccgtgtttgctttcacggcgctgttcgccatccttatcggcaacctcacctatgtccaggtcatcaaggcgaaggactatacaccgacatcaacatcatcgacaccgccgagttcgcgatccccggccttgacgacgagttccgcgtcatcgtgtctccgtggatcctctcctcgctgatcaccgatcgccttgccgcttactacgagacggtcaccaagcacaacctcaactaccgtcgttactatcaccagttcgactactaatagttgaccactcatttaagaagcaccctgcccgggcgcatgcgtccgggcatttttatgccgaaattcgctaggaaggggaatcgaatgaggcagtttatcgtggcgtcccatgctcattttgcgtctggaatcgtcgagagcatcggcctgctttccggcgagcgcgaaaacgtccatgcgctctctatgtatgtcgacggaaacgaggacctgaccaaggaggccgcagcgattctggacggctttgccgcggacgatgaggtcgtcgtttgcaccgacctctttggtggcagtgtcaacaacgagttcaccaagatcgtccagacgcgtcccaacacgcatctggtgaccaatatgaacctgccgctccttattcagctgctgttcgtgcccgaatccaccccgatcgatgaggccattcgccagatcgtcgaggcggacgacaccaaggtcaagtacgtcaacgacctgctggggcaggccgagctcgatgagttttaaccactagggagcacatcatgattcagatgattcgtgtagattatcgactgcttcacggccaggttgccgttagctggacctcggctctgggtgccgattgcatcctgttggtgagcgacacggtcctcaatgacaagcttcgtctacaggccctgtcccttgcaaagcctgagggctgcaaggtcgtcgtcaaaaacaccgaggacgccgtcaaggcgctccagagcggagtgaccgataagtacaagctcttcgtggtttgcgagacgatccagcaggccggtgccgtcgccaaggcgatgggagtcaagaagatcaacctcggcaacgttgcctttagcgagaatgcccgccaggtctcgacgagtgtgttccttacgcccgaaaacgaggcatacgtcaaagagctgctcggcgagggctatgaactgttcattcagatgattccggcagatgcgaagactgacgccgcgaaggtcatcggttaggggctgtcatggttatcaagacaatcctgattttccttattgcccttttgggctattccgagtggctgaccggtacgagctacctccagcgcccgattgtgctcggacctctggttggccttgtcatgggcgacatggtgaccggcacgatcatgggcgccacgatggagcttgccatggtcggcgccatctcggtcggtgcgtataacccgcccgatacgatttccggaaccatcctgggtgtgtcgcttgccatgcaggccggcgcggacgcttcggcggccctgaccctgggcattcccatcgcaacgatcgtcctggcgcttgatacggccctgggccagccggtgatgctactgctggtgcaccgtatcgacaaaaacgtcgaggacggggacaccaaggccatcacgcgcaacatgctcatcgccggttacgcgcagagctggtgcggcctgctgattattcccctggcattcttctttggcgccgatgctgttgccagcctgctcaacatcatccccgatttcgttcaggccggcatggatgtcgccgccgccttcttgcccgcactcggctttgcgatgctggcgcagatgattatgaacaaaacggtggcgccgttcttcttcgctggcttcttcctcgtcgcctactttggcattagcacgacgggcgtggcgatctttgccgcgatcatcgtcgtcgcgatgacggttttgggtgataagaaaaaagcggagcagcccgcagtggcaaccgaggatcctgcgattgggagtgggttcgatgagttttaagtttgagtcttcttacgacgggctgatttcccgcgcagaccttaagaagctgttctggcgctcgattccctatgagcattcctggaactacgagcgtatgggccatatcggctttatgtgggcccttatgccgattcttcgcaagctgtatccgcaggatgcggactttaaggccgcccttaagcgccatatggagctctataacgtcacgccgtacatctcgacgctccccatgtccatcgccgctgcaatggaagaggtcaacgctactgacgatagctttgacacgagcgcgatctcaaatgtcaagcttgctttgatgggaccgctgtccggtgtgggcgatgccttctactggggcacgctgcgatttttggcaacgggtgtcggcacgtcgctggcgctgcagggctctattcttggcccgattttgttcctgctcgtgttcaacgtccctcactacatcatccgttacctgctgacgtttgtgggatatcgctttggctcggacatgatcagcaaggtccaggaatcgggcattatggacacgatcgtcaagatggcctctatcatgggcgccatggtgatcggcgctatgaccatggagatggtcaccgtggacattccgctcatggtcggtgcgggcgatggtgctcagacgctggccgagctgctcaacggaatcttcccgggctttgtcacgatggggctgtttggaatcgtctatctcatgctcaagaagaagatgaatccgctgcttatcatgctcgtgatcctgctcgtgagtatcgctggcgcgttctttggagtgcttggtgtccagtagagtatccgtcataatgagaacaatgtaagagggggcgtcgcgcacactgtgctgcggcgcccttttgccgaaaggtggacaagatggagtatccgcagcttgccgtcatgaatatcagccatcgttattttgaccttgaggaattcttttcttcggcagcggcctcgggctacacgtgttgcgagctttggaccggggcgatgcatctgtatgtcgattgccatggatacgattcgctcgagcaggtgcgggagctgtcgcagcggtatggggttcggattgtggggctttgtcccgaacagaacaaccccaagccgtggaatatcgcggcgcgcgggaatgaggcacgtgcccgcacgctcgcgtactttaagaacgttgtggatatcgcggcggaacttggagccgagcaggtcatggtctcgagcggctgggcatttttgaacgagccaatcgaggacgcgtggggtcgaagtgcctcgatgctgcgtgcgattgccgagcatgcgggagagcgcggcgtgcgactggtgctcgaggccctacagccggttgagtcgatgatcgtgaactcggcggccgacacgaagcgcatgatcgaggcagttgatcatccggcacttaaggcgtgtctggatataggcgctatggcggtggcgggggataccatcgacgattatttcgatctgcttggcgatgatgtcgcccacgtgcattttgtcgatgttgcggcagatggcacgacgcatcttgcctggggtgacggcgaccgcgatatgcgcgccgacctggataggctggtggcgcgcggctatcgcggagttgtttcggccgagacctatgactggcgctattttgccgaccccgcagctgccgatgcgcaggtaatggcagagtatcgtcgtgcgattggcgcctaggtggggttgggttgcggcaatctgccctatgtttccaaatgaatacggtgtgagcggctacgacggattttccccgcaagcactctagtatgctaaagtacccagaagaccggcggagctatgccggtcttctgttctatatgaaacacagcatgaggaggctcaccagatgacggccacaccgtggggattccgggacatattgcccgaggaggctcaggcgcgcgaggagattgcgctgacggtgaagggctgctttagggagcatcattacctgccggtcgagacgccgctgctcgaggacaagggctctctcgaggagggtggccgcattgcggacaccccgtttaagctctttgatgatgacggccgcctgctggtggtccgtcccgacaacacgctgccaatcgtgcgcttggtttcgacccgcatgcgcgcggccgatctgccgctgcgccttcgctacgaggcgccggtggttcgcgagtgccagcgcaatgccggcggctcgcgtcagtttacgcagttgggttttgagcttatcggtgtgggcgataccgcgggcgatgtcgagatcgtctcgctggtggcggaggccgtgcgcaagctggcacttcccggtgcgcgcattatcgcgggcagcgtgcgtccgtttaaggaactgctcgcggcctgtgaggatcgcgaactggctgccgaggcattgcgttgtgtgcacgccaacgacttcgtgggcctcgatgcccgcgtggcgaaaagcaccgagtccgaggccgttaaggtcgccattagcgagctgccgcgcctgcacggtggtgccgaggtgctcgaccgcgtcgacgcgctgctgacggcggcgggcgttgtcgcgccgctcacgcgcgagctgcgtgccctggtcgagggcctggctcccgaggacgcccaggtgctgtccttcgacttctccatcatgaactcgtttgattactacacgggcctggtctttaaggcctatgccggcggactgcccgatccggtcggttcgggcggacgctacgactccatctttaccggtgcatttggcgacggcatcgaggtgccggcggcgggcttcgccttttcgctcgagcgtctggaggccgcgcacacctcggccgaggacgctgcttccgatggcgatcacgccgtggggcgcggtgccgagggtccgctgcgcattgccgtgcccaagggctcgcttaaggctgacacgctcgacgtgctcgaggccgcgggcttggatgtctctgagctgcgtgaccccggtcgtcacctcatcgtgcgcggccgcgacacacaggccggtgagggtgcggtcggcgatatcgagtttgtcatcgtgcgtcccagcgacgcgcccgcctttgtgggctgcggcggtgccgactgcggcatctgcggctgggactcgcttatcgaggcagacctcaacctgctgcagctggtcgacctgggctacggtctgtgcacgtttatcgaggcggagcccgcgtggcgcgccggccaggccgagcgcaactatgcccgccgtgggtcgcttcgcgtggcaaccaagtacccgcgcatcgcgagtgcctggtatgccgagcgcggcgtgaacgccgacatcgtctcgctgcacggcaatattgagttgggccccatcgttggcatgaccgatcgcatcgtggacattaccgccacgggcgccacgctgcgtgacaatgacctggtcatcaccggccgcatcatggactgcacggcccgcttctttgtcaatccaggcgccgcacgtctggatccgcgcgtacgcaatctggcagatcgcttggcggcagccgtgaaggacaggcattttgagcccgttgcgggctcggcacaatagcgcgagcacgcacgggcgccccaacgtctgggctgcgggtcgactggcgccgccgcccggcctctcgtttttcgaacataacctcgaccgataggggataccgatatgaagaccatcaagcttgctcccggcgagcgcctcgttaccaaccagctcaaccgtaagggcgtgctgccgcaaaacatcgtcgacgccgcccgcgatattgtggccaacgtgcgtgccaacggcgatgccgcagtgcgcgactattgccagcgctttgacggcgttgaactgcagagcttccgtctaccgcaagagcagatcgatgccgcgctcgaaggcctcgatcccgcttttgtcgcggcgctcgaaaaggctgcacgccagattcgcgagttccaccagcgcgaggtcgagcagagctggtttaccacgcgcccggacggcacgatgctcggcgttaaggtgaccccgcttgctgcggccggtatctacgtgccgggcggtcgtgcacagtacccttccaccgtgcttatgaacgccattcccgccaaggtggccggcgtcaaacgcgtggtcatggtgaccccgccgcaaaaggacggcctgataagcccctacacgctcgccgcggcaaagctcggcggcgtggacgagatctatatggtgggcggcgcccaggccgtggccgcactggcgtacggtaccgagaccattccgcgcgtcgacaaaatcaccggcccgggcaacgcctttgtcgccgctgccaaacagattgtctcgggtgacgtgggtatcgacatggtcgccggtccttccgaggtctgcgtgctggccgacgccacggccaagcccatggtggtcgcggccgacctgatggcccaggccgagcacgatccactggcagcctgctatctggtgacctgcgacgagcagtttgcgcgtgaggtcgaggcgggtatcgatattctggtcgcgcagtcgccacgcgccgagattacgcgcgcctcgctcgacaatgagggcaccatcgtggtggccgccgacatggctgccgccgtcgaggccgtgaacaccgtggcgcccgagcaccttgagctgcactgcaaggacgcgatgggcctgctcggcggcattcgcaacgccggcgccatctttgtgggtgcttggagctccgagccgctcggcgattatgttgccggccccaatcacacgctgccgaccggcggcacggccatgttctccaacccgctttcggtggaggagttcgtcaagcgctcgagtgttatctgctatacacccgagggcctgctctcggacgctcccgccacgcagcgtctagccgagtccgagggcctgtgggcacacgcgctttccgccgcactgcgtcgccgtgtgctagagcagggcgaggatgccgtgagcgtcgagtcgctcgccgcggccgacctgaccaaggtcgcctggccgggcgaccccgtggcgacggttgccgagggcgttgacctggcggctgcgggcgcggatggcgttggcacaactggcaaggaggcctaatatggccgagctgacgccccgtatgaaggagctcgtccagccctacttggccggcattgagccctacgatcccaactttacgcccacacgcatcaacctttcggccaacgagaacacctatcccgtgccggctggtgtgcgcgaggcggtcgacgccgccctggctgctacaccgctcaaccgctatcccgatcccatgtccaacgatctgcgcgacgagcttgccgcttggcatggtgtggcgcgcgagaatgtctgcgtgggtaacggcggtgacgagctgctctataacttcctgttggcgtttggcggcgcgggacggaccctgctcaactgcccaccgtgctttagcgagtacgcgttctttgcgtcgctctgccagaccgaggtgcgcgacgtgtggcgcgaccctgcgacctttgagctcgatcagacagccgtgcttgcggcggcgcccgagtgcaacctggcaatcgtgacctcgcccaacaatcccacgggtgatgtgacgccgctcgactttgtcgcggccctgtgcgatgcgtgccccggcatggtaatggtcgacgaggcctacgttgagtttgccgacgatttgtttggcgcggccaccacggcgcaggggcttatcgccgagcatcccaacctggtgattctgcatacgttgtccaaggcgtttggcgctgccggtacgcgtctgggctacgtgatcgcggcgtccgaggtcatcgacgtgttcgcggcgattcgccagatctattcggtcaacgtgctgagccaggcggcggcgcttgcctgcgtgcgtgcccgcgatgcgtacacgcccgtggtggcacaggtcgcatccgagcgcgagcgcgagctgtgcgccctgcgcgcgatggctaccgagggcctgcccgtggaggcatggccgagcgcggcgaactttgtgctcgtgcgtacgccgcatgccacgcgcgtgcgcgagcgcctacgcgacgagtattcgattttggtgcgcgactttagctatgcgccggggctttcggactgtctgcgcattaccgtgggcatgccgcaggaaaacgatgaggtactggctgcgtttgccgtgctggtgaaggaggagatctagatgggccgttatgccgaggtgacccgcaagacgggggagaccgacattgtcgtcaaactcgacctggatggaaccggtacgtgcgatatctcgaccggcgtgccgtttttcgaccacatgctcaacgcctttggccgccatggcctgttcgatttgacggtgcatgcggtaggcgatgtagaagtcgatgcgcaccataccgtcgaggacacgggcattgtgctgggcgaggcgttttgccgggcgctgggcgacaaagcgggtattacgcgctttgccgatgcggcgatcgccatggacgagacgctcgtgatggccgccgtggacatttcgggtcgcggccaggcctactgcgagctgcccgtgccgaccgagcgcgtgggcagcttcgataccgagctggctgtcgagttcttctatgcctttgcgcgcgatgccaaacttacgctgcacgtgcgcgagctggcgggcggcaactcgcatcacattatcgaggccgcctttaaggccgtgggccgcacgatgcgccacgcctgcgagctcgatccccgcgtgcagggcatccccagcaccaagggctcgctataaccgtcacaagggtaaaaccaccacgaaggggacaggcacctttgtggtggttttggatgatgagaagtggaggggtcgcgtgggcgaaccgaagatcgtggtggtcgactaccacaagggcaacttgtcgagcgtcgtgcgcgggcttgcgcgcgccggtgccgccgcctgcacatcggacgatccggaacagatccgcaacgccgacggcctggtcatcccgggtgtgggcgcgttctatgacgcgatcgcctttatgcgccagagcggcgaggaggtggccgtgctcgatgccgttgccgccggaactccgctgctcggcatctgcctgggtcttcagctattttttgagcgtggcaacgagggcgtgcctgcggacgagggcgtggacgcggacgacgatgcctccgagcaggccggcggtccctgggtcgatggcctgggcatcatgcgtggctcgtgcacgcacctggagtcgagccgtctgaaggtcccgcacgtgggctgggatcaggtgcacatgacgcctgccggcgcggccgatccgctgctcgccggttttgccgagggcgccaatatgtacttcacccacagctacgcggtggccggcgacgtcgatgccaccgatgtgttggcgcgcacgcactatacacggagtttcccgtgcatcgtgcgccacggcaatgtgtggggctgccagttccatcccgagaaatcctccgcgctgggtcagcgcatccttaagaacttcgtcaacatcgtcgaggaggttggccgatgatcctgtttcccgcaatcgatctgatcggcggcaaggttgtgcgcctggagcgcggcgaccgcaaccgctgcaaggtatattccgatgaccccgtggccgtcgcccgctcgtttgccgagcagggcgcaagctgggtgcatgtcgtcgacctgtccgctgcctttggcgaggacgaggacacatgcgctgccaactcggcggcgattaaggccatctgcggcgtcgacggtctgtccgtggacgtgggcggcggcgttcgctcactcgcacgcatcgatgagctggcaggctatggtgctcgccgcattgcgctgggcaccgtgctcgtgaccgagccgggttttgctgaggtggcagcccagggccttggcgagctgttggtcgccgacattgccgcgcgcgacggccaggttaaggtgaacggctggcgcgacggcgcgggcgtggcactcgacgatgccgtggcgcagcttaccgagctgggctttaaacatctggtgtataccgacatcgcgcgtgatggcatgcagacgggcatcgatgtggcggcgtatcgccatgtggcgcaggtcgcgggctttcccgtcgtggcgtcgggcggtatctcgacgctcgacgacatccgcgcgctggccgcggtgggcgagggcgcgattgaaggcgccattaccggtcgtgcgctctacgagggcaactttacgctggcccaggcgctggccgccgctcgaggggaggagtagcccatgcttaccaagcgcgtaattccctgcctggacgtcaaggacggccgtgtggtcaagggcgtcaactttgtgagcttgcgcgatgccggcgatccggtggagctggcccgcgcctacgaccgcgagggtgcggacgaggtcgtatttttggacattaccgcgacgagcgataaccgtgcgacgactatcgagatggcggcgcatgcggccgaggagctggccattccctataccgtgggcggcggctttcgcgacctggcgggcatgcgcaccatggttgccgccggtgctgacaaggtgtcgctcaactctgccgccgctcgcgataacgggaatcggcaccgcgcgggccaaggtgtcgctcaactctgccgccgtgcgcgatccgtcgttgatcagccaggccgccgcggcgtttggcagccaagccgtggtcgtggcgatcgatgccaagcgcgtggggctgcccggggagccgggcgccgataagtgggaggtctttacggcgggcggccgcaacgctacgggtatcgacgcagtggcgtgggccgaggaggcggctcgtcgtggcgccggcgaaatcctactgaccagcatggaccgcgacggtaccaaggccggcttcgatctggcgcttactcgcgccgtggcccgcgcggtgccgattcccgttatcgcgagcggcggcgtgggcacactcgagcattttgccgagggtgtgatcgagggcgaggccgatgccgtgctggcggcgagcgtctttcactttgggacgttcagcattcgcgaagtcaaagagtatatggcctctcaaggtattcctgtgaggctggacttctaatgctgcggcttgcccaggcacccgaccttccggctccaaccctcctcgcgtacttaagtacgcgtcgtcgggcttgtcgctcggaatctcgggcacctggacaaccctcaccgacctgcgaagtttgaatttgggaagagaaatggaagagataaccgatccttcaaagcttacatacgacgccaaggggctgattccttgtgtggttcagcagtatgacaccggcgaggtgcttatggttgcttggatgaacgaggagtcggtggggctgacgctcaagaccggtaccacgtggttttggagccgcagtcgccaggagctctggaacaagggcgcgacgagcggcaatatgcaggaggtcaaggagctttgggccgactgcgatagcgatacgctgctggtcaaggttgactcgccgggtccggcctgccataccggcaaccgtacctgcttctttaagcgcgtggaagggggagtgcgatgaaagtcgtgacgccgttcgaggtcgccgactgcaacaccgagctcctccgcgcgggcgtgccatgccgcgtgcacctgactgatgcctgcggggcgcagtcgctttggctcgaggccgagaaggaaaggcttgatgaggcccatgccgtcatcgtcgagttctttgagaaaaagggcgcaaagcctcggttcgatgagaccggtacctactttacgctgcagtaacgagaggaaataaccatgggagtcagaacagctaacgtgcagccgggaaatatcggcgagacgctgacgggactggccgaggtgattcacgggcgtcgcgatgcgtcgccacaggagagctacaccgctcgtctgctgaccgacgtcgaggacgaactgctcaagaagcttgccgaggaggcgagcgaggtcatcatggcctgcaaggacaacgaccacgaccacatccgctacgaagccggcgatctggtctaccacctgctcgtgacgcttgagcgctacggcatcaccctcgacgaactggccggcgaactcaacgctcgccgccactagtcaagcttttggtgcaagggggacagtagtcattggggacgttcttaaacgactagtcgtttggggcagtctttgccggcgctgccaaataacatgcccaattactacgatgaaactggatctgctgaccacacgtcggttttgaacaaatcgtcaacgcttctacctgcggttttattttccgcattaagccgatggtcggaggtttgcggttcatcgtagtaaacgggcgttctttttggcgggcggtgttgcacgggcgtcggtggtgagcgaaacgacctgttttcctccgtccccaaggggtcatttgtgaagagtgccctcaatgactagtcttaggcgaggggcgtgggctcccattcgccggtgaggtgggggatgtcgaaggttcgatagccgcagtcgtaggcgtggccctgggcctcgcggatattccagcaaatatcgcaggcgcggtgcgcgtccgagccaaaggtgatcggcacttcggcatgggcgaagcaacgcaaaaggccggtcgcgggatagtagtcgtcgagtcccttgcgcggtgcggcggtcgagacctcaacgcggcggcccgtatcgtgcgcgcactcggccatctgcttccagaatggcgcggggtcaaaatcgggcgcaaagccttccttcgaaaaacgcatgaccaggtcgggatgagccatcacatcaaagttaagcgagctttcgcaggcgcgacaccagtcgtcgacgtagcgctcccacacaccgcgcacgcccaggttttcccaaacgtgcaggtcggtgtcgtcgtcgatccaaccgcaaagggaatcgggtgtatcggggcgagcgacgttttccgttcccgccgtacccgcggcaccggccatgatatcgcctgggttgccaatccaatgcacgctgcccaggcgtacgacggcgccctgggaccagcgctcaaccaaaggctcgcagctctcgtaccaatcgcattcaaagccatagataagctcgagctccggcgcgatctgcgcggcaagtttgcgagcatcctcaaaagccagacgatgcgccggcaggtcgccctcgacaacctgtacctcgcaattggcatccatgctggcgggcagggtgagatggtcggttgagaccatgacgcggcagccggccgtagcggcggcgcggacgttgtcctcaagcgaggcatgcccgtccgagaacgaggtatgagtatggcaatcgaccagcgggcaagcagacatggcagctcctttgcgtcaagcgaatccgctccattgtaacggcgcggtccccgatgcgacgagcgcaccggggaccgaaattgactggaaaggtgggttgcgtgcgagggtcgccgcgacggtatcggccccgcgtcaaaacatgtacatcagcctccaaaagctgcaaaaaatgacatgtttggaggctgatgtacatgtttggctgaggcggtggagtgtcggtttcttgcgaacaaggaaaatcgcgctcatcgcgctctgccacatccacgccgcccgcgatgtgttagcgtttgggtgaacaaaacgagcccgtgcggaaaggagccggaccgtatgccatgcgatagcaaatctccgctgtcccgcgagaccgatgcgcccgagactatcgtcaagctggaatgcgatatcgacgacgcatcgcccgaggtgctcgcctacgccgccgaccgcctgcgcgaggccggtgcgcgcgaggtgcactggctgcccctctattgcaagaagggccgtcccggctggcagctgcaggtaatctgcacccacgaggatatcgagcgcctgcagacgatcatctttttggaaaccacgaccaatggcatccgccgccaggttatggagcgcgtttgtctgccacgccgctttgagcgcgtaacgacgccatggggcgaggtgtccgtcaaggtggccaccctgcccgacggcagcgagcgcgcggcgcccgagtacgaggactgcgcccgtcttgcccgtgagcacgacgtgccgctccagcgcgtgatgcagacggcccagagcgcggcactgcgatttgaataacgcggccggcgacatcccgcgcccagccatatcaaccccatccgaaaggatctccccatgaaatacctcatcgcctccgacatccacggttcggcatattggaccgagcgtctggtcgccgccatcgagtccgagcagcccgaccgcatcgtcctgctgggcgatctgctctaccacggcccgcgcaacgatctgccgcgcgactatgcccccaagcgtgtgattccgctgctcaacgccctggctgaccgcatcatcgcggtgcgcggcaactgcgacgccgaggtcgaccagatggtgctcgacttcccggtcatggccgactacgccacgttgttcgacgagaccggccgcgagctgttcctgacgcacggccacgtctttggcgccggcatgcacaacagcgtcgaccacgcgcccgcgctgcccgagggctccgcgctcgtctacggccacacgcacatcaaggtcaacgaggagagcgccgcgcacccgggcctgcggctcttcaaccccggcagcgtgagcattcccaaggacggctcgcacagctacggcatctacgagggcggcgcgttccgccacgtgatcatggaggaggactaaccatggcgcagcacatggctcagcaaaatgccgagggctcgcgcgatctgtccacgctggtagatgcatcggccgagctgcagcatctggtgcagaccatttggcgcctgcgtcagcccgacggctgcccgtgggaccgcgaacagacgcatcagagcatcggcaagaacatgattgaggaagcctacgaggcgctcgattgcatcgaggccgatgatgccgcgcatctgcgcgaggagctgggcgacgtgctcatgcaggtggtgctgcatgcgcagattgcggcggacgccggtgagtttacgctggccgatgtggcgcgcgatatcgacgccaagctcattcgccgccacccacacgtgtttggcgatgcggacgccgataactccgacgaggtgctcaagatctgggacgaggttaagcttgccgagaaggctgccaaggacaaggccgtggcagcaggcgaggctgcgcccgagggcctgctcgacggcgtgcccacgcatctgccggcgctgatgcaggcgcagaaggtgtcgcgcaaggcggctgccgtgggctttgaatgggagacggtccaggatgtgtgggatgaggtcgccgaggagcgtgccgagtttgaggccgaggagcccggctcgcccgagcgcgaaatggagtttggcgacctgctctttgccctagtcaacgttgcgcgcaaagaggggattgacgccgagagcgcccttcgcgccagcacggcaaagttccgtcgccgttgggctgcgatggaggccgccgtgcacgaggcgggcgatgacctcgccgcctgctcaaccgctcaactcaacgacctgtgggaccaagcaaaagcaagcgagtgaggcctgcgtctctcacggcatccattcgtagagaggtctctacaagcaaaaagccatatacaacggaagatgtgccagctgcgcttcggcatcccactcgagttgtttagggtgcaacacgtaagccatcccaatcttcttgttaaagcgcgcgcggaatcggtcgagggagatggttccgtatctgcgtggcgacttaacttcgacggggctgatgcgcggctttccggcggcattgacatagggtcgggtaacgaggaagtcgatttccatgcgctcctccccctccttctttccgctttggaaataaaagaagagcctgtgtccattggcctttagagattgggcaacgtagttttcggtaagcattccttcgttcaatccgatgtcgccgcgaagcacggctctgtaaacgtcttcatcggtatcgttgttgtcagagaaggcaagcgttacaagcaggccggtgtctgccatgtagcacttgagggccgtttgctccatgctgagtgaaagacccacactcggttcgcttgcggcatagcagatattggcaattcgcgcgtctgccagccaaaagaaggcttcttcgtaggtgcgcatgcgtgcgtttttatcaagtgaggaaagcttgaatcgtttttcgtgcttagagagctgacctgggatgccatcgagtacggagacgactttgaattcgtaaccggttgcaaaacgagagatatcgttgcgatagagctggacgattcggcgcttcgaagcgtcgacgggcgcaaaagcgcgctgttcaacatagatggataccggctcaggcatgccgcctacgagcatgtattcgcgcataagggagagcgctctgcgatgtagggcatcggggagcggcttcatcttgttaaaactcatgcgaatgagatcggccagccccttttcgtccatgccccaaagaaactcctcaaagtcgaggggctcaagttccagagactcttcctcggatgggatgacgatatctttaatgttctgcttgatgctgagcagggatccagtttcgatgtagtcgtaacgtccgtctgcaacgagatacttgatgagtccgcgtgcttgcgggtacatctggacctcgtcaaagacgataagcgtctcgtgttcatagagtttgacgttatagaaaaccgagagatagaggaagagcgagtcgaagtcagtgcgatagtcctcaaaatattgcttaacttcggcaggtgcttgaaagaaatcaatgacaaggcaggacttgtattcggtttctccaaacgtgcgggcaagcgtgctcttgccgacgcggcgggctccttcaataagaagtgctgttttaccagcgctttcatgcttccattttagtagtttgtcataggcttttcgtttaagcatggctacctcgtgcacgatatccagaacttttgtaacctgattatgcacgatatccagaacttcagacccttagaattgcacgatatccagaactttgcacgatgcaaaagcacattattggctctttcattcgtaagccaggtaaagacggtatgccgatagaagaatttaatggggggcgacctctagagatgaatgctcggtgcaaaaacaagcgcctcaaaaagtgatttctctaattcatatgtatccctcggctaacttagggcataatgcaaaaagtgcgacatggctaacttacggaggtgcaccgatggtgcacagtcggccagtcgcttgcatcaactacgtttccaagtgagagggagacaacatgagcgatattttggatgtctacggtcgcgaggtactcgacagccgcggcaaccctaccgtcgaggtcgaggtcgtgctcgaggacggcagcttcggtcgcgcgatggtgccttcgggcgcttcgaccggcgctttcgaagcctgcgagctgcgcgacggcgacaagggccgctatctgggcaagggcgtttcgcaggccgtcgagcaagtcaacaacgagtgcgctaacgccgtcgtgggcctcgacgccttcgaccagcgcgccgtcgatgccgcgctgattgccgcggacggtacgcccaacaagaccaagctcggtgccaacgccatcctgggcgtgtcgctggccgttgcccgcgccgctgccgagtcggcaggcctgtcgctgtatcagtacctgggtggcgtcaacgcccacctgctgcccacgcccatgatgaacatcctcaacggcggcgtgcatgccgacaacaacgttgacttccaggagttcatgattatgccggtgggcgccccgagctttgccgagggcctgcgctggtgcgccgaggtctaccacaccctcaagggcgtgttgcacgaggccggccttggcggcggcgtgggcgacgagggcggcttcgcacccaacctcaagaccaatgccgagccgttcgagtacattaccaaggccgtcgagaaggctggctttaagcccggcgttgacttcatgtacgccatggatccggcatcgaccgagttctacaacgccgagaccggcatgtacgagctcaagggcgagggcgttgagtacacgagcgctcagatggtcgattactgggagaagctcgtcgacacctatcccatcatctccatcgaggacggcatggcagaggaggactgggacggctgggttgagctcacccgccgcattggcaataaggtgcagctcgtaggcgacgacctgttcgtcaccaacaccgagcgcctcaagaagggcatcgagctgggtgccgccaacgcgatcctggtcaaggttaaccagatcggtacgctcaccgagtcgctcgaggccatcgagaccgccaaggaggccggctacgcttgcatcgtgagtcaccgttccggcgagaccgaggactccaccatcgccgacctggtcgtgggtgttaacgccggccagatcaagtcgggcgccccgtgccgcagcgaccgtattgccaagtacaaccagctcatccgcatcgaggacgagctcgagggcagcgcgcgctacgccggtaaggccgcgttctacaacattcgctaaacgggcgaatttggcgagggggaggctgactcggttcctccccgtcttggctggatgccgcaaagaactatgggcgctgggccatacggctcagcgccttttttatgtcgagcaaaggctggcgaaggcggtgcgggcgctcgtgctataactaaaggacttagcgcaaacaaacctcaaccgcacaaggcgcacatggatcagatttacgacaacaggtattattccgccggttcgcgcgagccgtcgcctcgtcgtgcgcgtaccgcacagcttggcgggtctggttatgctggtgctgatcgctccaggtatagctcgccggcgacttcgcatcccaatgctcagccaaatagttcctcggatagtccggtgcgcccatcgcgttccaagcatgcgtcgcgcccttcgacccaggcgtccgacaagccgcgccgtccctcaagccgtctttccggctcggactttatgcactacgccaacgacaacgcagcggtcaaggcaatttacgactttacccacggtcctcagcgagggctgtttatcggtattgtcgtcgccctggtgctcgtgagcctgtactttcccgtgcgcgacctctacgttgccaaacgctcgagcgatatcttggccaagcaggtcgagattcgccagcagtacaacgacgagctgcagaaaagcgtcgacaagctgctctcagaggagggcattaaggacgcggcgaccgaggacctgggcctggtgatgcccggcgagaccaagattgacgtgctgggcctggacgacgattcggactcgtcgtcgagcaaaaagtcctcgaacgccaagaaggccagcgaagtcgccaaagagatcgaagaggtcggcaaggacgcgccgtggtacatccagacgctcgatatgctgtttggatttaacggcgtcgagggccagacggtcgtgtccaacggcaaatagcgtccggaggggagcctgcaatgacgcattgcgacaaacgatataaggtggcggcgattgacctgggaacggtgtcgtcgcgactggtgttggcccaggtcgaggacggggcgatcgtggaatcgtccaagcataccgagattaccgacttgggcgagggtgtggacgcgacggggcgcttttgcgaggcggccgttgagcgcgtgctcgctgcgtgtcgcatgtttgtggatgaggcacgtgcctttggggccgcgtgcatctgcaccacatgcacgagcgccgcgcgcgatgcgtccaatgccgcgctactgctggacggcctgcgcgagctggggctcgagccgcaagtgattccgggcgaggtcgaggcgcgcctgacgttttttggcgtggcacacgactttgccggcgagcgcatcatcgttgccgattcgggcggcggatccacagagctcgcgacgggcgtctatgcgccggagcgcggcgtctttgcgctggaggggacgcgctcgctggatatcggttgccgccgcgtgaccgagcggtttttctcggcgctgccgccgtcaacggacgagcttgcggctgctgccggctgggcaaacgagcagtttgcgggctattttgagagcctgcctgtcgactttgagcgcgccgagcgcctggtggcggtgggtggtaccgtcactacgctcgtggcactcgtccacgaactggagccgtatgattcaagctttgtgcacctgcgcgagctttcgctggagcaggtttcggccgctatcgagagcatgtccgcgctggatgttgcgggcatcgccgcgttaccgggcgtgcaacccaagcgcgcgggcgtgattttggctggtgccgttgtgattcgcgagctcatgcgagccggcggctacgatacactcaccgtaagcgagaacagcctgcttgccggcatggccgccaccatcaacgaggttctcgacggcgcgacccccaccatcgcctggacccccagcctcagcgccctttaaccatcccctcataagttgcggtgaaatagttcctaaatgggctggtagcctgccaaaacagaaactatcccatcgcaacatagagccccatcggcatccaaaagaaacgagcccgcatccctgggggacacgggctcgtaaacaatgcgtggtaggggcggtgggacgtccgcgtatttgctgcgcaaatccgcaccggcttcggccgcctgccggcgccctcgtcggctcgctgcggacgctgcgcgtccgtttggcgctcgccccctcgcgggttcgagtcccaccggcatctaaaagaaacgagcccgcatccctgggggacacgggctcgtaaacaatacgtggtaggggcggtgggactcgaacccacaatccttgcggcgagagattttaagtctcctgcgtatgccaattccgccacgcccccgtgagactagaagtctagcacaagccgtccgttacgcgttgacggccatcgagtgttggcccgacttctcgaggaactcttggaactttgcctcgtcgcccttgttttggtactgcagggccagcaggtactccaggcggcagcgcttgaccgggtcgtcgccgacatcctcgagcatgcgctccagctcgggaatgtcgttgtggcgcttgaggatcatcgtgtcgtacatcagctggcactcgtgcgcgactgcctcggcctgaccgccctcaaagcccttgatctcgtgcagcaactccttggactttttgcggtcctcctggccaacgtagtagttaaaggccttaatgaccaggtcgacgcgctgcatcttgggcaggttgagtcccagcagcagatcgaacatctcgctggcgcgctcgtggtcctcgcgcagcagataggagttcaggcgcaggtagtcgcggttgtagcgcgggtacagcatgctggtgagtttgccgtcgagcaaacgatcgaactcgtcccactgcttggcggccatgagctgctgcaggcgcttaaacgtggtgcgttttttgacgctaaagaacaccgacacggcgatgcagatgataacgacggcggtccagagtgtgcgggaatcgggcatattagggtccttagtcgctcataaagcgagcggtatgacaacacgtactggatgtattatacgcagcgcgcaagcaaactggcataaaagctcatcgaggccgagtgacatcgctcgctgcggtacacttacctaaagtaaaccatgaagggagacattacctatgaagaagatcgttttggcttgcggtgctggcgctgctacttccacgctcgttgcccagaaggtcgccaccctgctcgacgccaacggttatgccggcaagtatgagatcgtgcagtgcgccatctccgaggccaaggactactgcgacgagggtgctgacctgctgatcgccaccaccgttgcccccgagggcctcacctgcccgtacgtgagcggcgtgcccttcatgaccggcatgaaccgcgtcgctgccgagaaggccgttctcgacgtcatggctcagtaggctctgcctgtatgagtgagcagaacgccaatccggtcgagctctttggcatgcgcgttgcccatgtgggcattaacgccaccgacccggcagacgccctggagatcgcggagctgttctcgacgatgatgggcctgcccgtcatcgagacccccgtttcgtactttaacgattcgctggtcgagatcatgaagcagaacggtcgtggcgccaagggccacattggctttgccgtcaacgacattgatgcggccgagaagtggtttgccgagcgcgggctcgaggtcaacgaggagtcgcgcgtgctgctgcccgacggcggcaccaagctcgtgtactttaagcgcgagttcgccggcttcgccgtgcacctgtgccgcgagtagcgcacaagctgctatggctaacgaaaaatggggtaaggcgcgtggccttgccccatttttaatgccgagagggtgactgacgggctgccgtaaaacgaaggtgaatggttttccgcgaagtgaacgagtgaaatcgaacccctggagcatcgacacttttacgtcgctctttcctgcggttttgtcaggtatttcctgcgggtttggcgccaaaaagtgcggatgcttcgggggtccaaaataggtcgttcacttcgcggaaaagcattcaccttcgattcacgagggggcttcctaccgtggcaggcgaatcgtaaagcggctgccgaccccttcgaccgaggtcacaccgatgacgccgccgtggctgtcgacgatccacttggcgatggcgagccccagacccgagccctgcgcgccggcatcgcgcgcgttgtcggcacggtagaaccgctcgaacgcgtgagctgcggattcctggttcatgccgatgccctcgtcctcaacacttatgtcgatcgtgcccatgcccgcatcgggcgttatgccaaatgtgacggtcgttcccgcgtccgaatacttggcggcgttttgcacgatcacgcgcagagcctgcttcacgagcgccacgtcgacgggcgcgtcgcagcgcgggtcgctggcaagcgtggtgtcgtacaccagccgatacgtgtgctcggtatcgatcatctgcgattcctcgcatacctcgccgaccagtgcggccaggttggtatgcgcacgccgcaggaccgtgcgcccggcatcgccgcgcgccaaaaacagcagctgctccacgagctcttgcatgtgctcgctttcggccttgagggacgcgatggattctgccagcacgtctgggtcgtctttgccccagcggtcgagcatgtttacgtagccctgaatcaccgcgatgggcgtgcgcagctcgtgacttgcatcgttgacaaagcgcatctgctgcaacttggcctcttgcatctggcgcagcaggcggttgagcgcgacctcgatgctcgccaggtcggcgtcgccggtggtgacgctcggcgagtcgacgcttgcgcgctcgatggcctgctccagtgtttccatcttgccgccggagagctgcatgcggccgagctcgtccacgcgcaaggccaggtcgttgagcggcgccatagtacggcgtacgcggcgggcaccgccgagcatgttgagcacgctgatgacctgccatcccacaacgacaaggtagagaggccatagcgtgacgagatcctgtgcaagggggaaggtcttgctggtacgcgcaagctcaacggtataggtgagcgttgtcaggtcccagccgcgtgcgggcgtcagcgacatgccgcgaacggtggcgttggggatccatcctgcggtaaacgcgccgtcgggcagcgtctggttgtatccatagacgaggatcgccgccgcaatcaccagcagcaacagatcgagccagacgtagctcatcaggcggcgccacatgtagctccagttgatggcgcgggcgatggaggtgacgcgcttggcttcggcgttacgcgcggcagacatagcccaccccgcgcacggtctggatgatgcgggcgctgccggcgtcctcgatcttggcgcgcaggtgcgcaatgtgcacgtcgacgttgttggtgtcgcccacgtattcgtagcccagcgcttcgtgcgcgatgcgctcgcgcgtgagcacggtctcggcatgcgccataagcagggcgaggacgtcgaactcgcgagccgtgagtgcgatgggcgagccatcgaccgtgacttcgcggcggtcagggtcgagcgcaaccgagcccacggtgagtgtggcgggggagggcgcggctgaggtcttggccgagtctccagccgggggtatcgcagcggcacccgtagcgccctccccggccccaacgccgccaacgcccgaagccgcccgcacggcctccgagcgcttcagcgcaacgcggatccgtgcgaacaactcctcaatcgcaaacggcttggtcaggtaatcgtcggcgccggcatcgagcccggccaccttgtccatcacggcatctcgcgcggtgaccataatcaccggcacatccttgtgcttgcgtacgcgccgcaggacctccatgccgttgagctgcggcaacaacacgtcgagcagaatcagatcgtagtcgcgctccagcgccaggtccacggcggtgcggccgtcggcggcgtgctccacctggtagccctcgtgctccagctcgagcgtcacaaagcgggcgattttctcctcgtcctctacgatcaggatccgtgccatgcgtgcccccgtctgcgattacttgtcgtcgttcagattttgcttgatgtcgtccgcggcatcagcggcgtgattcataaggttgttgatgctgccgggcacgtcgccgtcgctgtcgatgcggtagcgcatgccaaagaacaggccaatcagcatcagccaaatcgtagcgccccaggcaaacagggcgatgatggggatcaggatggggatgttgaggatgatcgcatcgcggcgcgtggcgataaacttggtgtccaggctcaggcggaagagctttttgaggtactcccatacgctgtccatcttcttggagaagtcggtcttttcgctcgacttctcgtaggcggcctgcgcggcgaccatctcggctgagggctcatcgactggcgcggactcggtggcggcgtgcgccgacgtggtctgcgtcttgccctgcgactcgagccaaatgatggcgtccaaaacgttgccgtcggcggcgtcgagcgcggccttggcatcggtgtagctcacgttgcacttggtgcggatggtttcaactttttcgaggtcgtccatgacctgtcctttcgttcgatgggcgcgacgccggacgatttgcccgggcgcgagcgttgcgttcggcggtctgcgttgcgcggcgccgccccgcccttggtcgaactctatagtgcaggttatagattaagcgattcttgagccaagattaacgttggatgagtttttgggtggcggtgggaaaagtattagacctcgatagcgggggatgtggtgccggtgcaaaacggcgtcaaaggttggtcgagcaggcggtttctccattgatgtccgcacagcatgtgacacttaccctgccgccccgctctgccgcggcggcatgcgtctgaacaacgaccctctaaggagttcgataccgatgagtgacaacgcaaagcatctcgcaaagaagtgcgttaaggacgcggggccgtgcctcgcgctgtgcgtagccggcgcagcggtcgcgctgttggctgttctggggccgttcgacgtgctccgaagtgccagctttctgcatgtttgcatggctcttgccggcgccacgatgaccggcggcgtgctcgatctgatcttttgggtgtttgacccgtttggatggaagagcgaggggtaggtcccaaaggatggaagggctggaacggttgacttagtgatcgtgcagaatgtgggctagcgacttacagggaagtggtaatccgatgacggtctatgtaacaggcgatattcatggcggcgctgacatgcaaaagctccgcgattgggagcttggggatagcctggcgagcgacgactatctcatcatcgcgggcgactttggctttccctgggacttttctaccgaggaatgtgccgatattgcttggctggagtcgcgcccctacaccgtgctgtttgtcgacggcaaccacgagcgtttcgatcactgggcggaacgccccatggagttgtggcacggtgggctgacgcagcgcctgtcggatacctcgcccatacggcgcctgacgcgcggcgaggtttttgagctcgacggctcaacggtctttaccatgggcggcgccacgagcgtggacaaggaataccgcattccgtattccagctggtggccgcaggagctgccggacgagcgcaactttgaggaggcgcgggcaaagctcgacagcgtgggctggacggtcgactacgtgatcactcacacctgctctacgcgcatgctttcgtccacgctttatccagcgtccggctggaattgcccctccgttgatcggcttacggcatttttcgatgagctggaagaccgcttggactacaagcgctggtactacgggcattttcatcgggataccaacccggccgagcgtcacaccgtgctctacgactgcatcgttcgcttgggcgacgaactccagccctgggatgttgcgtagaggcggggtggctggctactcgaccgttacagtgatgttctcccgatgcgcgcggatgacgtcccagctaaagtgctcgaccagctgctcggcggtacgcggcgtggtgtccggcgcgatgcctgtttgcccggcgagccatcccaacagtgcctcgggtgtgccaaagcgggtgcggagctcgcccaggtccagatcgcgatcgcgcttggaaaggcggcggccgtccggtgacatgagcagcggaatgtgcgcgtagtgcggcgtgggcagtcccagcagatgttgcagatagatctggcgcggcgtggaaccaagcaggtcgcatccgcgtacgatctcggtgacgcccatggcagcgtcgtcgaccaccacggccagctgataggcaaacacgccgtcgctgcggcgcaccaaaaagtcaccgcactcggtggcgagtgcttcgcattgggctccgtacgtgcggtccacgaattcgatcacgtcgctggcgaggtcgtcgacggtgggcacgcgcaggcgcgtggccggagcacgcagggcactgcggcgggtgatttcatcagcagaaagacctctgcaggcgccgcggtagatgggcgtgccgtcgctggcgtgcggcgcgctcgcggcgtggagttcggcacgcgtgcaaaaacagggataggtgaggccggcgtcttgcagctggcgcagggcgtcctcgtacagatccaggcgatcgtgctggtagtaggggccttcgtcccactcgagccccagccaggtcagatcgtcaatcagttgagcggcaagttccgggcgcttgcagcgatcgtccaggtcctcgatacgcaacacgatgctgccgccctggctgcgggccgaaagccatgcgcacaggcagctgaacacgttgcccaagtgcatgcggcccgagggcgacggggcaaagcggcccacgacgggggtgggcactgccgttgctggtgcgtccgcggcgggcgttgctatgttgcgtgttttgatatccatgcggatgagtatagcgcggggcttggcagggaaggcgttgccgcgctcacaagttggcggcggtgcgcattgcgcacggtgggtttgcggctcaaggtctcgatcgctgcgtaccgacttagcctcacaaacgacagaaaccccggcagctcttcgcaactgccggggtttccgcggaaaagggggacatggtcctcgagcgaacggcaaaggggcaaaccgttttcgctcaactactttatgcccctcggctggcggctcagtcagcgcatgccgcgcccacacaaagccgctacacctgtgacggagctgtgaagtggtatctattgctggcgcaggccatgccaagggtgtccctaatgactggtcatttaagaacgtccccaatgactggctgttggggtgcgggtgtgactttcatcccgtttggcgctccggtcgcctagatgttcgtcatgcgtacccgcaaacgtgggacaatggcgctgttggttttacagacaaaggatgtgcctatgaacaccctcgccgccaaagtcagccggcagcgccacctgtttgcgcgattcgcttccgtctgcgtgctcgtcgcgcttgcgttgttgctgctgcctgtcgccgcgcacgccgacggctactccatgacccagacctatatcagtgccacggtcgaggccgatggatcgctgaccgttgtcgagggacgccagtttgatttcgacgacgacatcaacggcgtgttttgggagatcaatacgggctccaaccagcagggcggcacggcgggcgtcgacgtgctgagtgtcgaggaagaggacaccgcgtttaacaaagtcgatagcgcgaacaagggcgactctggcgtctacacggtcgagcagaccggtgacggcgtaaggattaaggtgttcagccctcacgagagcggcgacagcgcaatctactacgtgagctacaccatgaccggtgcggttatgaactgggccgataccgccgagctctactggaagttcgtaggtgacggctggtctgcggattccgatgacgtcgagatggaagtgtgcttcgcgaatgccgctgccgggacggcggccgtcaagggcgataacttccgcgcatggggccatggtccgctgacgggcgacgtgtcgctcgatgaggacgagcccatggtcacctataccattccctgcgtgcaccagggcgaattcgccgaggcacgcatcgccttccctagcgactgggtgccgcagcttgccgcttcgggcgaagagcgcatgtcaacgatcctgagcgaagagaaggaatgggccgacgaagctaacgcccgccgcgctcacgctcgcatgattgccaatgcacttgccgtgctaagtgttgttgcggcggtggcctttaccggcacaatcgttatgctcaagctgcgcaagcgcaagcccaagccgcttttccaggacgaatatttccgcgatgtgccttcggccgaccatcccgccgtgctttcggccctcatgagctggaacgaggtgcccgatcaggcatatatcgccacgctcatgaagctcactgacgaccgtgtgatcaagctggagcaggcgaccgtgaccaaggccaagaagggtctgttggggcgtgaaaaagaagagcagacgtatcgcgtgacggtgagtgatgcgggctggaagtcggccaagggcattgaccacatggtgctcaaggtcttctttgccggtactaagcctgacgagaacggcgatcgctcgcgcacgttcgacgagctgcagcactacgtcaagcagcacgctacacccgtgggcgacaagctcgaggactatcagaacaccgttaagggcaagctggccgatagcgagtacgttgcctcagacggcattgttgcaatggtgttttgcctggttcttggtatcctgattgcctttgttcccgtgggatccatcttctttaccgatggcgcacaggcgaacattaccgccgcggttatctcggtgccgattgtgctggtgggtatcggcgtgggccttacgttccgccgctttacgccggagggcgccgaggtggcggctcgctgcaaggcactcaagcattggctcgaggatttcacacgcctaaaggaagccgtcccgggcgatttggtgctgtggaacaagctgctggtgatgggcgttgccctgggcgtttcgaaagaagtgctgcgacagctggccgaggccgtgcctgcggacctgcgcaacagcgacgatttctacgacaactacccctgctactggtggtattaccatcactacggcaacgagtctccgctcgattcgttcaacgatgtgtatcacgagaccatccgcgagctggcttcgagctccgatagctcgagcggcggcagcggcggcggcttctctggcggcggtggtggcggcgtcggcggaggcggcggcggaacgttctagcgcgctctgatttttgggatggatcttctccggcgactgccgacggatccatcccattttcatgcgctacctacgaaggctgtccccaacgactaatcactgggaacatccctaaatgactaggtatggctgctgggtttaggctgttagatcgagttcgtagaggaagctttcgcgcggcatgtcgtggcgacgctcttcgcggttggcgcggtgcgtggccgtgcgcttaaagccgtgcagctcgtagaacttccacgagcagttggagtcggtgtacaggtgcgccctcgtcgctccaagcgaggataggtgtgagaccgcggcatcgagcagaaccgtgccaacgcccaggccatggacatcgcgatccacggcaagcagcgtgacctcgttgtcgtgcggcaacgggctgctctcgagcaggcggttgttggtccggatggttgcgcgcacaaacgagagatactcggcgcaggcatcgggctccagctcacgcatctgcgatagcagcgcgcgttcggtatccatccaatgttccttaacggtggcgccggagctctgtcctgcgcgtgcaagcgcaatgccgcgtgcatggccgtcgattacggcaacctgcgaaaacgtcgaagacgaaaggcaataggcgaggtcgcatgcggcctcgaggcggttgtactcatcgttatccgaattgttatgccaaagctgctgcagaatcaacgcgatggcgtcgaagtcttcggtatcaaacggtcggtagagaacccgcgagaccatggtgcctctttcttttgcggatgcatatcgagcacagttctaccacgctattggcatctaattatggtgcccctgtgttccatgaactcaccgtgcccggtgccgtgcccatcccctccgctcgcaaactttttctgcatatgcgcccgttgcggggtgcatcgatgcgctcgatgcgctacattgaatcagtattttcaatgccgctgcgcgagcgctgcagatcgacgtatcaccgactcacagagcacggcggcgtaccagacaggaggactgcatgggatctgatgtgaagatcgcacgcgcgttgatttcggttaccgataagacgggcgtcgtcgatttcgcacggacgctggtcgatgactttggcgtcgagatcatctctacgggcggcacggctcgtgccatcgaggacgcgggcgtccccgtaacccccatcgaggagttcacgggctatcccgagatgatggacggccgcgttaagaccctgcaccccaaggttcacggcgcgctgctggcccgccgcgattccgagcagcacatgcaggaggcggcannnnnnnnnngtacttcttggcggtgtccttgtaggccttcttgatcacggcgcgctgctggcccgccgcgattccgagcagcacatgcaggaggcggcacagcacggcattaagctgatcgacctggtcgtcgtcaacctgtacgagttcgagaagaccgtcgccaaccccgaggtcaccttcgcggatgccatcgagcacatcgacatcggcggtccttccatgctgcgctctgccgccaagaacgccgcgagcgttaccgtcatctccgacccggccgactatgatgccgtcctggccgagatgcgcgagaccggtggctgcaccacgctttccacccgtcgtcgcctgcaggtgaaggtctaccagaccaccgccgcctacgacacggctatctcccgttggctcgccgcccacgcaagcgacgtggcggacacctctgccaagctcgagatctcgctggagaaggtcgacgacctgcgctatggcgagaatcctcagcagaaggccacggtctatcgctttgccgagggctgcgagaataccgcgagctcgcagttcccgctcgtgggctccgagcagatccagggcaagccgctcagctacaacaactatctggatgccgacgccgcttggaacctagtccgcgagttcgacgagccggcctgcgtgatcctcaagcatcagaacccctgcggctccgccgtggccgaggacatcacggccgcctacgaccgcgccttcgcctgcgatcccaagagcgccttcggcggcatcatcgcctgcaaccgcgaggttccctatgagctggttgagcactttgccgatcagaacaagcagttcgtcgaggttatcatcgctccgagctacactgccgaggcgctcgagcgcatggccaagcgccccaacctgcgcgtgctggccaccggcggcgtggaccacggcgcccaggtggagctgcgctccgtcgacggcggcatgctggtgcaggaggtcgaccacgtgaccgaggatcctgcgacctttacgttccccaccgaccgcaagcccaccgacgccgagatggccgagctcgagtttgcctggaaggtctgcaagggcgtcaagtccaacgccatcctggtttccaagggtaaggccggcattggcatgggcccgggtcagcccaaccgcgttgactctgcgctgcttgcctgcgagcgcgccgaggacttctgcgagcgcgagggcgtggagaagggcggctttgcctgtgcaagcgacgcgttcttcccgttccgcgacaacgtcgacgtgctcgccgcgcacggcgtgacctgcatcatccagcccggcggctccaagcgcgacgacgagagcgtccaggcctgcaacgagcatggtattgcgatggtcttcacaggggccaggcattttaggcactagaggctttcccaagcacccgaccttgcccctcaaaccgtcgcttgcgtacatttagtacgcggcgctcctctttcggggcaatctcgggcacttggaaaacccttaatgggatgttgttctatcccattaagccgatcggtcgcctgaccgtatcgtcaaaataatctctgcaaaagacggctgctccgtttggagggccgtctttttggtataagaggacggaatgactaacacgaaaggtatgaccatgccccagattgatgatgccgagctgtttggcaatgccgaggatcagcgtgcgtacgaggacttttgcgccaatcaggaggcggtcgagaagtttacgctcgacaagcccgcgcttgtctgccgttggcgcatgtccaacaaaaaggtgcccatgctcaaccgccacattcgcgcgctgtccgagcgcctggtgcagggcgagccgcttacccacaacatgctcagctgggccaaacaacacgttgagtggtcgcttgccgagggtgattacaccgcacacgacggcgtgctcatgctggtgatcgacatcaacggcaacgccgccatgacggtgggcgagtacgagccgctggccgatacgtcggccaaggcgctacgtgcccgctccgccgaggcccgctccgaggccgacgaaaccggcgtggcgcccgagctgctcgccgccgtcgataacggcgagctggcctttgtggcgccagcggacgagtgtctgtgcggcacggcgacgctcattgagcagctggcccagaccaagggcatcccggtcacgcgcgtggacattcccgcgcagctcaagggcgcgctgttcctggtgagtgacgagcacggcgtggtccccgcaaccgagacggacgccgccgaggccgacgccgccacggtcgccttcttcgccgaaggctacgaaaagctccgcgcccgccgctaaatgatttttctgggacggggattaaagaatcattttggtccccgccaccgctgcgagtgcgaggcggacaaaacgcccccgctcgcgaacagttctgtcacctggcaccgcgcgaggcgtgtacctgcagctttgcggtcataatgggacaagacaaccaagaggggagcggaatcaatggcgctgatctatatcgttgaggacgacgagcccattcgtcgtgagcttgtcgacatccttgcccgcgccgggtttgaagtcgaggcctgcgaatcgtttgagcatgtctcgcgcgatattctcgccgccgtgcccgacctggtgctgctcgacctcacgcttcccgtcaaggacggccagcatatctgccacgaggttcgccgcgaatccgaggttcccatcatcgttctcacgtcgcgcacgaccgagatcgacgaggttatggccatgacgctcggcgcggacgactttgttcccaagccttacagcgcccgtgtgcttgtggcgcgcatcaacgcactgctgcgtcgcaccgcggcgtcaggcgagcgcagcacacttgtccacaaggggctggagctcgacctcgcccgctcaatggtcaccaacacgcaaacgggcaccagcaccgagctcaccaaaaacgagctgcgtatcctctcgctgcttctgagccgcgcgggcaagatcgtttcgcgctcggccatcatgcaggacctgtgggactccgacgccttcgtggacgacaatacgctcaccgtcaacatcaaccgcctgcgcaccacgctcgaaaaaatcggcatcaaggggtatttgaccacgcatcgcggccaaggctattcggtctaggggccggctatgtcgtttggcaagttctttaaagatgcgctgcttcccgtcgccgtgtggacgtgcggtgtgctgctgagctgctttgtgctgacggttgccggtgcacccgtctctatcgtggtcgtggcggtcggcgtgtcctttatctttggtatgctcggcatcgtggtcgagtacgcgcgtcgccgccgttttctgcgtcagctggagcgcgcggccgaggagctcgagagccccgcatgggtgcaggagatggtgcaatgcccgacctatgccgagggcgagctcgagtacgaggtcttgcgccgggtgggcaaagccgcttgcgacgaggttgccgaaggccggcgtcagaccgatgactatcgcgactatatcgagagctgggtccacgaggccaaactgcccctggcggcggctcatctaattttggaaaacctggatggcagcgaagacgacctgtctcgtgtggatgacctgggccgtgagttggctcgcgtggagcgctatatcgaccaggcgctgtactacgcgcgttcggaagtcgtggagcgcgactacctgattcgccgctgggatctcaagaccttggtgacgggcgcgattaaggccaacgcgcgcgagctcatcgcggcgcacgtggccccggtgtgcgagaacctcgactttgaggtctttaccgacgagaagtggctcgagtttattctgggccagctcattcagaacagcattaaatatgcgcgcgaggacggcgcaaagatcgtgttttcgggcgcgttgctggacgagggcctggcgagcgaacgcatcgagctcaccgtcgcggacaacggctgcggcgtgagcgcggccgacctgccgcgcgtgttcgagaagggctttaccggcgataacggccgcaccaccaagcgcgcaacgggcattggcctctacctggtggcgcgtctgtgctccaagatgggtatcgatgtcaccgcggcatccgagcccggcgaaggcttcgtcgtcacgtttgccttctcgaccaacaaattccaatactttgagtagtcgtcgcggtgtaacgtcccggagcgtcattcacgttaagacaattatcccaaacgggataattccatcatgatgtgctatgattatcccgtttgggataatcataggggattagcatgcaagactggaatgagcgaacgatttttgacccagctgaactcggtgcatatttgcgtgagcgccggaagaagctcggttatacccaacgcgatgtggctgatttcaaccagtgcagtttgcgctttgtgagcgagcttgagcgtggaaaggcgggtgccaatcttcgccaaacccttcaaatcgctaacagcttgggggtcgatttgatcctgagggagaggggcgacggctcatggcattaaaggtttatcgtgagtatcggggaacgtttgagctggtcggagaatttgagagggccgaccccgtaaacgagacgtttgcatatgatgagggatatcttgaacgcgacgatgctgccgcactctcagcttctcttcccttgcgacatgagccatatgccagcaatgagttttcggcctttttttcgggcatgcttcccgagggcccggttcggcatgagctgtcgatgcgttttcaaatcccccagtcagactatttatcgatgctcgagcgtttgggcgatgagtgcgttggtgccttgaggtttctcggcgatgagaaatcgagctacgatccgggctatcgtcctctgcaagacgaggattttgaggcactttctaaggcggaagtgtttgagattgcaaatgatatgcaggattcgaggctgtcgttggcgggcgctcagtctaaaaccggttggtttttaccgcgcggtaaagatgcaaaaaaggccgggtcgggggattggatgctgccgctcggctctgccccctcgactcacatagtcaagattgcttcaactaaacatccggatttgccgttcaacgaattaatttgcatgacggcagcgtctgctgctgggcttgaaattgcccgttcagaagcttcggatacgattcctggtgcgttcttttccgagcgttatgacagaatctggagcaatgagccgccgtcgatgagcggattcgatgtgcctctgaggctgcatcaggaggatttttgccaagcggttggctggccttcgtatatgaaatacgagacacgtcccgatagctgctatatggctctttgcggccgattgataagagagcaatcgtctaacgtaattgctgatactcaaatgttcgctcgtcaggtaatggtcgattatgcgttggggaattgcgactcgcatctcaagaaccattcgtttctttatagtccgagttggcgggaaaagaggttggcccctgcatacgatattgtttgcacgacgataatgggatacgaccataatcttgggattgatattggggatcaccgggtgatcgatggggtgactcctgaagatttcgaattcatgtctcaagatttgcatctgccactcaagatgatcaagaacatcgcggcggaagtggctgaagaggtgtctgcccagcttgcagaacttgcctctgcaaccggagatttgggtcgggtcgctctgaaaattcagacggattccgttgagagaatgagggttctggagcaattctcagcctaaagcaaagcggggccaccgtaatggtggtcccgctcttggaagacttgggcacgtgggcttgcgctccgcgatgcgttaggcgtacgtttgctacttcacgaccaagatgtcgcagtccgtattgcgcagcaggaacgtcgaaatcgaacccagcagcgcatacttgatcgaggacaggccgcgggcgccgcagagcaccaggtcgggcttaaccacgtcgagcatctcgtccttgagcgtctcgcgaatacggccggcgcgaatcatgacctcgacctcgggaatatcgggattggccttggcctcttcgagctgcttggcgatggagttcttaaatgcctcctctaggccgttgaccagatcgaccggataggaaccggcgctctcgagcgccgtggaatcgataacgtggccgatgattagcttggcgccgttgttcgcggcgaccttgatggcgcgtgcgagcacaaaatcctgctgctcagtaccgtcgagtgaaacaaataccttggtgtagccctcgttcatggtttcctccttggtctatcgcacgggcgcggggctcgtgcatcgggcgggcgcgggcgcgttggccgccggacactttatcttgttgcagttatacccaaggatttgggtttgaccgctcgcaattctgtgaacgggcgagttttttggtaagggtaggcgtagacgcgcccgaacggttgataatgggacatcgcccgcaccgtccgcagaacaatatcggcgggtgtctaacgagggggtccctttggatattatcgagcttctaaaatctgccttcatgggcctggtcgagggcatcaccgaatggctgcctgtttcgtcgaccggtcacatgatcttggtggacgagttcgtcaagatgaacgtgagcgagacgttctggaatatgttcctggtcgtgattcagctcggcgccattctggccgtctgtgtgctgttcttccatgagctcaatccgttctcgcccagcaagggcaaggagggccgtcgcgacacctgggtgctgtggggcaagattgtgctcggctgcattcccgccgcggcgatcggtctgccgcttaacgactggatggaggagcatttctacaatgctcccgtcgtggcgctggcgctcattgtgtacggcgtgctgtttatcgtgatcgagaactggcgcgcgagcaagcgcgaggaaatggccgttgccggttcgtttggctcgcgtgctgtggtgtcgggtggacgtcccgccggtgcgcactttgcggcgcccgccgcggctaccgctgaggatgaggacgatgacgagaatctggactttggctccatcgccacgctcgaggacctgagctggaagactgcgctgggtatcggctgcttccaggtgctttcgctggtgcctggtacgtctcgctccggttctaccatcatcggcggcctgcttttgggctgtacgcgttcggtggcgtccaagtttacgttcttcctggccatccctgtcatgtttggcgcgagtgcactcaagctggtcaaatacttcatcaagggcggcacgttcggcgccaacgaggtcgctatcttgggcgtgggctgcgttgtggcctttgtggtttcgctcatcgccatcaagtggctcatgggcttcgtccgccgtcacgacttcaagtgcttcggtgtttaccgcatcatcctgggcgtcgtagtgctcgcatacttcttcgttctggagcctatgctcggcctgtaacttggttgacgctgcgcggcggccagagcgacaacttgtcattcaaagagggcggcatgaccaaaaggtctatgccgccctcttttcatgccaatttgttcgctctggccgccgctcgctgctgctaccgtgacatcggtggctctgtgattggcgcaatggggtcaggttactttgcaccagcttggtgcagacaaatctgaccccattgcgcctaatccgctggggtgggcctgacggtggcgcacggagtcgtggtgtgatttgcgtcggtgtccgcgcggctcggtatactggtacggctcaaactatggcgccgcccgcaggcgcgccgtccgtcagatgaggagtcgcccatgacccagcccttgccctgggaaaagaacgccacggtatccgtgccgcccgcgccggaacccgtgccgctcgatgcatacaccgcccctgcagcgccggagcccgagctcgtcccgctcgacatctacgacgctcctgcgctggcacccaaacccgccaagccgctcgtcgacatcgacagcctgaatcccgcccagcgcgaggcggttctgaccaccgagggcccgttgctggtgctcgccggcgccggctcgggcaagacccgcgtcctgaccttccgcatcgcacatatgctcggcgacctgggcgttaagccttggcaggttcttgccattacgtttaccaacaaggccgcggccgagatgcgcgagcgtttggcggcgctcattcccagcggtacccgcggcatgtgggtgtgcaccttccatgccatgtgtgtgcgcatgctgcgcgaggacgccgacctgctgggctacaccggtcagttcaccatctacgacgacgatgactcaaagcgcatggtgcgtgacattatgcaggcgctcggcattgagcaaaagcagttccccatcaacatgatccgcagcaagatcagctcggccaaaaacgccatgatcggccccgaggacatgctcaagagtgccgatagccccaacgacaaaaaggccgcgcaggtctacttggagctggagcgccgcctacgcgctgccaatgcgatggactttgatgacctgctcgtgcgcacgctcgagctgctgcgcacccgccccgaggtgctcgataagtaccaagagcgcttccgctacattagcgtcgacgagtatcaggacaccaaccacgtccagtacgagatcgccaacctgctggccgccaagtaccaaaacctcatggtcgtgggcgacgacgaccagtccatttatagctggcgtggtgccgacatcaccaatatcctggactttgagaaggactttaaagactgcaagaccgttaagctggagcagaactaccgctctactggtcatatcctgagtgccgccaacgccgtggtgcgccataactcgcagcgcaaggacaagcgcctgtttacggccgagggcgatggcgagaagatccaggccttccaggcgagcgacgagcgcgacgagggccgctggattgccggcgagatcgagaagctgcactccaagggcacgagctacgacgatatcgccgtgttctatcgtaccaacgcccagtcgcgtattctcgaagatatgttcctgcgtgcgggcgtgccctacaagatcgtgggtggcacgcgattcttcgaccgcgccgagatccgcgacgtcatggcttacctcaagatgatcgtgaacccggccgacgagatgagcgtcaagcgcgtcatcaacacaccgcgccgcggcatcggttccacctcgatccaaaagatcgaacagctggcgcgcgacaaccgttgctcgttcttccaggcttgtgagatcgcgtgcgccgaaaccggcatgtttagcgccaaggtgcgcaatggcctgtcgagctttgtgtcgctggtgcgcgagggccgtcgcatggatggcgagctcaaggacgtcgtcgagatgattgtcgacaagacgggcctgctgcaggcattccgcgccgagggcaccatggagtccgagagccgcgccgagaacatccaggaattcctgggcgttgcggccgaatttgaagagacacacgaggatatcgagggtacgcttgagagcttggaagagctgcgcgcggctggcgttgccgatgtgcctgccgacgctgagcccgagcccgttgtggtgagcgcgcctgcgcccgagccgggaccgtccgcgcccgcgtcctcgtttgaggcgctggtcggcgcgcgcgatgccgcaggttccaatccgctcgatagcctagccgccccggcgctctcgccgcaggatgctctggccgccgccatcgcgggcaacgcatatgccgcgtcgacggagatgccggcgggtgccgtgcatgccgacgagatcgagcgcacctacggtccgctcacctgtaaggcgctgccggcgctcatggagtggctggccctgcgctccgacttggattccctagccggcgagacgcatgccattaccatgatgaccatccactccgccaagggcctggagttcccggcggtgttcgtggccggcatggaggagggtatcttcccgcacgtgcacgactttggcggcagcgatgacccgggtaagctcgaggaggagcgtcgcctggcctacgtcgccatcacgcgcgcccgtaagcgcctgttcttgacctatgcggccacgcgtcgcacctacggctcgacctctgccaacccgcgttcgcgcttcctcaacgagattccgtttgaggatatcgagtttagcggtatcggttctgccggctttgaaggcacgggctgggagaagcgcggcgaccgtcacggcacctttggctcgggcatgggctcggatatgtatggcggcaaggtgttcggctcgcatacgcgctcgaccggcggttccggttcgcgcggcggatcgagctttgacgatttctttggcggcagcagctacggggccgaacgccatcgtggggtctcgcccgatgccggccgtgttgcctcgacctttggttcgggcgcgccgcgagccaaaaagccgtcgtccaaggtgtcgccgacggtggagcgcaaggtcgatcgcgccagcgcatcgcaggactttgccgcgggcgataccgtgagccacaagacctttggtacgggtaccgtgatctcggtcgccggagacatgatcgaggttcaattcgaaaagaccggccagaccaaaaagctgatgaaaggttttgcgccaatcgtcaagctgcagtgatcccggcggacctgggcgggcgtatagggcaacatcgcctgctcgggcagtcctgcgcaagacggaggccacattaagtggcctcctttgcgtgcggaactcgcgatcgatgttgccctatacgcccgcccaggtccttgggtaacgttgctagacgagcgttgctttgctcgttcgctttttggtctggagagccgggtgggctgatatatatggacaaggggctcccccgttggtgaacgggggagccccttgttgcgtttgggttgttggtgcgaactagaggtggctgatgatcagttccatcttgccttcgaggtcgatggagctgacggtgctcggggccagcaggtggcttcccttgtggacggggtcgccgcagatggtgccttcgccgtcgatgactgacaggcacatgaaaggccagcgctggtcgagggtcttgctgccgtccacgcgaacgcggtcgacggtgtagcaggggttggactcgagctcggtcacgccattgacttcgggtgcggtcacggtgccgtcggtcggggcctgcgcgttaaagttgatacagtccaggctctgctcaatgtgcagcgggcgcagtttgccgtcggtgccgggacggtcgtagtcgtacaggcgatacgtcacgtcgctcgactgctgcgtctccagaatcagcgtgccggtcttgatggcgtgaacggtgccggagtcgatttggaaaaagtcgcccttgtggatcggcagcacgttgagcatgtcgtcccagcgaccctcttcgatcatctgcgcggcctcggcacggtcatgtgcgcgctggccgacgatgatcgtggcgccgggctcgcaatccagcacgtaccagcactcggtcttgcccaggctaccgttctcatgctcggcggcgtactcgtcgttggggtggatctggatcgacaggtcgtccttggcgtccagaatcttaatgagcagcgggaactccttgccctcgcagttgccaaagagctcgcgatgctcggcccacagccacgacagcgtgtggccggcgtacggaccctcggcaatctggcaatcgccgttggggtgcgccgagatggcccagcactcaccgatgggaccctcgggaatgtcatagccaaagacggtctccagctggcggccgccccaaatcttctcgtggaagatcggcgtgagtttaatcaaatcggacatgtgcatacccccatcaggttgtgcaggcacctcgcgaaaaacggctcaaagcgagcgcctgccggattacaaacttaagccaacgttacgttgtgcagctcaaagcggtcgcccacgttgcgcgaaatcgagtactcaaacgcggcgccgctgtccaaaaagccaatctggttgagctcgagcaggggagagccgggcttggtgttcaggcgcttggcctcttcctcggttgccgccacggcacgaatggtgcggtggaagctcgagatcttaagcccgcattgctcgcggatatagctgtagaccgacgcgtacaggtcctttttcttcaggcccgggatcagctcgagcggcatataggtgtactcgataacgatgggcaggccatcgacctcgcgtacgcgcacgatgtgataggcaaagtcgtcttcggccattcccagctgggaggcaacctctgccggcggattgacgatcgagaaatcgtagaccaccgaggcaaccttctcaccgcgatgctcgtaggtaaagccctgcgcgcggtcgtttctgccttggaaaaacgctttgccgggaagccccgcggtgtccttgacgtaggtgcccgatccgcgacggctcgtgaccaagccttcctcggtaatttgctcaattgctcgtttgacggtgatcttggaaacgccatacagctcgcagaactcaacgacagtgggtagcttgtcgccgggcttaagggcgccatcctcgatactgcgacgaatatccgcagctattgactcatatttgggaatcatggaaccccctttctaacatgaatgcctgtaaaagaaagtatacctactataaaagcatctatatggctttaatcaaagaagttcgagaaagaaaaacaaaaaagacgctttacataaaaaattagagcgctatagttatagataacaagcgagatgcatgagcatcgcctgtaccgcttggagacggatttgttttggtgggtcggatatccggataaccggtgcgcgcccgcgccggattacccgccaaagcaaacccgcctccaatcggaggctcaaagacacgaaagcgaggacttcgatggcacagtatcagctgcccagcgactttttctttggcgcggccatgtccggtccgcagaccgagggccagtggaaccagggcggcaagctcgagaacctgtgggacacctggtccatgcaggatctgggctcgttctataaccgcgtgggttcctatgccggtaacgactttatggccaagtacaaggacgaccttcgcatcatgaaggacctgggcctggatacctatcgcacctccatccagtggagccgcctgctcgatgccgacggcaacctcaacgaggagggtgctgcgtggtaccacgagctgttccgcgcttcccgcgaggcaggcctggagccgttcgtcaacctttaccacttcgatatgcccacctatctctttgaccgtggcggttgggagagccgcgaggtcgtcgaggcctacgcgcattacgccgacgtcgccttccgcgagttcggtcaagagatcaagtactggtttacctttaacgagcccatcgtcgagcccgagcagcgctaccaggagggcgtgtggttcccgcagctccacgacttcaaccgtgctcgcaccgtgcagtaccacatttcgctggcgcacgcgctggctgttgccaactatcgcaaggcctatgacaagggcgccgttcgcgccgatgccaagatcggcatgatcaactgcttcaccccggtctacaccaaggagaaccccagcgaggcagacctcgaggccgtgcgtatgaccagcggcatcaacaatcgctggtggctcgaccttatcaccaagggcgagcttcccgccgacgtgctcgacagcctggccgagggcggcgtcaagcttccgttccgcgccggtgaccaggagatcctcaagcagggcgtcgttgactggcttggctgcaactactaccatcccacgcgcgtccaggcgccggcgagcaagatcgaccagtacggtctgccgcactttgccgacgagtacgtgtggcccgatgccgtcatgaacaagagccgcggctgggagatttacccgaagggcctctacgactttggcatggactgcgccaagaactatcccgatcttgagtggttcgtctccgagaacggcatcggcatcatggacgagtacaagaatcgtgacgccgagggaaccattcaggacgactatcgcgtcgactttgtgcgccagcaccttgagtgggtcgccaaggccattgacgaaggggccaagtgccgcggctaccactactgggccgtcattgacaactggtcctgggcaaatgccttcaagaaccgttatggctttgtcgaggtcgacctcatggacggctatcagcgccgtcttaagaaatcggcagcttggctcaagcaggtcgccacgacccacgtggtggattagcgatcgggcgctcagccccaaaacgggcgctcagcccctgcgcaaacgcgcaataacattggcacatctggtggcagagggcgacagaccaccgtgcgcataggaaaaggccggatttgaaagttaggagcaatcatggccagtgacaacggaaagagcttcctcgacaaatttgccgaggtctctgcgaaggtgggaaaccaggttcatctgcgttccctgcgcgatgccttcgcgaccatcacgccgctctatatccttgcgggtatcgcggttcttatcaacaacgtcgtgttccctctgttcccgctcgatgcggcgggcctcgccaacctccagacctggggctcggcaatcaccctgggcacccttaacgtgtccgccattatcctggccggtctgattggctacagcctcgccaagaacgagcgtttcgataacccgcttgcctgcgtggttgtcgctatctctgccttcgtcatcatgatgccgcagcagatcaccgccacccttgccgccacgagcccgcttctcaccgacaagatcacctccgccgaggtcaccggtgccctttcgaccgccaacaccggtaccaacggcctgttctcggccatcatcatcgccctgctctccacgacgctcttcatcaagatctcgggcgtcgagaagctcaaggtcaagctgggcgagggcgtacctcctgcggtctccaactccttcaacgtcatgatcccaatgctgctcaacctctcgatcttcgctatcgcctcggccctgctcgccgtctgcgccggcaccgacctgtgcaccatcatctccacctgcatctccaacccgctcaagagcatcatgaacgccggtccgtgggctgtcatcctcatctacaccctcgccaacctgctgttctgcgttggtattcaccagtccaccatctcgggcgctaccgtcgagccgatcctgaccatgctcatcgtcgacaacatggctacctttgccgccggcggtaccatccagcccgatcactacatgaacatgcagatcgtcaacagcttcgccctcatcggcggctcgggctgcaccctcatgctgctgctcgacaccttcctgttctccaagaacaaggcctccaagaccgttgccaagatggccattctgcctggcctgttcaacatcaacgagccggtcatctacggttaccccatcgtgtacaacctgccgctcatgattccgttcgtgcttcttcccgacctgttcatcggtgtcacctatggcctgacctgcgctggcatcatcagcccctgcatcgctcaggtgccttggaccatgccgcccgtcatcaacgccctgcttgctacgggctttgactggcgcgccggcgtgtggcaggctctggagctggtcatcggcatggctgtctacctgccctttatgaggatctccgagaaggccattgctaagcaggaggccctcgccgagcagaacgcctagcgtttgtccattccacccttgcgggtaccgatgcttggtaccggtacccgtatctccttttttgcctaaacgtgcaaaacaggggaaagataaccacaaggatttatccagtttgtcgtctgcgcgccgcgcagttataaggaggaaaccatgaagaagatcatgctttgctgcaatgccggcatgtccacgagtctgctggtccagaagatgcagtccgaggtcgcgagccgtggtctggacatcgaggtcgaagcccgtcctatgaatgaggcccacgatcacctggacgagtgcgacatcctgctgctcggcccgcagatcggctacaccaagggcgactttgagaaggaggccgccggccgtttcccggtcgaggtcatcaacatggtcgactatggccgcatgaacgccgccggcatcatcgaccactgcgtcagcgtgatgggctaggtgcagcgcatggaggatatgaacgaactgcagatgacctgcttcgagatcatcagctacgtcggtaccgccaagagcatgtacatcaacgccgtgcagaaggccaaggagggcgatttcgacgccgccgaggagctcattaagcagggcgacgaggcctataacggcggccacgatgttcacatgggacttcttaagaaggaggccaatggcgagcgcaacggcgaggccccgctgattctgctgcacgccgaggaccagatggccggcaccgagaccatgcgcgtcatggccacggagctcattgaggtccacaaacagctacaggcactcaaggcctagctggcgttttcgccgcgacggatcgtgcggttcgcatacaatccagtcccttttgcaggcgccgggagtctccctctcccggcgctttttgtttggcgagttgctgagcgtcattgctcgttgagcgggcggacgtttccccagataaaacctgccaaaacaaacctgtccctttttggcgggtttttgtcttgagagcggtaccatacaggcaatgtttaaacgagaaaggtgggctctcatggaacctaagcagtactacatcggcattgacgtcggcggcacttcggttaaggagggcctgttcgacgaggacggcaacctgcttgccaaggccagcgtgcccacgcctcccatcgtcgacgctgcgggctttgccgcggtaaccgaggctatcgaccaggtggtcgccaaggctcagattccgcgcgcctttgtggcgggcatcggcctggccgttccgtgccccattccggctgcgggcgatgccaaggtcaaggcgaacatctccatcaacctgcccgagcttaagattgccattcaggagcactgccccgacgcggtcgtaaagtacgagaacgacgccaacgccgccgccatgggcgaggcctggctcggttctgccaagggcgtgcaaaacgtggtgatggtcaccatcggtaccggcgtgggcggcggcgttatcgtcaacggcgacgtggtatcgggcgttgtgggtgctggcggcgagattggccacatgtgcctgaacccggctgaggagcgcacctgcggctgcggcggccatggccacctggagcagtattccagcgccaccggcgtggtgagcaactaccttgccgagtgcgagaaagcgggcgtcgagcccatcgagctcaccggcccctccgattccaaggacgtgttccaggcctgccgcgagggcgacaagctcgcgctggccgcggccgataccatggccgactatctcggccgcgccctggcgcttattgccaacgtggtcgatcccgagatgttcctgatcggcggcggcgcctccgcctcggccgatgtctacctcgacaaggctcgcgagtacttccagcgctacgcgctttctgcctcgcgcgagacgcccattaaggtcgcttcgctcggcaatgacgcaggcatcatcggtgccgcctacgtagccctgcgcgccgccggcaaatagctggtgcaagggggacaggttagtttgcgccaacatagtgcaagggggcagacttcgccccggcacttgccccaaattgtgccgcggcccttccgtctcagaaggctcggcgccagcgtgctaccatagctacgtccaagtacacatatcaagtggaggatatccatggcaaacgttcttgtctttggtcaccagaaccccgataacgacgccatcatgagcgccgtcgtcctgtcccagctgctcaatcaggttgagtatgctggcaacacctacgaggcctgcgcccttggtcagcttccggctgagtccgccaagctgctcgccgacgccggcatcgccgagccccgcgtgatcgagtccgtcgaggccggccagctcgtcgttctcaccgaccacaacgagtccgcccagtccgtcgccggccttaaggacgccacggtctttggcgtcgtcgaccatcatcgcatcggcgacttcgagaccgccggcccgctgcactacatctgcctgccctggggctccagctgcaccatcgtcactaagctcgccgacgtgctcggcgttgagctttccgacgtccaggccaagctgctgctctcggccatgatgaccgacacgctcatgctcaagagccccaccaccaccgatgtcgaccgcgccgtcgctgctaagctcggcgagcaggtgggcgtcgatccggtcaagtttggcatggaggtcttccttacccgtccgtccggctccttcaccgcagccgagatggtcggcaacgacatcaagatgttcgagcccgccggcaagaagctgctcatcggccagtacgagaccgtcgacaagagccgtgcgctcggcatgatcgacgagatccgcgaggccatgcgcgcctacgccgccgagaagggtgccgacggcattgtcctgtgcattaccgacatcatggaggagggctcgcaggtcctgctcgagggcgagaccgaggccgctcagaagggcctgggcatcgccgacgagcacgacggcgtctggatgccgggcgtcctctcccgtaagaagcaggtcgctgcccccatcatggccgcctgctaggtttagttgaccaaacgccacgaccggatcgcggaagccccgcggtccggtcgttttttgtgcatggagccgcgtcttttcttggacaggggctcctgtgccgttgagcaaataatgttcaacctgtggttccgcttttcggccgcgctcgcgcgcttgtcgcgcagggtaggctagatgcaagcgtaatacgtcggagcgcggcgccgccatctgggcgggccgtgcttttttaagacgggaaccttcccgtgaaaggagccgcccatggcagcacccgagcagctgtttaacgttcgtgaacgcaagcgttttgagcgtcacgacatttgggggcgcattgccgagaatggcacgatttccgccgccgtcatggtgatcgctgccatcgccgccgttatctgtgccaacaccgatgcctacgaggccatccatcactttttggagaccccgctgtatgtgggcctgggcaaccttacggccggtctcaccgttgagcttttcgtcaacgacttcctcatggcgattttctttttgctcgtgggcattgagcttaagtatgagatgacggtcggcgagctcaagaacccgcgtcaggccatgcttcccatgctggcggccgtgggcggcgtcgtcgttcctgcgtgcatctacctcatctttaaccatgccggcgcgcacaacggttgggctatccccatggcaaccgatattgcctttgcgctgggcgtgctgtcgcttttgggcaatcgcgtgcccaacggcgtgcgcgtgttcttctcgacgctcgccatcgccgacgacctgatctctatcgccgccatcgccatcttctacggtcagagccccaatccgttttggctgggtgccgccgcggttgtgacctgcgcactcgtgtggctcaacaagacgcagcactaccgcctcgccccgtactcggtgctgggcttgctgctgtggttctgcatgttcaagagcggcgtgcatgccacgctcgccggcgtcatcctggccttcaccattccggccaagtgcggtgttaagctcgatagccttaccgattggctgggcgaatgcctgccgttgctcgacgaccgctacgatgacgaggcgcacatcctgggccagcatgactttaccgtctcgaccactaaggtcgagcgcgtcatgcaccgcgtgaccccgccgctcatccgcatggagcgtctgatttccacgccggtcaactttgtgatcctgccgatcttcgcgttcgtcaacgcacaggttcgcctggtgggcgtggatatgagcacgttgctcaccgacccggtgacgctcggcgtgtactttggcatgctgctgggcaagccgatcggcatctttggcatgacgttcgccctggttaagctcaaggcctgcgagctgccgcacaacgtcaactggcacatgatcgccggtgtgggcattctgggcggcatcggctttacgatgtcgatcctcatcagcggcctcgctttcccgacggccgagtttgaggttcttgccgccaaggctgccattcttgccggttcggtcaccgcggccgtgctcggcatgatctacatgagtgtggtctgcaaacaccccgcgcccaagaacgagtaaaagcacaaacaagtttgaaaacgccgcccgtgaacaccgtcacaagcggcgttttagtcattggggacgttcttaaatgactaggtttattccacggtgccgtagacggcgccccagccgtgggcggccaaggcggagttgagctggtcgcaaagcgattggcggtcgtagtagccgggcggcaaaaggttgacgatttccatgaggtcgggcgcgaggtccaagatctcggcctgcacgatgagatccaggcggtcgatggcgcggcggtcataaaacagtccgtcgaccaggcgctgcaggtcgccgaattcctcggcctggaacgatccgtactccatagtgcctccttgggcgcttcatgccggcatgcgcggcgattcgtaattcattgcgatggacttaatctatcacggcttcataacgttgcgacggtggcggtctatacttagaagaattgcaacgtaccgcttcgtgaaaggtcgcacccatgcagacgatctaccagaagatggaaaccaccgaactcgatgccgccatcgaggcgctcaaagccgaggtcgccgaggtcaaggccaagggcctggcgctcgacatggcccgcggcaagccgtcgccctcccaggtggacatctctcgacccatgctcgatatcctcaatgccgatgccgatctgcacgacggcaatgtcgactgctccaactacggctgctttgagggcattccctcggcacgcaagctggcgggggagttcctgggttgccccgccgagcagacgctcgtgctgggttcgtcgagcttgctgatcgagcacgatattgccggtatgttctggcgttgcggctcgtgcggcagcgagccctgggaggcttatgaggccgcgcacgacggcaagaaggtcaagttcctgtgccccgttcccggctacgaccgccactttggcatcaccgccgatctgggtatcgagaacgtccccgtcgcgatgaccgacaacggccccgacatggacgaggtcgagcgcctggttgccgccgacgactccatcaagggtatctggtgcgtgcccaagtattccaaccccacgggcattacctttagcgaggacaccgtgcgtcgcctggtcgagatgcccacggccgcgcccgatttccgcatcttctgggacaacgcctactgcgtgcacgacctgtacgacgagaccgacgagctcgccaatatcttcgacctcgctcgcgcggcgggcaccgaggatcgcgtggtggccttcgcctcgacgtccaagatcaccttcccgggcgccggtatcggctttatcggtgcgagccccgcggtcatcgccgagttctccaagcgcctgaaggcaggccttatcagcgccgacaagctcaaccagctgcgccacgtgcgtttccttcccaccatcgaggcggtcagggagcacatgaaaaagcacgccgagttcttgcgcccgcgctttgaggccgttgagcgcaagctcaccgaggtcctgggcgatacgggttgcgccacttggacgcatccccgcggcggctactttgtgagctttgatggtcccgagggctcggcccaaaaggtcgctgcgctttgtgctgacctgggcgtcaagctcacgccggccggtgctacctggccctatggcaaggacccgcgcgataccaacatccgcatcgcgccgagctatcccacggtcgaggacctggaggccgcgctcgatgtgctggtgctggccgttaagcttgtcgctgccgagctcgcgcgtgccgagcgcgcctaacgcgcggcttcccgtactatccgcaccttcgatacgtaaaggagcatatacatggatttgggtatttccaccaaccccacgccagagctctacaccattaaggtaaccggcgagatcgacatctctaacgccgatagcctgcgcaatgccatcgacctggcgctcgagcagcccactgaggccgttgagctcgattttgcccaggtgagctacatcgattcaacgggcattggcgtgctcgtgggcgccgcgcaccacgcggtcgaccacggcaagcgttttagctgcaccaatgtgcagcccccggtaatgcgcgtggttcagctgttgggtgtcgaccaggagatttcgatcaccgctgcataatctttgcccccaaaagggcgtgccgtttggcatatgtttgtgatgcgctcggacgttttggcgtccgggcgctatacttgaccgaatgaatagacgagttccggccgaatggcgcggtgcgggctcgactcacatcgagccttggaggtatgtgtgtttggtattggagagggtgagctcgcgatcatcgtggtcttcggctttttgctgtttggcccggataagctcccgcagatgggccgcacgatcggccgtgccatccgtcagttccgcgagacgcaggaaaagatgacggccgttgttcagtccgagattatcgatccggtgagtgaggccgcttcggctccggtcaagcccaagaaggctgccgtcgatgacgattccgatgcggacgaggatgccgccgaggcggcagcgcccgccaagaaggagacctttgccgagcgccgtgcccgccttgctgccgagaaggccgcgagcgaggctgctgctgagggcgagggcgccgagcccgccgaggccgagcctgccgctgccgccgagcctgtcgtcgagcccgagcctgctgcagaaccggagcccgagcccgagccggtagagcccacgacggccgacctctacgcccgtcgtccccgcaagcgcaaggccgtcgtcgaccagctcgcccgcgagctcgaggccgaggacgacgccgctgccgccgacgcctcgaagggaggcgatgagtaatgcctatcggacctgcgcgcatgccgctcttcgatcacctgggagagctccgtcgccgcctgactatcgtggtcgtgtcggtgtttgccgccgccatcgtgctgtatttcgccacgcccgtggtgctcgacatcctggaagaccccatccgctcctttgtgccggacggtaagttctacatcaccaccacgctcggcggctttggcctgcgcttctcgctggccatcaagatggccgtggtcatgtgcacgcccatgatcatctggcagattctggcatttttcctgccggcactgcgtcccaacgagcgcaaatgggtcgtgcccacggtgctcgcctcgacggtgctgttcttcctgggcgccatcttctgctatttcatcatcatcccggcgggctttgagtggcttatcggcgagacctcggccgtcgccacggcgctgcccgacctggagaactacgtcaacatggagctgctctttatgatcggctttggcgtggcgtttgagctgccgcttatcatcttctacctgtccgtcttccacatcgtgtcctacgcggccttccgcggcgcctggcgctacgtgtacgtgggcctgcttgtgggctcggctgtgattacgcccgacggctcgcccgttacgctgggcctcatgtatggtgccctgctctcgctctacgagatttcgctcgccattgcccgcgtggtcattaccgcgcgcgagggcaaggagggcttgtttgtgagccgtctggacctgttctcggacgatgaggacgacgaggagtaaatcggtatgcacgaggttggcattgtcaacggcatactcgatacagtgattcgcgcggcgcgtggggcgggggcctcgcgcgccgttttggtaacgctgcgtatcggggatatgaccgaagttgtgcgcgaggcgctcgactttgcgtgggagacatttcgcgatgaggactcgctcacgcgaggctgcgagcttgccgtggaggaagtccatccacaaagcgagtgtctggactgcggggaggtctttgagcacgatcgcttccattgccgctgtccccaatgtggcggcgccaacgtgcgcctgctgcacggccgcgaactcgacatcgcaagtatcgaaatcgaaacccccgacgattagcccatcagccacctggggacggggtataaaggggcaaaagtaaggagcgctgagtatggctgagaaaacgattgatatcgcgtcgccgatcctgtcgcgcaacgagcgcctggcagatcagctgcgacagcgatttaaagagacaaacacctatgtgatcaatgtgctgtcgagccccggttcgggcaagaccaccacgatcctgggcaccaacgagcgcctgcgcgacaaggctggcctgcgctgtgccgtcatcgagggcgatattgcctcggatgtcgacgccatcaccatgaaggaagccggcatgcccgccatccagatcaacacgggtggcctgtgccacctcgagggcaacatgatcatggaggccgttgacgcgttcgaccaggccgtcggtctggagaacatcgacgtcatctttatcgaaaacgtgggcaacctggtctgcccggtcgactttgacctgggcgagaacctgtccatcatgattctctcggtgcccgagggcgacgacaagcctatcaagtacccgggcatcttccagcacgccggcgcacagctgctcaacaaggttgacgtggctccggctttcgattttgacatggataggtatactaagacactcgatgacctcaatccgcaggcgccgcggtttgccgtgagcgcgcgcaagggcgagggcatggatgcctggtgcgattggctcatcgggcagatcgagcaagcaagggcgtaaatcggccgccatacgggcgggcgtagccgcagagacacgagataggagcctcttttgaagctcatcatcgccgagaaaaatgacgccgcgcgtcagatcgccgagcgtctgtccacgggcaaacccaaaaaggacaaggtgtacaacaccgccatctaccgctttgagtggaagggcgaggagtgcgtgacgatcggccttgccggtcacatccttgcgcctgatttttgcgacagcgtgctgttcgataaaaagctgggctggtattcggtcaccgaggacggcgagatactgccggccgacatgcccgatggcctggcgcgtccgccttacgacaccaagcgtaagccgttccttgccgatggcatctccattaagggctggaagctcgagagtctgccttacctcacctgggcgcccgtcattaagttgccggctgagaaagagctcattcgctcgcttaagaacctcgccaaaaagtccgacagcgtcatcattgccacggacttcgatcgcgagggcgagctgatcggttcggacgccctcaacaaggtgcgcgaggtggcgcccgacttgccggtcgcccgcgcccagtattcttcgtttaccaaggccgagatcacgcaggccttcgataacctcgtctcgctcgaccagaacctggccgacgccggcgagagccgtcagcacatcgacctcatttggggtgcggtgctcacgcgctacctgacgctcgccaagtttggcggctttggcaacgtgcgttccgccggccgcgtgcagacgccgacgcttgccctggtggtcgagcgcgaacgcgagcgcatggcgtttgtgcccgaggactattggcagattcgcggcatgggcgccgcgcaaggcgctgccgaggacgatcgctttaagatcgcgcacaagacggcgcgctttaccgacaaggatgctgctgagacggcgtacggtcacgttgacggtgccaagacggcaaccgtcgccgcggtgaccaagcgctcgcgcaagcagcagccgcccacgccgtttgcgaccacctcgctgcaggctgccgccgcagccgagggcatctcgcctgcgcgtaccatgcgcatcgccgagtccctctacatggcgggcctcatcagctacccgcgtgtcgacaacaccgtgtaccccgcgacgctcgatctgggcgccgtggtgagcgacctggcaaagatcaacccggcgctggcgcccgtgtgcaaaaaggtgctcgccggccctatgaagcccacgcgcggcaaagtcgagaccaccgaccacccgcctatctatcccacgggcgagggcgatccgtccacgctcgacggcggccaacgcaagctctacgacctcatcgcccgccgcttcctagcgacgcttatgggtcccgcgaccatcgaaaacactaagctcgagctcgacgtgaacggtgagccgttcgtggcttcgggcgatgtgctcgtgaccccgggtttccgcgaggcgtacccgtacggactcaagcgcgacgagcagatgccgccgctggagcagggcgatacggtcgacgtgttcgacattaaactcgaggccaagcagaccgagccgcccgcgcgctacagccagggcaagctcgtgcaggagatggaaaagcgcggcctgggcaccaagtccacgcgcgcgagcatcattgagcgcctgtacgccgtgcgctacctcaaaaacgatcccgtggagccgagtcagctgggcatcgccatcatcgatgcactgacgcagtttgccccgcgcatcacgagccccgatatgaccagcgagctcgatggcgacatgacccgtgtggagcgcggcgaggataccgaagagcatgtagtgacgcactcgcgcgcgctgctggctggtgtgctcgacgagctgctcaagcacacgcaggagttgggcgacgccatcagcgacgccgtcacggccgatgcgcgcgtgggcgcttgccccaagtgcggcaaggacctggttatgaagacgagcgccaagacccgtggcagcttcattggctgcatgggctggcccgactgcgatgtgacctatccggtgccgagcggcgtcaaggtaagcccgctcgagggcgaggcagccgtgtgccccgagtgcggcgcgccgcgcattaagtgccagccgttccgccagaaggccttcgagatttgcgtgaaccccacgtgccccaccaactacgagcctgaccttaaggtgggcgagtgcaaggtgtgcgccgaggccggacgccatggcgacctgatcgcgcacaagagcgagaagagcggcaagcgctttatccgctgcaccaactacgatgactgcggcgtgagctatcctctgccggcgcgcggtaagctcgaggcgacgggtgagacatgccccgagtgcggcgcccccatcgtggtggtcaacacggcgcgcggtccgtggcgcatctgcgtgaacatggactgcccgaccaaggagaaaaagccggcccgcggccgcaagaccacgaccaaggcgagcgcggcaaagaagacgacggcggcaaagaagaccacggctaagaaagcaactgccgccaagaagacgaccgcaaaaaagacgaccaccaagaaggccgccgacaagtaaccgagcacatatagacgcggcggggccgggcgcgcaaatgcaaatgcgcgcccggccccacttctaagttgcggtgaaatagggactgtttttgctggcaaaaggcctaattaatccctatttcaccgcaagatttgatcagttgttgggattacttcacctcgacaggcttggcgccgggatagcgttcctcaaagtctaggcggtacttattgtcattggtgcccgccacgttgtcgcgcgacagcggcgccacgatctcattcttgtggtccgcaggcttggcgtatttcaggctgatctcccaggcatcacagattgcgtcaatgcggtgatccaggtcgtcgtacagggcgatgatgtccttccaggagctgtagttcttggagctcgtcgggacgtccaggtcctcgacgatgtcgtaatactgctcgatggtgtcctctgtgcgctcggcgacgtcggcgagattttggcgggtggttcgatcctcttccagatagctgccgttgaagttctgcgcgcagccacggacgtagttgtcgaggtcttcgagcaagtcgtagtattcgctcagtcggcggtagaggttctgctcggagagcgttgcttcgctgccatcctcgtcgtcatcgtcgtcatcgtcgtacaggctgttgggatcgccgagaggctttaggtcatcgtcgtcgacgtcatggtgcagcttagctacctcggcagtcgtctgcgtggcggcgttgtcgaaaggcttgatcacaaagaaaacgaccagggcgatgatgatcgccaccagcacaacaataacggcgataagcggcccggtgccgctctttttgggagcgggggtctgtggcgaagcgggcgtgtatgcgggagccggctcctgttggggcgagccgctcgcgacgggtatgcgctgcgtggtctcgacggccgcagggcttgcggcggggtcgtggcgatagacgagggggtcgtccgccttggcttgcggcgtatcaagggagccggtctgctcaaaagcgggctggctatcgctcgcggttgtttgctcaacgggtgcaccgcacgaggtgcagaacttggcattatctgcaagaagcttgccgcacgaggcgcaataccgagacattgccactcctttcgccacatttcaatgcaatacgacgattatacccagcgtccaaaattccccttcataagttgcggtgaaatagggactgtttggcggtctcagagctttaatcagtccctatttcaccgcaacttcggggatgcctcgatggctaggttggatttgggacgcgccgagcactggggtatcatggtttggttgatatatctgcatttacgcgccttgtaggaaggggctgcgcccatggcttttgagcccgctcaacatagcttcattacgctcgagggcgtcgatggcgccggcaagtccacgcaggcgcgcttgcttgcccgcgcgctcgaccttgccggctaccaggttgtgagcctgcgcgagccgggcggtaccgccatcagcgaaaagatccgtgctctgctgctcgaccccgccaatacggcgatgggcgacacttgcgagctgctgctgtatgaggccgcccgtgcccagctggtgcacgaggccatcgcgcccgccctcgctgccggcaaggtggtcctgtgcgaccgcttctacgattccacgacctgctaccaggcgtttgccgatggcctcgatcgccagatagtgcgcgatgccaacaacctggccgtcgcggggacgcacccggcgctcacactcgtctatcacatcacgcccgagcaggcggcgctgcgcatggcagcccgtggcgcggcagatcgcatggaggctaagggcatggccttccaagatcgtgtctaccagggtttttgcgcaattgctgccgaggagccaaaccgcgtaaagctcatcgacgccactgcgaccgtcgaggaagtcttcgagaagacggccgaacaggttcgcgcgtacggtctcgacattccccaagacgccgtcgcctccgcgcttgccaaggaggccgagtaacatggcccccgctcaggcaagcctgctcgccaagctcgacacccaacagcgcgtgcgcgactttttgaccaacgccatcgcaaacggccgcgcatcgcacgcctacctgtttttgggcgcgcccggtgccggtaagctcgacgccgcatgggcgcttgcccaggcattcctgtgcgagcaggatggctgcggctcatgcgatagctgcgtgcgcgtcgcccgtcatacgcaccccgacgtgcactattacacgcccgagagcgccacgggctacctcatcgcccagacgcgcgagctactcgacgacgtacccctggcgcccatccgcgccaaggccaaggtctacatcattgaccgtgccgagcagctgcgcgccaacaccgccaacgcactgctcaaaacactcgaggagccgcccgagggcgttatgtttatcttgctgggcacctcggcagacgtgatgttgcccaccatcgtgagccgctgccagtgcgtgccgtttcggctggtgtcgcccgccgtcgccgcgcacgccgtgagccgtgccactggtcaggatatcgcgcgttgtcgcatggccgtcgccgtggcgggcagccccacgcgcggcatcgagttccttaagagtgccgagcgccaggacgcccgccgtcagatggtccgtgccatcgactcactcattgccgccgacgaggccgacgtgctcagccgcgccaagtcgctcatcgtcgccgttaaggcgccgctcgccgaggtcaagtccacgcaggaaaaggtgctcgagcaaaacgccgactacctgtcgcgtggagcattgaagcagcttgaggaccgcaacaagcgcgaactcaacgcgcgcgagcgttcgggtattatggaagcgctggcgagcgcgcggacgctcatgcgcgacgtgctgctgacgcttcaggacgaggcggcagacgttgtgaacgaggacgtgcgcgacacgatcgggcggcttgccgccgcgacgaatgttgcgggtgccacgcgggcgctcgaggcggtcgcaaccgccgagcgcaacatcgccagaaacgttactcctcagctggccatcgaggtcatgctgctcgatatcaggaaggcactgaaatgccgttagtcgtacccgttaagtttacctacgcctcgcgcgacctgtggttcgatccgcaggatctggatatcctcgaggccgattatgccatttgctccaccgagcgcggaaccgagattggcctggtcacggccgatccctttgaggtgccgcaagacgagatcggtcagccgctcaagcccgtgctgcgcgtggcgagcgacatcgacctccagcttgccgacgacctggccatccagggcgacgaggccatggtcgacttccgccgcctggtcaaggagctcgacctcgagatgaagccggtgggcgtcgagtacctgtttggcggcgagaaggccgtgttctactttgcggccgaggagcgcgtcgattttcgccagctcgtcaaggatctgtcctcgacgctgcacattcgcgtcgatatgcgccagatcggcgtgcgcgacgagacccgcctggtgggcggctatgcccagtgcggacaggagctctgctgcacgcgctttggcggacagtttgaacccgtctcgattcgcatggcaaaagagcaagacctgccgctcaattcctccaagatcagcggcgtgtgcggtcgtctgatgtgctgcctgcgttatgagttcgaggcgtacaaggactttaagagccgtgcgcccaaaaagaagacgctcatcgatacgccgcttggcaaggcgcgtattcaggagtatgacacgccgcgtgagcagctggtgctgcgcttggagaacggtaaagtctttaaggtcaacctggccgatatgacgtgctcggagggctgcaaaaagaaggccgccgagcagggctgcagctgccgccccgactgcgtgacgcgcgacgtgctcgagcgcatcgagtcgcccgagatgcgcctggcgctcatggaactcgatcgcgagaatggcgtcgacgtgggcgatggcctgtcgagtgccgaccgcctggccggcacgtcgatgcctaagcgccgtcgtcgcgatgctgaatccgatgctcgcgccggtcagggtcagggcgagggccgtggccgcggaaagggccgcggcaaggccgaggcgcccgaggccgaggaggccgccggtggccgtcgccgccgcaagcgtgcgggctcgggcgatgctaccgaggctgcagccgcgggcaagaacgcctctcgcgagcgcgaggttcagcagccccagcagcagaatcgcggcggtggcatgaaccccacacgtcgccgccgccgtcatctgtcgagcgaggagcgcgaggacgccttccgcgccgcagctgctcgcgaggctggtgccgcttccaagggcgcctcggcctccgatgcgcctgtcgacaagagcggcaagtcacgtggcgaggaggagcgcgcgccgcgtccgcgccgtcgccattcctcgggcgcgcagcagaagccctcagtgccctccgtggccgatcaggtctcggatggcgaggtcaaggtcacgcgccgtcgtcccggagatggcgggggagcggctgccaaggcttcgcgtggcgccgctcgcgacgagcgcgagccgcgcgaggatcgcggtggcgagggctcggccgaccagggtcaaaagcgccgtcgccgtcgccgttcccgcaagcctcgccaggatggtggcgagggctcgaccccgtcttcgcccgcaccgcaaccgcccgccggcgaataacgcccgcgagcggatttagcccgccttgccccgagcgcatcggggtatcatagcgccgaatcaacaaccctccctgcgaccgagcgtagggagggttgtgtcttgaagagccatctgaacatattgagccgtctgcagggtgccggtgccctaccgtttgcggacgaattgctaccgtttgccgagcgggtggcacgcgagacgctcgaggcattgtcgccaacacgatgtgccggctgcgagcgcgccggtacgcttatttgccaagactgcctggctgcgctcacgctcatcgacccacgtcatagctgcacccgatgcggcgccccgtttggggatttgctgtgcactgagtgttcggtcgagggcacgtcctcggcaatggcggaggcgctcgaccgctgcctggcgtgcgccgtctatgcgcatccgctgccgcgcatcattaaagcgtacaaggatgcgggcgagcgacgtctggctccgtatctggcagagctgctctacgacaccgccctgcatgcccaggtcgtagcgcccgatcgctacggaggtgtgctgtccggtgcggatgcggtggtgtttgtgcctgcgacggcggcagcgtttcggcggcgtggttttgatcatatggaggccattgcgcgcccattttgcgagctgtcgggtgttcccctgctcgatgctctcgtcaagtacgggcatggcgaccagcgcgaactcggtcgtgaggagcgccgcgagcgtgcccgaggcatgtacgagacggttgaggatgtgcatggccgccgcctgctgcttatcgatgacgttatcaccacgggcgcgacgatggccgcggcttcggcggaactcaagcgcgccggcgccgcagcggtcggtggcctcgctatcgcacgcgtttggtaggggtggttttgtgtcagtaaagattgagcggcgcaacgagccgacaggcgaacagctagcggcttccataatcctgaccggcgcctcggcgctgcgcatgatgcgcgccgagcgccggcagatgggctatatcggctggagggacctcagtcccgatgaagagcgccgtgtgctgcgcacgtcgtcgccctcgaccgaggacatctatcttcccgacttggtgcggattggggccgcaagcagcgaggtacaagaggatctgtgcttgctggtagggtctgcagcgcagcgccgccgcattcttggcgtgagctggtccgtatgctccgggttgcccgccggctcgattctagaggtggaaccgggggtgtacagtctatctcccgaggccctttgtgttgtcgtcgcccgcgaggtcggctgtatccaggcgtttgccctggcccaggagctgtgctctaagatttcactgagtgaccgcgggaagtatctgcctccctacacctcgcctgtcgtgaacaaattggcaaaggacaaagaccagccgccagatgtcggttactttgaggtcgagtccgtgctgacacccgattgcctggtagattacctcgcggcatgcaaggggagcgcggccaagcagctgcggcggctgtgtccctatctgtcggaaaacctgcgttcacccatggagtgcatcatgcttgccatgttttcgcttccgttttcctatggcggatttgcctgtggtccctttaagaccgactacaagatcgagttcaacgaccgtgcacaggcgatctcggggatgccgcatgcggtttgcgatgcctttcaggaagcagcccggtttgacttggaatacaacggtgagctgggccattcttctcggaggggacgtatccatgatgaaaagcgcaacacgggcttgattactatgggaatcgaggtcgcgacggtcaacaacgaaatgctctgtgacatggaagcgatggaagcactcgcatggcgcatccaccagcgtatgggtaagcgatatcagaatcgcgtagaggctcgtcgaaagaggcaagatgctctgctgaatacgctccgagcgtgctttgggctcaaaccagcgtaaaactatggctttatagggggtctgtttatatgctctgtgcaaaaaacggcaaatatgagtactgttactagattagtgacagcaaaaacaaagaaacttgggccgataatctggattcagcgaagagataataaacgaatgtggaatatcttggcgccaagcaggctgtgcggaactcaaaaagggctcgtgaggcggtaatacgctgctactaaattggtaacagtactcatatttgccgttttttgcacacggcaccctgagacgggtgccccggagctccccgtaggggagctccgggcttcataggggcacgaatggtccgctccgacccgcaaaatctgtactcgagatgcgaatgacgcccctaaccttaaactttagcttgaacttagctataatgcgcttcgttcctaccaggctgtggttgcggacggacgaaatgcccgtcctagtccaagacagacgcggtcaaagggatccacgtaagcgaccgcgtgcgcgcggcgcgatcatggcgcgtcctagatgtaagccgcaccgtccgttctactttctttggggcaataccgcctcgcgggcgagcgggtcagtcgtgaaggtggctgcggcctcccgagcaaacaccccggtgcgcaagtgtggggtcaaataccaggtcagctggtgggaacaacctgatattccgcgcaacgcacggatcgtatacgacacagaaggcagggtagtggacatggtgaggggcagcttgatgcacgcggctcggttaggtgctgggaccgcagcggtcatcgccgttttgggcctgagcggatgcgcgttcaacccgctgtctacgttcacgactcccacgatcgaccagatcgagtacgagaccgtcacgccggcggtgtcggacgatgccctggtcactcccggaaccctgacagtcgccctcgatacttccgatgcgccgcaggccatgcaggacgccgacggcgagctcacggggtatgcggttgacgccgcccgcgccctcgcaagccgcatgggccttaaggtcgcctttgtcgatgcgtcctcggcaggttccgcgctcggcgacaaaaaggccgatatctttatcggcgagattaattccacggacggggacattagctcgctcggcacctgcctgtacgatgccacttccgtgtttggtaaaactagcgatggtgggtcgctaagcgtttccaccgatacccttaacacgtccaccctgggcgttcagatgtcctcggcctcgcaggaggcgcttgctaagcagagcattaccgccaaccaaaagacctactccaacatcaacgagtgctttgaggcgctcgagtccggcgaggtcgactatgtaatctgcgactccacggccggcggctaccttgcacgtctgatgagcgaggtctcctatgtcggtgcgctcgaggcgccctcgacgcttggtgttgcgggcctctcgtccaatgacgaactgtgccgtgccgtgagcgatgccctcgacgacatcacggtcgacggtacgctcgaggcggtccactctgtctggtatggcacgatgccctacgacctcaccactaagacggtttcgggcgctaacgtgcagccgggcgactctgagtccagtgagaccacgtcctccggcagcgagtcctccgattccaacaatgagaccgcatcctccgaggacaaatcgtccagccaggaaggcgccatcaccgacgacgacattaacaaactcaatagctagttattgctaggggtggtgtctcctatacgttggaaaggacacttcttcacggtttcaacacgcactgccgggcttccccgatgggggagtccggctttttcatcccaataaaactagcaggtcaaagccaattttcgggaccaaatacaaagccgccggccccctcctatagcgcactttgccatggaaaagtgcgagacttcggtatgcggtatcaagcaatcgttattcgggtctttaggaatccgcgtgattaaatgcacggcaatgggtacatagccagtacagtaagtccccgaggcagattggagccacgtatggatatcaaggtttctggacgcaagacgacggtaaccgatgctctgcgtgcgcatgtggatgagaagatcggcgaggcgctcaaggttttcgatatcgagcccatgacggtcgacgttgtacttcgctatgagaagaacccctcgaaccccaacccggcaatcgtcgaggttacggttcgtgcccgcggttcggtgattcgcgttgccgagcacggtgcagatatgtacgccgccatcgacctctcagccgataaggtcacccgccagctgcgcaagttcaagaccaaggtcgtggacaaccgccagggcggtgccagtgcagcggatgtcgcaccggtcgagcgcgtcgaggatctggccgacctgctgctgcccgaggaggaggatgacctgctcgtccgcgagaaggttatcgacgtcaccccgatgactgaggagcaggcgctggtgcagaccgatctgctgggccacgacttctacgtgttcgagaacgcgacgactggtctcatcaatgtggtatatcaccgtaagaatggtggatatggcatcatcaagccccgtatcgaaacacttgacgagtaaaatacgttaacttgcatgagttaacggttggcggccatcccatgcgggtggtcgccttttttacgtaaggagtcgctttgatggacaaggccgcatccgccggtcattcgaaccgttgccgcatcgtcgtcgatacctgctgcgactttagccccgaggtcgccgcgaacctcgatgtcgatatcttgggcttcccctttatcatcgatggcgaggagcgcacggacgatatctggtcgagcatgagccctaaggagttctacgaccgcatgcgcgccggcgctcgcgtgtctacctccgccgtgtcgctcggtcgctatatcgagttctttaccgagtgtgccaaagaaggtactcccacggtctacctgtgctttacctcggcgctgtcgtcgagctacaactccgcgtgccaggcggcggacgccgtgcgcgccgagtatcccaactttgagctctacgtggtcgacaacgctctgccctgcgcgaccggcgcgctcttggcgctcgaggccgtgcgccagcgttcggcgggactgaccgccaagcagctggtcgattgggcaaacgaggcaaagacctacgtccacggctactttacgctcgagagctttgacgcgctggctgccggcggccgcattccgcccgcggcggcgcagctcacggcaaagctcgatgtcaagcccgagctctcctacgaccttgccggctcgctgtcgctgatcggtgtcaaccgcggccgcaagaaggcgctcaagtccattctcaagtcgttccgcgagaactacgtgcccgaccgcaccatgcccatcgcaatcatgacggccgatgccgaaaaggacggcgactggctcgaagccgccatccgcaaggaggagggttgcgccgacgtcacgatcattcgcagctccgtgggccccaccatcggctcgcacgtgggccccggcatggtggcctgcgcgttttggggtaagaaccgcgccgacaaggcgtcgctttccgaccgcatcgcctgccgcgtgcgcggccagtaggcaagtaacgcggccgtaatcgatcccaactcactgcccaaacgctggcatcgagtattcaacctggtaacaacacccaacccaaaaggaaaggtttcatggcaaacaagctctccgtcgcatttatcggcaccggaatcatgggtgcccccatcgccggtcacatcctggatgccggctatcccgtcacggtcaacaaccgcaccaagtccaaggctgtcgcgcttatcgagcgcggtgccgcctgggccgatacgccggccgatgccgtggctaacgccgatgtcgtctttaccatggtgggctatccctccgaggtcgaggagctctacctggcgggcgacagcctgctcgcgtgcactaagcccggcgcggtcctgatcgacctcaccacgagctcgcccgagctggcgcgcgacattgccgaggccgcccaggtttccggccgcatggcgtttgactgccccgtcaccggcggtgagtcgggagctatcgccggcacgctcacggctatcgtgggcgctaccgagaacgacatcgcgccggtccgcgacatccttgccacctttgcggccaacatctgctgcttcgacggcgccggcaagggccaggctgccaagctcgccaaccaggtgtcgctgggcgcctgcatggtcggcatggcagacgccatggcatttgccgagctgagcggccttgacctggagaagacccgccagatgatcctgggcggtaccggcaagtccggcgccatggagagcctggcgcccaaggcgctcgacggcgactacaagcccggctttatggttgagcacttcatcaaggacctgcgcttggcactcgcctatgccgacgaccgcgagcttgcgctgcccggcgccgacgtggcctttacgctctacgacatgctcgacgccatcggtggcgccaagctgggcacccaggccatcacggtcctctataaggaggaggccgacgccatcgccgccggtctggactggtcgcagtatcgtcccgaggagcatggcgctcacgaggacggctgcggttgcggcgagcacggcgacgaccatgagtgcggttgtggccaccaccatggcgaggaccacgagtgctgcggcggccacggccatgacgacggccatgagtgctgctgcggccaccatcacggggagtagcgcccatgagctggacgttcgtggtgctcgcgctggtgctctttatctttgcgatctatattggctttttgtgcggccagtgggcgtgcgaaaagcgcgtgatcaccaagcgcgactactggattgccaattttgcaggagcggcggcagtcgtcctactgacctgggtgttctcgctgttcccgctggtgcagtttgcgccgatcggctggctcggcggctttatcgccggtcttaagatgagctttggcgagtccgtcggtccgtggcgcaagcacgacgaggtctttaacgtcaacaaggctcatcgcgccgccgccgacgcgggcgacgctgaggaacgccgccgtgcgcgtcgcaatggcgcggccgaccgacagctcatctcggtcaccgatgacagcaagggtgctggcaagcacgctaagaaatagtaagaagaggtaactatggcagaaaacaaagacgaacagctcaccgacgaggagctggcacagcttcagctggcagaggagaacgagaacgccgtcgaccgtctggtcaaggagctcggctgccccacgcgccgcatccgccagtttgccgcccgcgtgctgcacctgcttgccgagcgcgatccgcagcgcgtcgtgccctgcgtgcccgcgctgatcgaggcgctcgaccgccccgaggcgcagacccgctgggaggccctcgatgccctgacggcgctcgccaccacctgccccgagcagctgggcgatgcctttgagggcgccgagaccgcgctgttcgacgagatctcctccacgctgcgctatgccgccttccgcctgctgtgcgtatggggcgccgcgagtgtcgagcgttcgcgcgaggcttggcccatcctggacgaggctatccagtgctaccacggcgaccttgagtatcgcgacatgctcggttgcctgtacgagtttggccagggcgagattgacgccgaggtcgccgagaagctcgcgctgcgccttaagttcgacgccgagaacggcaagggcagctatctcaaggcccgttcgagcgagatttgcgaaatgcttgttaaacgttttggcctggatctctccaaaaagaagaagcgtgctaccgttaaaaaatctgacgacgccgaagacgaggagtaacagattatggcgcacgatgtagtcctgattcccggtgacggtatcggtcccgagattacgcaggccatgcgccgcgtggtcgaggctgccggtgtccagatcaattggaacgtccaggaggccggtgccggcgtcatggacgagtttggcacgccgctgccccaacatgtgctcgatgcggtcgccgagaccaaggttgccatcaagggtcccatcaccacgccggtcggcacgggtttccgcagcgtcaacgtggccctgcgcaagcactttgacctgtacgcctgcgtgcgcccctgcctgtcgcagccgggcgacggctcgcgcttccgcgacgtcgacctggtcatcgtgcgcgagaacaccgaggacctctatgccggcatcgagttcgatgagggggctgccgaggtcgaggagctctcgcagcttgtcgagcgctcgggtcagaaggccttcgccgccgattccgctatctcgatcaagcccatctccatcgccaagagccgccgcattgtggagtacgcctttgagtacgcccgccgctgcggccgcaaaaaggtgacggccgtgcataaggccaacatcatgaaggcgaccgatggcctgttcctgcgcgttgcgcgcgaggtggccgccaactatcccgatatcgagttcaacgacaagatcgtcgacgccacctgcatgggcctggtccaaaaccccaacgacttcgatgtcctggtgctgcccaacctgtacggtgacatcgtgagcgacctgtgcgccggcctggtgggcggcttagggatggcccccggctccaacatcggtgccgactgcgccatcttcgaggcaacgcacggctccgcgcccgatatcgccggtcaggatatcgccaaccccacggccgagatcctctctgctgcgatgatgctcgatcacctgggcgagaacgacgctgccaatcgtatccgtgccgccgtatctgccacgctcgacgagggcgagcaggttaccggtgacgtgcgtcgtgcccagaccggctccgtcgagggcgccgtgggcacacaggcctttgccgatgccgttatcgcgcacctggcctaaggtatgcacgctgcaaacgcctaaatagtacttaagtgtttgcgtataacctaagaatcaatacgcccggcactctgtcgggcgtattctattgaagactatgtttcctaacaaggagtaaccgatatgggtctgattcaaaagaaggacgagaaggacgagatcgacggcatccagatcatcgagcgcggcgaaggccccgacggtgacgaggacgagaagatcgacctggtcaccggtacgtctgccgagcacattgctgccggtacgacggccgaggaggaggacgcccgtctggaggctcagattgccgcggatgccgctgacgaggatctgatgcccgaggagcaggacgaggacgacgactccgacgtggatgaccacacttgcaagcacaagaagacgatgattgccgcctttgtggttgcagtcgtgattgctgccgtgattggcttctttattggcaatggtggttttggcggcaagggtgtcggctcgtcgaccctgaccgaggaccagctcgattcgaccgtggcaagctacagctacaacggcaagaagagtgacatcaccgcacgcgaggccatcgagagccagtacagcctcgacaccgtcaaggacgacgacggcaactataccgctccgtctgccgacgtcatcctgtcctacgtgcgcaacaagatcctgctcgatgctgccgaggacgagggcatcaccgtctcttctaaggagatgaagaaatacgccgaggattccatcggcacttcggactacaagaccatggccacgcagtatggcgtgtccaaggaccaggccaagcagatcgtccgccagtccgcgacgctgcagaagctctacaagaagaaggtgggcgatagctccgcaagcatgccgaccgctccgaccgagccttctgacggcaatgaggacaccgcgagcaaggattacgccgactacatcatcaaccttgccggcgacgagtgggatagctcgaagggtacctggaaggacgagaacggcacctacgctaaggcctttgccgacgatgcctttacggccgatagcgctacctataagcaggctatgaccgcctactacactgcttaccagcagtactcttcgcaggcttcgagcgccagctccaagtggaccgagtacgctaacggcctgtacgccaaggccaacatcagcatctacggcctgtttgcgtaaggtttgcctgaactactgcgcgctaaccgatctacctgattaagcccgctagaacggacaacgttctagcgggctttttgttaccgaaaccactggggtaggcctcgagcccgcacaatgctccatcgggttcccctaattcatctgggaaaacaactgcaaacgattgcaagtaaccggtgaacggtcgaaaactaccgttcaccgataatctcaaaactggttctaactggtattaagtcaaaaagaccaattcacatatcttcacaatgacctgcaatttttctacacgctatttttagccgccctgcgttgtttagacacaggaaaagatccgatcttttgccaaagcatttcgaaacggtttcaaaaccgcaggtagaagtgttaacgaccggtaaacggtcgaaatatcaccgtgagcggtgcaaaaacgttttaccgtatgaatcaacgaaagcgacctcttctggggtgatatagtgacaacaacacgtcacgtggttactaccagtttagaaaccactggtcttcaaagaacgctttctaagaagctttaagggcgagcgcccgctggcttccgaaaatcatcggacacagatcgtacgcaccttcggaagggaaatttgaatggttggctttattcttaccggtcatggacagttcgcacccggccttgcaagcgctatcgctatggttgccggcgaccagcctgcttttaccgtcgttccttttgagggcgaccaggctgcttcctacggtgaggatctccgcgccgctattaccgccatgcgcgaggagtgcgatggcgtgctcgtctttaccgacctgcttggcggcaccccgttcaaccagtcgatgatgattgcccaggatgtcgacaacgtcgaggttctgactggcaccaaccttcccatggttattgagcttctgttcctccgcggcaatgccacgctcgccgagcttggcgagcaggccgtgaccgttggccagacgggcatcaccgcccagacggtcgcatccgttgccggctccgacgaagaggatatcttcggcgacgaggacggcatctaatggccgatttcggagccaacgtcctgagctcctcggtcgctcttttaggcctgcttgtcatcatgggcttgatttacaccatctggtcgcaaatcaacatgaagaagaagcagaagtacttcaaggagctgcacaccgagctcaagccgggtcaagaggttcttttcgccggcggtatctacggaaccgtcaaaggcatcgaaggcgagaaggtccagatcaaagtccgatccggagccgtcgtagatgtttcgcgttacgcgattcaggagatcaagtaactgtcgtcagcaaataacgaaaggaagctgatcaacatggcagaacccaacattcttcttacccgcatcgataaccgactggttcatggtcaggttgccacccagtggaactccaccctgggctccaacctcatcctcgtcgccaacgacgacgtggcgtccaacaccatgcgccagaacctcatgaagatggccgctcccgccggcgtcgctacgcgtttcttctctctgcagaagaccatcgacgtcattggcaaggcgagcccgcgccagaagatcttcatcgtggccgaaacaccggaagacgtgcttacgctcgtcaagggcggtgtgcctataaagaaggtaaacatcggcaacatgcacatgtcggaaggaaagcgccaagtcgccacctccgtcgcagttaacgacgaggatgtcgctgcgtttaaagagctgcaggaattgggggtggagttggagatcaggcgcgttccgagcacgcctgttgaggacacgagcaagctcttctcgtaatcctcatgatccacgttgtcaggaatgaaaccctgacattctgtacgtgaaatccaaagtgcgtacattcattttgaaaggaggagcaagatggaatactcgatcatccagatcgctctggtcttcgtcgtcacgttcatcgcggcaatcgaccagtttgacttcctcgagtctctctatcagcccatcgtcaccggcgccgtcatcggtcttatccttggcgacctcaacaccggtcttctcgtgggtggtacctatcagctcatgacgatcggcaacatgccgatcggaggcgctcagccgcctaacgccgtcatcggcggcatcatggcagccattctcgctatcgccacgggcctcgagcccaacgcggcagtcggcctcgccattccgttcgctctgcttggccagctcggcgttaccctggtcttcacgcttatgtccccgcttatgtccacggccgataacatggctcacaacgcggacaccaagggcatcgagcgcctgaactacttcgccatggctctgctcggcctgatcttcgctgtcgtcgtcaccctgttcttcatcgctggcgctaccattggtcagaccatcgcttccgccatcccgacttggctgcagaccggtctgtccgctgcaggcggcatgatgcgcttcgtcggcttcgccgtcctgctcaaggttatgatgaaccgcgatatgtggggcttcttcctcatgggctttggcctcgcgctcatcaccgttgccaacgattctctggcaactcctgctctgctcatcctcgctctcatcggcttcggcatcgctttctgggacttccagcagcagaccgagctgaagggtgcagctgtttctgacggaggtgacttcgaagatggcatctaatgagtatgtgatcccggagcactacgaggatctcactcctgctccgcagctcgaccagaagaccctcaacaagatggcttggcgctcctgcttcctgcaggcctcgttcaactacgagcgtatgcaggccgctggctggctctactccatcattcccggtctggagaagatccacaccaacaagaacgacctcgcggcttccatgagccacaacctggagttcttcaacacccacccgttcctcgtcacctttgttatgggcatcgtgctttcgctcgagcagaacaaggttgacatccccacgatccgcgccgtccgcgtcgccgcaatgggcccgctcggtggtatcggtgacgccctgttctggctgacgctcgtgcctatcacggccggcatcacctccaacatggccatcaacggcaacgctgctgcgccgatcatcttcctggtgatcttcaacgctgtccagttcgctctgcgcttctggctcatgaactggtcctacaagcttggcaccagcgctattgacgctctgaccgccaacatgcaggccttcacgcgtgccgcttccatcatgggcgtcttcgtcgtcggttgcctggtcgtcaccatgggtggcacccagatcaacctccagatccccaatggcaccacccgtggtctctccgctactaccgtgatcgtctccgagaaggaggccgagaacttcaccggtatggagggcatcgataccgagaccgctgaggccggtaccatcgccatgaccgataaggacggcaacgcccttaccgcttccgatgccgacggcaacgctgtcgagtgcggcgtcaccgatctgggcaacggcatggagtccgtgacctacggcaccgttaccgaggatccggtcaacttctctgttgccgacaccctcaacaccatcgtcccgaagctcgtcccgcttatgcttacgctgctgctttactacatgttcgctaagcacagctggaccccgaccaagggcattctcctgctcttcgtccttggcatcctgggcgctggcccgcttggtctctggccgagcatctggtaaggctctagcttgaggggtgtgtccctacgcggctcacaccccgaccccttaagccatgtgtatgttaaaagccgcgtgctcgaaagagcgcgcggcttttgttttcttaatgattcgggtgtggcagacagataatgcataacaccctaggtagttagccgaattcgagcaaaagggaggataggatggcgatcggagcgcataagcaaccgctgtacgatcagctggtcgatattctgaccgaaaagattgaccatgaatatcgcgccggtgacatgattccttccgagcgcgaactttcggagcgctatggtctctcgcgcactacggtacgcctggctctgcaggaactggagcgtttaggactggtggttcggcagcacggtcgcggtacctttgtgaccgaccgctcggcaaaggcaaccaatcttatgcagtcctacagctttaccgagcagatgcgcgcgatgggtcgcgaccccgagaccacgattctcgatttttgcgagatggaggccgataagaatctggctgagcatatgggattgcgtatcggtgatcgcatttttaagctcaagcgtcttcgttctgccgacaacatgcccatgatggtcgaacgcagctatctaccggttcgtcaatttctatccctaaagcgaccactgctagagcgtaagccgctttacgatgtgattgagcaagactttcagcaaaagatacgcgtggccgaagaggagttctatgcgagcatagcccgtcccaccgatgctcaccttttgggaattgtcgagggctcgcctgtgctcgacttggtcaggactacgtataacgagtcaaacgaggttgtggagtatacactctcggttgctcgtgccgatcagtttaaatacaaggtttaccaccagcgcagtaactagtgctcgcatcgtttccatatggtgattctttgcatttaactggttactaccagataaccaaccgaagtgtataattgcacgtcagaggattacttctagagagaggtattagaaatgttcgagaagagtgtcgaggagctcaccgagctcggcgcccagatcaccacggccgagattgctcagcagcccgagctttggcgcgatacgctcaacatctatcgcgagaacaaggaggccatcgaggccttcctggccgaggctcgcgctatgggcgagggtcgtctgtccgttgtcttcaccggtgccggtacgtccgactacgttggcgatacctgcgccccgtacctgcgtcacgctggcaacactgatctctacgactttaagcccatcgccacgaccgacatcgtgagcgccccgcgcgacttcctgcgcgccgaggatcccacgctcgtggtttcctttgcccgctctggcaacagccccgagagccttgccgccgttgccgttgccaaggagctcgtccacaacgtcaagttcctcaacatcacctgcgctcccgagggcaagctcgccgtcgagtccgccgatgatcccaatgcgctgacgctactcatcccgcgcgccaacgacaagggcttcgccatgaccggttcctacacctgcatgaccctgctctccacccttattttcgacactgcctctgacgagcagaaggccgagtgggtcgagacgattgccaagatgggcgaggaggtcatctcccgtgagcctgagatcgccgattacctggctggcgacttcaaccgcgtgacctacttgggttctggctccttcggtggccttgcccaggagagccagctcaagatcctcgagctcgctcacggtctggttgctacttcctacgacacctccatgggctatcgtcacggacctaagtccttcgtcgacgataagacgctcgtcttcgtgttcgtcaacaacgacgcctacacccgtcagtacgacatcgacatcctcaacgagatcggtggcgacaagattgctcagcacaccgttgccgttcagcaggatggcgctaccgtctacgagggcgagtccttcacctttaagggctacgaggcgcttcccgagggctaccttgccctgccgttcgtgatgtttgcccaggctatcagcctgctcaactccgtgcgcgtgggcaacacgcccgatacgccgagccccaccggcacggtcaaccgcgtggttaagggcgtgacgattcaccccttcaccgcttaatcgcgtccccctgtaagggcgcccgtccgctcataacggcgggcgggcgctttttgtttttacatggaccgggtataagcattaccacagtcaactgctttagaagcaaggagtgcatatgagcacgtacgcaattaaggctgacaagttcttcttgccggcaggcccgcaactgggcggctatcttatggtcgaggatggcgtttttggcgcctggcaggccgacgagccctcttgcgagatcaaggactacacgggatcgtggatcgcaccgggtatggtcgatactcacatccatggcttctataaccactcgactaccgacaacgaccccgagggtatcgatatcagctcgaccgagctcgcccgtcgcggtaccaccagctggctgcccacgacgttcaccgatggcgtcgagcagatcaaggatgcctgcgccgccatcgcccaggcggacgagggccgcggccccgacttctgcggtgctcgcattcagggcatctatctggagggccccttctttaccatgaagcacgtgggcgcgcagaaccccgcttatcttatcgatccctccgaggaggtcttcgatcagtggcaggaggctgcgggcggtcgcatcgttaagagcgccatggcggccgagcgcgacggtgccgctgcttatgcggctgctctgaacgccaagggtgtggtgaccagcatcggtcactccgacgccacctacgatgagtgcatcgccgccatcaacgccggtgccagctgctttacgcatacctataacggccagcgcgggctgcatcaccgtgagcccggtgtcgtgggtgccgccatgtccacgcccgagacctatgccgagatcatctgtgacggcaagcacgtgaaccctgccgccatcaaggcgctgctgcaggcaaagggctggcagcacacggtgctcatcaccgactgccttggctgcggcggcatgcccgagggcagctacaccagcggcggcatggacgtcatcatgaaggacaacctgtgctggctcgccgacggcaagagcattgccggctcggtgctcacgcttgcccagggcgtcaagaacatcgtcgactggggcatcgccagcgccgatatcgccatccgcatggcaaccgaggtgccggctcgctctgcacacatcgaggataagtgcggcagcatcatgccgggtcgcgacgccgactttgtcgtgttcgaccatgagctcaccctcgtcgagacgtatgttggcggccagagcgtcggcaacgcctttaccgagtaacgatagaaaaagacggcgggcccgaatctgctcggacccgccgtatgggttaaacgctcaaaagcaccttaacagttacagcttgttagcgatcttctttgccgtgcgcttgacgccggccacaagaccccccgcgggatgctccttttcgtatgctagacgcttctcgcgcttggcgtactcttcgacgatgatgtcgccatactcgtcttcgatcttgtcgaagaagtcgacggcgcccttaatttcctcagcggtcgggtgtcccttctggacgccgccggtaatcttgaacggaccccacgtgtcaaatccggggcagccgtagacacccataaagatggcctgcctcatgcggcagatgccatcgatatccttgccgtaccacttgtttttgccaccgtaggtcataaggccaaacaccttgtcctgcggctgcagcacgttcgtgagcacgcgcgccatatctttgtcgatctcggagtaatagatgcccgtggcgacaccgatcagatggtattcgtgcaggtcggggtactcgtttttaccgagtgacttcacgtcgagggtatcgatttcggggtgcgcctcgacgatggcgtccacgagctttttcgtattgccgtggtggcgtgaggcataaaggatgatggttcgcataagaaggcctttcagctgtaattgcatcaatgtctgtatggtaccccgttgcatgcctgggaaaccggacgcatcgatgaacgtgcgggtttgtcctttggtcagggccgagacgggttcttgcgagcaaaaagcagttgttcgaaaggatggacaatggaatacgctctctccaacgattcgatttctatcaaggtctccacggccggcggctcgtttacctcgattgaggctggaggtcgcgagtacttgtggcagggcgatcccgccgtgtggtccggccaggcaccgatttgcttcccgatttgcggaggtttgcgcgataacagcgccatgacgtttgccggacatcatgtgaagctcgcccgccacggctttgcgcgtaagcaggagtggaagctgttgagccaaagcacaaacgagttggctatgtgcctggcatccgaggataacgctgcgctgctgagcgattatccgtatccgtttaaacttgtcgcccgctatacgctcgaggacgccgccgtgcgtgtctcctatgaggttaccaacgagggcaccgaggacatgcctttctttatcggtggacaccccggctttaggtgtccgctcgacgagggtgagtcctatacggactacgagttgcgttttgagaaagacgaggctgcggagctctgcaccgccgttccctcgaccggattgattgatgtggacaggcgttccaagaaccccatggtgggaaagacgctgcctttgtcgcatgagctcttcgattttgcggagaccatctttgacgtgctcgagagccgtcaggtcacgctttccaaaaagggcgaggacaagggcgttcgcctgagctttgagggcttcccgtacctcattgtgtggagcaagcccgagggtgattttgtggcagttgaaccctggggcggcctctcgacctgttccgatgaggatgacgtgcttgagcacaagcgcggctgccttatcgccaagcccaaagaaaccatcgtgcgctcgttcacaatcgagattctgtaattccgttttgtcgactcgtatcgcgaggcacaaggagcctgcgagataaggagctaaaaatgatcctcaccgttacgatgaacccgtctgtcgatacgcgctatcagctcgatgagctcgttatcgacgacgtcaaccgtgtgacgcccgaaaagaccgctggcggcaagggcctcaacgtggcccgtgtgctgggtcagctgggcgacgacgttgtggcaacaggtctgctcggcggccacatgggcgcctacatggctgagctcatggacgccaacggtattaaaaacgactttgtgcccatcaagggcgagactcgcatttgcctcaacatcctccacgccggcaaccagactgagctgctcgagagtggcccgacaattgcccccgaggagctcgatgcctttactgcaaagttcgccgagcttgcaggcaaggccgatgtcgtcaccatctcgggttcgctgccccgcggcgtcgaggcggactactatgccaagatcacgggcattgccgagaacgccggcgccaaggtgctgctcgatacctcgggtgcttcgctcgaggccgcccttaagtccgaaattaagcccgagctggtcaagcctaatctgaccgagattaacggccttctgggcacgagctttaccaccgacgatgtggacgagctccgcgccgcacttgcctctgacgcccgcttctccgatatcccctgggtcgtcgtgtccatgggtgccgccggttccgtgggcttccacaatggccgtgcgttccgcgccaagactcccgatatccccgccgttaacgctacgggctctggcgactccactatcgcaggcttcgcgcatgccatcgctgctggcgcagacgacgagacggtactgcgtaccgccaacacctgcggcaagctcaatgccatggatcccatgaccggccatctggtcatggaccgttgggacgaggtctacaacggcgttgtcgtgaccgagctgtaagagcttgggtgacggccccggcatcgcttgctagctcatgtcgacgacaagtgcggtagcattatgccggggcgcgacgccgagtttgtcgtgttcaatcccgaccttaccctggtcgaggcgtatgtgggtggcaacagcgtcggtaacgcgtttgccgagtagccgccaaagaagcgatccgagaggggatttagatgatttacggtgcattgggcgatatcgaggagtatcgcggaatgctcaagggcctcgacgtgttgatcgactggctcgaggagaacgacccggcggagctcgaggtcggcagccatccgattctgggcgacaaggtctatgcgaacgtcatggctcccacgacgcgtcccgaggccgaggctcactatgagacgcatcagcgctatcacgacctgcagatcgatgtcgagggtcgcgaggcctttaaggtcgctacgggcagcttgacgctggtccaggagtttgacgagaaggacgactacgatctggtcgattccgacgcctcgatcgccggcgatcttgctgacgataagtttgcactgttcgttgccggcgagcctcatatgcccacgctcgagttcccgggcgatggcgcgcagccggtcaagaagatctgctttaagctgcttgcagatgcttactgggaagagtaacgcgctgctcggctgagctgttcgtgttgtgagcgttttcctttggaggagcgcgcttaggccccgctgatcgcggttcctttggggattgcggctggcggggctttttgttgagtaggggagttgccggcggcgttgtgcttggattggcattgtgcgataaatcggggcttataggacaaaatgtgtgtcccgatagaacatccgtttccatccattaatcaagccagaacgggtacgggtccctgtggtggaggtcctcccacaggcatcgacctgcgccgatgcccccaacgtggacacacattttgtcctataagcctaaatcggcaagaaaaaagccgcccgaaggcggctatcttgtgcaatggagccagcgaccgggctcgaaccggtgacccccgctttacgagagcggtgctctaccaactgagctacgctggcggccatgtggtgacgcaactgaggcgtcaacggctgtttattatacgggacatcgcacatccgcgcaagggttctgacggcttttctcactttaaatgcactaatattggagacgtgatgtcccgctcgtatgggtctcaaacagaatggggcagccatggctcaacccaagattcttctcacgcgtatcgatgaccgtttcatttacgggcaagacgttgagctgtggaacgaggcgactggttccaaccttgtcctaatcgtcaacgacgagattgcggcggattcgcgccaatgggcacccatgagggtggcggcgccagaaggcgtttggacaaggtttttctcggtgcaaagggccatcgacatcattcataccgcaacgccgcgccaattgattctgatcatggtggcctcacccgccgatgcactcgcgctggttaagggtggcgtgccgatcaccaagatcagcattggccatatgcaggcaggggagggcaagcatcccgcagtgcccgcagtcgccacagacgatgcggacgtcgctgctctcagagagctgcaaaagctcggcatagaactagaaatccgctatctccccagctccaatcccgaccccatcggcaatctgttcaactgatcccttggggacggagaaaaacgaatcattttgcccttgcgagggacgcgtgcgatgctgcctgtcaaaaacaatgcccatttactacgtttgatcggccatcgccgagcatgtcgaatttgagaaaaacaaaaccgcaggtagacggctcgcgaatgtaacaaaaagcggtgcatggtcgagcatcccgggctaaacgtagtaaatggacatagttttgatatgtcacttatgcagtcacagcgaaaatgagcccaaaagatgaaaagcgcccgtcggcggtggtgccggcgggcgctgctgtgcgatatgtcgcgttgtgggcttagtgcctcataaagtggtattcgatcacattgctgtaggggtgacccgggcccacaatgccctgtgggaacagcgggtggtgcggcgtatcgggatacatctcggcctcgagagcaaagccggcgccccagtcatagttggcatcgtccttggcgtgctcatcgctaagccagttgccggtatagagctgaacgcccggggcggtggtgtaataatccagctcacgaccggtccacatctcctcgacatgcagcgcgcggcgcaggttgcggccgtactgatagccatcgatgcacagacagtgatcgtagccacgggcctgcttaatctgcgggtcgtctgcctccatgccgggtgcgacggggcgcagctcgcggaagtcaaacggcgtgccctcgaccggagcgatttcgccggtgggaatgttctgctcgttaatgggcaggtagtgagcggcgttggcaacaaagaagtgttcacagtccatgccggcgttatgaccggcgaggttaaagtatgtgtggttggtcatggacacgtaggtggcgcggtcgctctcgcagccatactcgatgcgaaagacgccggtgcgcgtaacggtaaacacggccgtaaacgtacggttgccgggcaggcccagttcgccatcctcaagcgaggtggtcatgcgcacggcgttgtgcacctcgtcgagctcaacgtcccacacgcgcttgtgcaggccgtgctcaagatcgctgtgcaggttgttgacgccttcgttggctggcatatgccagtccgtgccgtcaatggtgatcgtggcacccgcagtgcggttggccacagggccgatggtcgcgccaaagcaggcggggttgtcaaagtaatcctcgagcttatcgaagcccagcaccacatcgcgcacgttgccagggatgtcgggcacatcgatgccaagcacggtggcgccatagtccataatgcgaacgcagatctcgggcccgttgagggtgtaacgatgaacgggagtgccgcacggcgcggtgccgaaaagctcggaagtgatcatttggttcctaacatcgaggtatttcggacaaactgtagcgcgaacaggcgagattatcactacaccccactaaagcaggggtatttttctcaaaaaagtgatgattggaactgtgcgggcgttcatttttgacgggtacgagtctgatacaatttgttcgttactgtttgaatgatatgcgcgcaaagaacggcgaggattcatcgtgattaaggcagagcgacaggataaggttcgtcagctgctcgaagagcagggcacggtctcggtcaaggagatttcggatgcactgggcgtctcggatatgacgatccgccgcgatcttgaggagcttgcgagcctaggcgagatcgagcgcgtgcacggcggagcacgcagtgcacagggccgtccccacgcgatgttgcgccatgagtattcgcacagcgaaaagcgcaccaagcatgccgaggaaaagctgcagattgcgcgccgtgccgtggagcttatcgaggaaggctcgaccatctttttgggtacgggcactacggtggagcagatggcctcgatgctgccggcgtttcgcctgcgcatcgtgactaattcgctttcggtgtttagcctgctcgaggcgcgcgaagactgtgatttgtgcctcgtgggcggtatgtaccgtcgccgcaccgccgcttttgtggggccaacggccgaggataccctgcgggcattgggcatcgatgcggcgtttatcggtgccaacggtatcttggacggtgacgtatctacgtccaacatggacgagggccgtatccagcagctcgcctttagcaaggcagactcgcgctacctgattgccgattccagtaaaatcggcaagcgcgacttctacaccttctgccgcctggacagcttggacgccgtggtgtgcgaaccgggtatcgccgccgaggaccgcgccgccatcgaggagcacacgcagatcatttgctagctatcgctgcgggagatcggaccaagtattcagtttgtgggctagaccaggcggccgtagtcctgtgactgatgaaagacatgggcgatatagatcgtatcgcgctcaaacttgtaaagacacacgtatttgttgacggtaaacgatcgataattgcgtgccgccagctctcgtatgtgggagaggggccgtaggagcggctgctcgcgaagcagatcaagctgatattcaaactcagcaacaaaattgcctgctgcacgtgggttcataaggatttgagcaaggtatctgacaatagcctcgtattcatattgtgcgctttcgagtattacgacgttataggccatatttgtctcgtatcgcggtcgcgaaggagtcgtagtcgctgtagtcgccttgcgatatctcgtcttctgccaacatcatacgagacagcagcttggctttggcgatttcgtcttgcatgagacgatactggtcgctgctgatgcagtgcatggcctcatagccgttcttagttacggtgacgtcgcgctcggactcaacaagcgcggtaaatgcagcggtgtccttcatgtctcggacgggcacacaggtgggcataggtacctcctttgcgttgggacacaattgtaccacgccttgacaagaattcggtaccgtcaaattgtctcaatctgtaacgggtgggtgtgatcggagagtctgagggtctttatgggtggagcaaacggcgtgacatgcgctgttgaatccgtacgcccgcttgcgttttcgagtgaagaggcagcaaagttgattggcgtaagcgcgaagacccttgcaaattggcgctgtcctagtaaggggccggagtacattcgcctcggcaaatcctcgcgatcccatgttctttattgttacgatgatcatgaggcttggctgcactctctgcgccagcaggccaaggtaaattgattgatagctgttgggcgcggacaatatcgtttggacgggtatagcatggttccatgctccgcgttgctaattgcgccgctgcgtcatttgtgaaatggaatgattgatgatggagaggcgtgaggttctcggcttgccgcttttcacttggactaatgactgcggcggcagaaaaatgtcctggcgaacgactatcgtatagaacgcagcggtggttagatgggtcttcgcggtttgagtggtacatggattgtcggatgtgggagacgtgagaaacccatggtttggggcaaggttgctattctgacgagtttatctcttcatccctgtggcaaaatgaggacatattgtcctgttatctatccagaaggtgcgtcatgcaattatcagcagatgaggtaaaggccaagagacaggagctcggcttgactcagaaggaattcgccgctgccctaggcatgggccccaacggcgagcgaacggtgcgccgctgggaggcaggcgaaacaaggcccaccgcagccgagtcgaagtacatctccaccctcggccatcgcgccccctttgcacccgcaggggaggggaagcctgccttcaccttcatcgacctgttcgcgggcatcggcgggatccgcatgccgttccaggagctgggcggcaggtgcgtcttctcctgcgagtgggataagtttgcgcagaagacctaccgcatgaactacggcgaaaccccggcgggggacatccgtgaggtcgccgcttcagacatccccgacttcgacgtgctgctcgctggctttccatgccagccgttctcgcttgcgggtgtgtccaagaagcgctcccttggtcgcgctacgggcttcgaagacaagacgcagggcacgctcttcttcgaggttgcacgcatcctgaacgagaagcgcccgaaggcgttcctgctcgagaacgtgaagaatctgatcagtcacgacaggggcagaacgttcgacgtcatcatgcaggtcctccaggacgagctcggttaccacgttcactacaaggttctggactccaagggttggacatgccagcaccgcgagcgcatctacattgttggctttcgcgacgatgtggagttctcttgggacgacctcgactgcccgaacagtggtcagaaagccgcggagattctggaggaggatgcggacgcgaggtacgtgctctccgacaagctgtggtcatatttgaaagcatacaaggccaagcacgaggccgccggcaacgggttcggctacggtcttatcactccatcggacaccacgaggacgctctccgcacgctatcataaggacggtagtgagatcttggtctcgcgcggcgagggcgagaacccccgtaagctgacccctagagagtgcgcgcgcttgcagggatttcccgaccggttcataatcccggtctccgacacacaggcctaccgccagttcggcaattcggtgacggtccctgtaatacggtcggtggccaagctcatgatgggagcgtgtcaggatggattacggggcgcttagcagctacttcgacggcgcggtctcgaagaccctcgcggacgtcgatatcgacgcaggtaggagtaatcagcacgagttcaacggcacgctgccgctgaggtcgctgttcggtgacgacgacatccgcgacatccgcaccacgttcgcctacatgtgcgacgaggcggagccggagatgtgcgacgggaccgtgacttggtacgatgcgcgccgcaaacatcccacgagaaccgagtaccgtctctactacaaggacaaccccgccatcaggcaggcatccgctggcgacctcatggtggtcgccaactccgatgacctcgggctgctcatcatcttcgctaaaaaaggctcgaccatcgagtcgcagctgaggtggctgttcggcttcgaggagcccgaccgctcgggctatgccgtatcaaagggcgagcgcaaccgtatcggtgcggtggcctcgcgcatcctcggcatgattggtatcgagacgcgcgctcccttgagcgcggatatctacttggacgatatggtcaagaggtttggacatacgtttccgaagggcatcgactttacggagtactccatctcaacccttgaaggtctcgactgggcggatgaccccgatcgaagcctgctcgcgtgctacgagcgcgaggaattgctgttcaaggtgtttgagcgccatctgcttgagagagaccttgcgccctatttgaacggccagctcgacgtcgacggcattctgaagaccaccatgtcgaccttccagcgcaggaagtcccgcgcgggcacagcgttcgagcaccagcttgagttcctgttcaagggtaggggaatccgatactccgcacagccctacaccgagggaaagtcgaagccggacttcatttttccgtcaatcgagtgctaccgggatgaggggttcccctcctcgagccttacgatgctcggtgcgaagacgaccatcaaggagcgctggaggcaggtgctcgaggaggcgaaccgcatcgagcgtaagcaccttatcacgctggagcccgccgtgagcgtggactacacgaacgccatgcgtgacagcaagctccagctcgtcatcccctcccagcttttccccacctacacgccttcacagcaagaatggctcatggatgtgggaggcttctgcgagatggtcgaggagaggcaacgggtacttgactaggccgggacaataagagcgttgaggcggcgcgcaagcgcatgaccatcctgaagggctccgaaaagattgtggcatcgctcaatcagttcggcgttgtccggcgcgtgaggcgggggcactacgtgattgcagagcccatcgaactgaatgacgagcttacgcggtttttggtctttgccgacatgctggtaaaccggtcgagttaccggacgttcctggaactgcaggacgtggccgagttgtttccgttcgcgtgccgtgtgagcaaggagggacttgtggctgacgagcggttcgaggtgaacaacttcggcggggagttctcggtggggatacgggagtaggagagtacaggtcactcctacgacgcaacacctttgccacgcgtgaaaagcatatcgtcaatcgaaagctgcaggatttgcagtttaccctgctcctcggctggtatcagcgacgaatcgagcttctccttaaggactgcgactatgtactggcagttgattgtgctggcgcgtgcgattatgtcacgcaacaccttaccctcgatgttttcaaggacgtcatgcactatgaagcgcggagtcttgatgccctttgattctgcaaactgctgatacgctaaatcaaatgcggcgatgagtgacttgcgtgtgcccgtgctggagccagcggtatcacgtattgcaacggggaacttgttcgactcttcatagtaaacgagcagcggcgattcgttgttgaactccctggcaagcggagtgaagaatgcgttaaacgcaagcatcattgcagcaaaatcgttggattgcggctcgtcgccatcatcagacgagccaagcgatgcgatttttccctcaatgctggtctgttctacctcaaagctgttgagcgtatctattacttctcggcatttgccgatactgctcgaaagctcaactaggcgtgcctgaagcgactcgtactcatcgatgaggtcttgctccaccaatgacatgaattggctgttctgcgatgacagttggctgatttcacgttgcacagatgcacgctcggccttcagtttttctgccacactcgcgaaataggcaatcttgttgtcgcagagctggttgttgaatgcgaccatctcttcgaaagttgcattcaccatcgggatcatcgaacagacttcctcgaaaaaccgtctgctcaaattaacgtcggcttgtctaccgcgctcttgcatagcagtctgcagggcctcttcatttcgttgcagcctgtagtctatgtctgagagttgcagtgtcagagatgcgtatcgggtgcgtgtagccgcgatttcatcgcggttggccctgtagacatcggcgtcgatgatgctgttgagcttgcactggacttcttcatgctcggcttcgagccctgcaagtatctgctgctgctcgctgaccgtatcgacgttctggactttcttatagcgtttgatggactcacgcgtcttgttcaagtccttgttgaggtcgtcacgctttttgtcgagcgccggatctgagatgccgaacagagcgttgtagacactccggtagatggatgtgctgccgctgggaacggttttgaggaaggaattatcatccccgcctacggacacgcggacaaatgaattgatcaattggcgaaacgtgggcacattcgcttcgttcccgaaaagcaagacattgagtcgttgctggtaagctttctgccccatcttttcgccgtctatgtagtaccttccattcgggaagaggtcgattgtgagaatcacgtcatcgccatcgggaaaatccgatgtcagtgtcatgtcgacggcgatcttgtttgtgacgatgaaatcgcgtagctcctcggtcaccgtgcccgtgtcggcgtctgtgtaaatgagcttcctgtccttggcgcccattgcgatatcaatgagcttgaggaaggttgtttttccaacgcgattgtgcgattcggagtcctcggtatcgacgatgaggttggcacccttgtggaataagacctcgcgaactatttcgtcagttgttgtcttgcgaattctaagcgacttgatgaacatgtagccctcccttctcgtctattgacacgcgtccgaggaggaagagaaagtccaaagccatgacaaagaagtcgtagctcacttctttcttgaccagagtgttcgccgttacctcatagagttgaccggcgtccaagcctgggttctggtcgatgtagccatccaaggcggcagcgatgtaatagaccgtgctcgtcggctcattattgcgatcaagcagcagcatcgtcatcacctggcctcagaaggactctgcattttgccacggcaacggcaatcaacgcaacgcagaactggttgatgatttcttcggggacctcgtcagcctgaaagcttgcgtcattcacaatcatgttatagatctcgttctcgatgagcttgagctgtgcatcgccgtttcctacgcacagcttgccgtcatcgcgaacgtctgccacattgacaaacatcttgttcagcctttggatgatggcttcgctgtcggggaattccttgatcacgctgtcgagacgagcgtagttctcagaatactcgttgatgatgtttaggtaacgcggtgcgtggttgtaaatcagcttcttctctataggaggcggaggcgtaagggggaaatcttcgcccgttggctcagtcgacgaaatcatgatttgcaggagtttatacatgagcgtctttgtaagcggccggtgcgggccagacgagacgggctggtagatgtttatgtcatgtgagtcatagctattggagtcgccggctatgttcgtggcgacctttccaattgcgctctggcttgtctgcgttggcttatcgcgaagcatggatgttcgccgagttgttgctgcctacgacgtttgtggcaactttacctgtagcggtctgcgagttgtcgcttagactctttttgattgacttgatctcttgcttgttttggagcgagatgacggcggcggcgatggatgcgatagacgcgataattccaaggataaggttcacagtctccatcttgcctcccaaatgtcaagtccaatattctagaccattatcgagcgttcgctcgttgcgttgcctctaattcttgctaatggtcacaaactgccgaacggactggatgacctcactttgtgaccgacctttagcctatttgcatggttaagggacggttcgtttgtgctggcctatgtcaatcgaaaggcaggccgacatggacggagacgaccatagcatcgacgacgaggaagaggtcgcagcgcaggcgggcggccaagaaggggtcgcgcaggcggaagagccgcaggcagtggactcggagaggggctaccaggcgcttctcgccaagcaggaggctcgcatcaaggagcttgaggggcaagtggccgaggctgccaagagcgccgaggtggcggacgccctgcgcgacgaaatccagcaggtgaaggccaggcggccgatgagcgcatcgccttcgcggcagacagggcgacgttcgcaaccatgaacctgacccacctcttctacttatgcacggcgctggaggtggtctccggtttgggcaacctcgcaggtgtcaagtcgtgcggttcgcgttcgcttcgcgctcgtcgcccgccgagctggacttccgaggcttcgacccgtctgcgctcaccgacctgacctactgcttctcggggtgctcgtcgctggtgacgatctacgccgacgccacctgggcgctgccttcgagcggggtttcggactcgcagtgcttctataactgctacaagctgacgggcggcaacggaaccacgtatgcaagcagcaggacggtttatacccacttccgtatcgatacgacggctacgcctggttacctgactgtctctgcttgacatgctctttggctacggtatttgcgtcagtctgggtaatatccgagaacatttcatcaacgatgcggacatggcattcataagctgcatacctgctggacctcaccgcattttccgcttcctgcaggcgtgttgcagcatccctgaatcgggattttgccgccatttgccccatgatggagtctgggtggttgtcactgagtacgtctgcgtctctcagttctatttccgcacttgcaatgcgttccataagcagattgtattgggcatcgccgacctcagacaggcagagcacaaggtctttaaacgctgctgcggtcagcattcgattgagcactgccctgcaagcttctggctcggcattcgccttcgcgaccatatcattcacgaggtatttttcccattcctcatggtctccgccgttgccaccagactgttccggaagccactccgcactaacttttctcgtcatacgctcgatggacagaacagcctcgccgctgagaccaaggaagtcagcaatatcttggagctcgtacgtatcacaatcggtctccccgatgagaaaacctactggctttccgaatatgtcagccagatctacgaggtcatcccattgaggaaactgatctccttttcgaaatcggctgatctttctcgcaatcgccttgcggccgttctccctttccactgcatagcggtcatcggctagcgaggcatcatcggcaccgttacgcttttgatagagcagacgcgcaaggccgatattgctaatgcctctgcgccccttttctatttcatagctttccatcaaaccgctgagtctctttggaaaaatgtccttagggcgatctttgcggacgtacattgtcttaatcattcctcattaacaacagataagacaattataggacatataccgtcttatttaccgatggcatgatagcactgtcgaaagtgagcaccccagtggaagcggtgctgaagtgaaagaaagtgaggaaaaggcaatgacgacttgggactatgcgcaattgtcgcatctggcgaaagagctcggtgggcctcaggcgctgatcagcaatatcagagcgggcgggatttccgttggaagaatccagggtggagtaatcggttctgtagccacgctagtcgcaggtggaatcggactgtatgcctacgacaagcaccagaggaagatcgctcttgctgaacagagtgcaaccatgctcaaggcgaacatcgaagcatacgaagaggcacattcgtcaacagaagttgatgaggctacgagagagacgcaacatagtgaggaggaaacggtaactgaatccagtggcggcgaagaggcctagccaccagattcattagacagccactaccacgaggagccccggtatgtaccagggctccaattcgttcttataccttgcagcggatacttagatctctcgggacttgcagtagagcgggtcgccctctccgaccagcacatcccaccgccattgcggggtctcggtgccggactggcagagcgcatcgaggggcatgactttttgctcgggcgagcaggggcaaaggtctgccttgatgtgggccatgtcttcggcctggccggcgagcttttttatccggggaccatgctttcggcacgcgatcccccatcctcaacctcccaaatcaaaaactcaatctgtaacacctagactcgatttgagcagatatctgttacagattgagacgtttcggcagagtgattcccgtttgtcttgatttgtaacaggtagaggcaaaaaaatcgacttgatgttacagatttagacaaacggctgccgacccgcgcgaaaacaaaaaggccgcatgcgaacccgtggagggattcgcatgcggccgacaggggtatgcggcggaaactaggccatgagcaggccggtctccgcgacgttcttgtaccagtacgcgctcgccttgggatagcgcttctgggtctcaaagtcgatgtagaacaggccgtaacgtttgttatagccgttggtccaggagaactggtcctgcagcgaccacacaaagtagccgtcgacgtttacgccgccgtcgattgccttgaggatccatgcgagatgttgacgcatgtagtcgatgcgaggggcgtcgtcgataaagccatcctcgaagtcgtccttatagcccatgccgttctcggtgatgtagatcttcttgtagttggggtaatcgttcttaatgcgcagcagcaggtcgtagaggccctcgggatagatgatccagtcccaatcggtggtgggtacgccttcgcgcacgcatgactcgcccacgcccttgaggaaccagcgcgaggagcccttgtcgccggtgccattgtggttgatgtcgttttcgccctcggcggcacgcaggaactggcacttgtaggtgttgacgcccaggcaatcgttgtaggggagcgcggcggtcagcgcggcgatgtcctcgtcgcggacgtcgagctcgccgccggcgatatgggccagcttggtcgcagcctccatggtgtcggctgcatagtggccgcggaaggtggcgtcgagtacccagcggttgttgatgacgtcggccatgcgagctgcctcgcagtcggcggcgttgttggggtcgaggggatacttgggctccaggttctggacaatgccgatctcgccctcaaagccgccctcatggaaggcgacgacagccttggcgtgggccaccatcatgttgtgcatgagctggaaggccttgtccaggcggtacttctcgccgtgcggccagttgccgacgataaagctgccctcggcggttgcgggaatctcgttaaacgtgaaccagtgcttgatctcggtgaactcggcaaagcagaacttggcgtactcgacgaaggcgtcgatcgtcgcgcgcgtcaggaaaccctcgccgccgttctggtaaaaggcctcgggcgtatcgaagtgatcgagcgtgacataggggataacgccagctttgttgcaggtggcgaaaagctcgtgatagaaagcgacaccctcggggttaatctcgccggtgccactggggaagatgcggctccaagcgatggagacgcgaatgccgttaatgccaaagcgctggcacaaatcgatatcgaccggatatttgttgtagaagtcgcttgcaggatcgggggagaagcgaccctgggctgccaggaaatcgtcccagggcactttgcccttgccgtgcgtacgggtctcgccctcaacctggtaagcagcggtggcgccgccaaagacaaagccgtcggggaactgcatggggttggtcatgagtcatcctttctgtgggatacgaatagggagaggtgcccgaactggggatccgggcaccaacagagggaggaaactagtcgaggttctcgcggagccacttaatggcgccggcggggtcgcgagtaaggtcgatatattccttaccgcgcggggcgagcagcttaatgcccaggcgatcggtgtcggccttcatgtcgttgtagtagctacgaacctgcggggcaagcacgataacgtcgtactgatccatgatggcagtgtgctgaccataggcgcctgcggaggaagcgatgttctctccggtctgcgcggcaccttccttgatggcgttggcaagcatggcagaggtgccggcaccggcgcacaggacgaggaccttcaggccgtcgacatccttcttagcggatgcgtcggcggcaggctcgggctgatcggcgacaggcttgctttcggcggcagcggcggtcgtctcgacggaagcggtggcctgctcgacagcgggcgcagaggcgtcggcggcgatggcagcggcaccattggactcgagacccagctcggcggcgcgctcggcctcctggtcgcagagcagcttatcgtatgccttcaagaacggcaggtagatgatggcgtccagtaagatgatgatcgcgacaaataccagggcgataagctggaagttcgtggtgatgaagatgccgatgggggcgggggtggcccaaggcaccacgaaggagaagccgttcatgcctacgttatcgataaagaacttggcaacgctcacgttgacgcagccggcggcaacaaaggggatgagcatgtaggggttaaggatcatcggcgcgccaaagagcagcggttcgttgacggcaaaggcaacaggaacaatcgaggccttaccgacggctttgagctgcttggacttcataaagagaatcagcagaagcggcacgatgaaggtggcgccggtgccgccgaactcacctacgagcgacatgttaaaggtgagggagtgggcggggtggccaccggccagcagaacctgcaggttctcggcctggttggcaagacggatggggtcgatgcccggctggacgatcgaggggccgtggacgccgatgaaccagaagaacgcggtggctgcctggataaggataaggccaggataggtttctgcagcggtaaagagcggggagagcagcttgatgagcagctcggagaacggaacgcccatgaggttgcgcacaaccacatcgatgatgccgcagatgatgacggcgccgccaaaggggatgatgtcgcggaagttctgagcgatggcgcccgggacctccttgggcagcttaatggtcagatcgcgcgagacgcagaacttataaacccacacggtaatgaacgcggcgatataggccgagaacagaccgcgcgtacccatgctggtgcaatcgaagaccgaaagctcggagccgtcgaacttggtggtgaactgcgtaacggcgagcaaaagcatgctgcactgggcggccaccatggtggaaccgtcgttgagcactttgccggcgggcatgcgacggttcatggatgccgtgaagttcttggcggtggtgccggcaaccatgatgcccatgacgcccatggtgaagttgtagagcttgttgcaccagtcgatgagcggctggggcagcgtgatgccgactacgccgggaagcgtggcgatcagcagaaagatcgaagaggtaaggacgatgggcatgcacccaaggaatccgtccttgatggcctggaggtagatgttcctcgagatcttctcaaagaacggttgatgcttttcgagcatctttacgatggcgtccatagagctcctttgctgcttgatgcgcgatgcatgtggatggaactggtcgtcgatggatggtcaggactgcccggaaaccttcctgggtaaggaaggcattgcgaaatgacaacgttgtcatttcgttaatgacaacgtaagacatttttggaagagcaacaaggatttacgggtgaacggtcgatattgtccgataaacggctgatttgtcagttgggcaggtagtgtatgctagaacacaaaaaacaagcgatgcaaaaccgactggagaagtagtggcaacgatggacaagaaaaatgtctcaatgaacgatgtggcagttgccgcgggtgtttctctcaagacggtgtcgcgcgtgatcaacgagcctgatagcgtgcgagagtcgacgcgcgataaggtccatgcggccatggaggcgctcgggtttcgaaccaactttgccgcgcgttcactcaagttgggccgttacgggtgcatcggcgtggtgatgtttcacttgtcgggcggcgccgtggacatgattgacggtatcgccgatgccgccgaagagcgaggctttgctctcacgatgatcaaaaagcgcgctggggagaagatgacccttgccgatgcggcgcgcaggatgtcgcagctgcctgttgatggcatgatcttcaacctgcgtcagatggtcgatgactttgatacctttgaggcgccgaaagacctcaagacggtgattatcacaccaatggaacatcctacctgctccaccgtcagtgacgatcaagagggcggcgcgcgcatggcgtgcgagtacttcttgaaccacgggcacaagaacgtgtacttcgtttcgggtaagaaagagtcgctgtcgagccagtgccgaatgaaaggctggcgagcggcgctcgaggcgcgtggcattgagccgcccgagcctctgcaaggcgattggaatgcggatagtggctatgccgctggccttgtgcttgccgataaacccgattgcacggcggtcctcgctgctaacgactgcatggcaaacggcgtgatgatggctctacgtgacaagggtctgagtgtgcccgatgatgtgtccgtgatcggctttgatgacgagctttacaagacgattcccaactcgattctgacgtcggtgaagtttcgccaccgcgagctgggcgtccgtgcgctcaacgaggtcgttgcgggcctagaagctccgagctccagaagccgtacgctcgtctcgggcgtgttggtcgaacgttccagcgtaaaggacctgcgggcgtagggtttttcggcccgttcgtctcaatctgtaacagttaggaccgaaaaactcagctaaatattacagattgagatatttctgctcgggcgttctgtttgtctcgatctgtaacagctaggatccaaaaactcggctagatgttacagattgagatgaacaggagggcgggtgcggtctaaacaaaatggcccgcgcatcacgcatcgatgcacgggccattttttgtctgcgagcggcaggtggcatcagcgtcttatgccttgaggttttcctcgatccaggcgacggcacccttgggatccttagtgaggtcgatgtactgtttgcctttgggcgacagcagcgtgatgcccaggcggtcggtgtcggccttcatctcgttgtaataggtgcgaacctgcggagccaggacgatgacgttgtactggtccatgatggcgtagtggctgccgtaggcaccggcgttggcggtaatgtcgatgcccagctcgtcggcgccttccttaagcgcgttggcgagcagtgcagaggtgccggcgccagcgcacagaaccagaaccctcagatccttgcccttaagggcggacggagctgcggaggcctcggtggcagaagcggtctcgacaacaggagcctcaacggcgggggcggcagcggtcttgacggccttggtctcctcggcctcttcttcggccagggtctcggcctcctgcttgcacaggacgttgtcgtaggccttgcagaacgggtagtagatcaagaagtcaacgaccagcaggacgacaaccaggaccagagagatcggctggaagttggtgtcgatgaaggtgccgatcggtccggggagtgcccacggcatggcatagataaagccgttcatgcccaaaaagtcgatgaagaacttaccaatgaggacgttggccacgggggcaaacaggaacgggatcaggaagtacgggttgaggatgatgggcgcggcgaacagcagcggctcgttgacggcgaacatcacgggtacgacagaggctttgccgacggccttgagctgcttggagcgcataaagagcaggaagatgatcgggacaatgaacgtggcgccggtgccgccgagttcgccgatgtagttaccgaagttctcggtcagggcgagggcggggtgaccgccggcctgcagcgtggcgaggttggtggtgatgttgccaaacagcgcggcgttgagggcaggcttaacgaccgaggggccgtggatgcccatgaaccagaacagcgggatcatgaaccagatgagggcgaggccggcgtaggaatcggcagcggcgaacagcgggctcaccagcgtggagatgacgttggcaaacgggacggccaagcaggtgcggcagataacgtcgatgacggcgacaaacaggatggagaagctgaaggcgaagatgtcgcggaagttctgggcgatggcgccggggacttctttgggcagcttgatggtgatgtctcgcttaatgcagaaggcatagatgttgaccgtggcaaatgcggcgacaaaggagctcagtaggcccttggtgcccatgttgtcggtaaagaacaccgagacatcggcgccgtcgatcttggcactcgtctgggtaacggccaagatgagcatagcgcacatggcggcgaccatggtgctcgtggcgttgatggccttgccggcaggcatgcggcggttcttggagccggtcagcgcgcttgcggtggtgccggcgaccatgatgcccacgacgcccatcgtgaagttgtaaaccttgttgcagaagttcacgacgtcgacgttccaccagtcgggcagcgtaaagccgccgaccgtggcgacaacgcccggcagggtcgaaataagcaggaagacagaagaagacaggatgatgggcattgctgccaaaaagccgtctttaatggcctgaaggtagatgttcttagagaccttgtcgaagtacggctgacctttctccaagaacttaacgatcgattccatagttcacgctcctctttgcatgaaatcttaatggcatggacgttgaaaacctatatggtctcccgcttgctaaaagcccgggtgcaggcggggtcggtcccagggggagagaggggagcggctgggtttgtatcgcatagggccgctcccctctcgggagaaagcgaggcgatgcgctactgcgcgtccgccatagtgtcggcgagctccttgtaccagagtgccgactgcttgatgtagcgtttttgcgtgtcgaagtcgatgtagaacaggccgtagcgcttgttatagccgttggcccacgagaactggtcctgcaggctccagataaagtagccctggacgtcgacgccctcggcgcgcgcccggagcaccttctccatgtgctggtcgacaaagtcgatgcgctcgggatcggcgacgatgccgtttgcgccgggctcggggtccttgtggcccaggccgttttcggtgatatagatgacggggaggttgggataggtggcgctgatgtgcttgagcgtgtcgtagaggccttgcgggtagatgagccaatcccagtcggtggtggggatacccggcatatcgacctgctgcccgacgcccttaaacttaaagcacgaggtgcccttgtctccggtgccgttaaagctgttggtggactcgccatcgtaggcggcgataaacgccgactgatagtagttgaggccgaacatatcgttgcggggcgccgccttggcgagctcctccatgtcgctgtcctcaaccgtaagcgtggcgttgttggcacgcagaatctcgttgatgagtgagagggtgcgcgcggagtagtgacccaggaaggcgccgtccatgatgaagtcggtgtagaaggcgttgtacaggtcggcggcgtgctggtcggcgggcgagtctgtggcaggatatgccggcgtcaggacgttgaccatgccaatgcgtccgcccaggtgctcggtctcgtcaagatccttatacaggttgacggcgcgggcgtgggcaacgagctcgttgtgctggctctggatgccgctcgtcacatcaaagtgatggttgggcgggaagttgccttggatgtattgggagtgcgagaggctgatgagctcgttgatggtgaaccaattcttgacctcgcggaactcgcggaagcagaactcggcatagcgcacataggcgtcgacggtcttgcggttgagccagtcgccctggttgaacagggcggcgggggagtcaaagtgatgcagggacacatagggctcgacgccatactttttgcagcaggcgaacagctcgtggtagtgcttaacgccctcggcgaggggctcggcatcgtcgccgttggggaagatgcgggtccaggcgatggacacacggatggcgttgagtccatgctcggcagaaaggcggatatcctcctcgtagcggttgtagaaatcactggccgggtcgggcaaaaagcgaccctgggcgacaaggtaatcgtcccacatggtcttacccttgcctgccaccttcgtggaaccttccgtttggtacgcggcggttgcggcgccccaaacaaagcccttcggcagctgctgtacgcggtttagcaaagacatatgcatacaccctctcgtctcgctgttcgatattgtgcgtttgcgctcaggaggctccctggttagcgttcagcggtgaaaaagcccgataaacactatcttaaaatgattagaaccaaaatgagcacgtgaacatttgacaatgagcacgttaacatccggctgggatgtatagaaacaaaacaacttcaaacagccgcgaacggttgtatttgttcggtaagcggttttgattgacagaagttttcatgttgtggtatatggctcgggtatcatgagcacgttatcgatgtatgtacgatgcgccatgggcgcggggaatagttgggaagcaggttagcgtggaaggcatggctcagcagacaaggaatggtcattcggcgagcgcggcagaggttgcggcgctcgctggcgtgagccgccagactgtgtctcgcgtggtcaacggtgtgcccaacgtgacggaaaagacgcgcaagcgtgtgctggccgccatggaagagctgggctttcgtcccaattttgctggagcggcgttgcgcggcgggtcgtatcgttctattggcctgtgcatgtacaacatcacacgtgtcggtaacctggcgacgctcgagggtatcatgcaagcggcgcgcgagcacgattttgccgtcactatgatcgagatgggcggcgacaagccctatacacttgccgatgcctcgcgccgcatggtcgagcgacccgtcgacggcatgattctcaacatgaaccgcatggctcccgattttgaggagtttgttccccagccgggagtgcgaacggtcatcctgtccatgtatgcgcatccgcgctgcacgacgatcgactccgaccagtatggttcgtgcgagctgttgaccaattatctgctggaacatggtcactcgaatatgcggtttgtggcgggtccggaaaactcgatttcctcgcgttttcgtgaggccggttggcgcgatacgctgggtcgtgctcatgtcgatgccgctccgatgctgcgtggcgattggagtgcggacagtgggtacgccatgggcgagcggattgcggccgaggtgcttgccggcgggtcgcaggcgccgactgccgtgcttgcggcaaatgaccagatggcgctgggcgttatcgccgcgctcgagaacgcgggcctgtccgtgcccgacgacgtgagcgtggttggtatcgacgacgcactcgagggacttgttcctcacaatcgactgacgacgctgcgatttgatttgcgcggtgtcggtaagcttgcgtttgaggcggcgattggagagagctcgtctatcgaggcgattcatgtgccgagtacgctggtcgaacgctcgactgttagggacatgcggggttaggtcctactccgtttgtctcgatttgtaacaggtagacggtcaaaagcgggctacgtgttacagatttagattcttcggaaagagcaatcctgttcgtctcaatctgtaacagctaggaccaaaaaactcggctagatgttacagatcgagacaaacgtgcgacacggtccgcccaaaaaaggccgggggcggcgcgccgtgtgacgtgccgcccccggctgagaaatggggacaggttatgtgagcgggcaaccccgccagtcactagtccagacgacgggtctgcgccacgtgcttataccagtatgcgcttgccttgggtgtgcgcttctgggtttcaaagtcaacgtagaagaagccgtaacgcttgttgtagccattggtccaggagaactgatcctgcaggctccacaggaagtagccgcccacgttgacgcccacctccatggccttgagcaaccagcgcaggtgctgctcgatgtagtcgatgcgcggctggtcgtccacaaaaccgtccttgtaggggtccttgtagcccatgccgttctcggtgatgaagatctgcttgtagttggggtagcgctgcttaatgtagacgagcagatcgaacagaccctcgggatagatgatccagtcccagtcggtggtggggatgccaggcttgttcacgtgctcgccaatgcccttgacgcgccagcggccggtgcccttctcgcccgtaccgttgtggtgcaggtcgttctcgccatcgtaagccttcaagaaacggcactggtagttgttaacgcccaggtagtcgttgtagagcgcggcctcgcgcatgatttccagatcctcgtctaggatctcgatggtgccgcccgagacggcagccaggcggttggcgcactcgagggtgtcgggcgcatagtcgccgcggaaggtggcgtcgagcaagaactggttttgcagcacgtgctcgttgttggcggccttgatgtcggcggggtcgttctcgttgagcggatacttaaactccagcgactgaatgacgccgatcttgcccttaaagccgccgttgtggaaggccagcacggccttggcgtgggcgagcatcatgttgtgctcgcactggaaggcctcggccagatgcgccttgacgccaccggggaaggtgccctcgatgtaggtgttggaggcgtcggcccagatctcgttaaaggtgaaccagtaggtcacctggtcggcgtactccttaaagcagaaggtagcaaagtccacaaaggcgtcgatggtctcgcggttgaggaagtcgcccttctcaaagagggacagcggcgtgtcaaagtgatgcagcgtgacaaacggctcaacgtggtgcttatggcactcggcgaagaggtcgtgatagaactgcacgccctcggggttaatctcaccggtaccgttggggaagatgcggctccaggcgatagagaggcgaatgccgttgatgccgaactcctcgcacagctccaaatcgacggggtactggttgtagaagtccgaagcgggatcgggggagaagcgcccctgggcctccaggaagtcgtcccaggcgactttgcctttaccatgggtgcgggtctcgccctctacctggtaggcagcggtagcgccgccaaagacaaagtcctcgggaaactgcgcaggcgggttggtgacgctagcagggttaacggacatgatgatccaatcgtctaaatcgaagggccagccggtcttggatggtcggctggccctgagcgttacttacttcgagagttgctcgcttacgaaggcgagagacttatcgccgttttgggaaagctcgatgtactgcttaccgcggcaggcgacgcacttgttgcccacgcgctcgcagtccttctgcaggtcggccaggtaactggcggcctgcggggccaggacgaccagatcgaagtcggggagcatgtccacgtggttgccataggcctcggcagcggtctcaagattgatgccgcgctccttggcggccttggccagcgcgttggcgagcaggcccgaggttccgccgccctggcagagcacgagcacgcgcttgccgttgaggtcgctggcggtcgttgcctcggtggcggcgggagcgacgtcggacttcacggcctcggcagcagcgccggcggcaacgctcttggcgtcagccttgccctggaaggcatcgttgagcttagcggccttctcggcgttcttggctgcgagctcctcctgggaaatctcggcctcctcggcgcacttctgggcgtcataggcacggaagaacggatagtacagaacgaagtcgacgaccaggataagggcgagcatcacaaaggcgagcggctggaagcccaggcccatgatggtgccgatggggccggggacggtccaaggcagggtgtacataaagccgttcatgcccaagaagtcgataaagatcttgaggatccagatgttggcgatcggggcaaagacaaacgggacaaagaagacggggttgagtacgatgggcgcggcgaacagcagcggctcgttgacggcaaagcagacggggacgatggcggccttaccgacggcgcgcatctcctgagacttggccaggaagcagaacataaagaccaggacgagcgtggcgccggtgccgcccatgcagacgacgaagtactgggcaccctgggtcaggacagcggaagcgtgctggccggcctggaacgcagccaggttgtcggtcatgttggcaacgagagcggcggcgatggcgggctcgacgattgaggggccgtggacgcccacgaaccagaagaggctcatggcgccgtagatcacagcgaggccgatgtagccatcggcagcggtgaacaggggctggaacacctggatgacaccctgggcaaagcagaagccaaaagcagcgcggaagacgatgtcaaaaacccaaaagacggtgatgcagacggagaaggggatgatgtccttaaaggtctgcgagatgttgggcggaacctgctcgggcatcttgacggtgatgttgcgcttaatgaagaacttgtagatgatgccagtcacaaacgcagcgatgaaagcggtcagcaggcccttggaaccaaggtaggtggtgttgaaaccgctggcggcgtccgtggcgatcgtgtcgctcgaaaggagcaagaagccgatgatggccgcgcacatgcacgagatgaagttgatctggttgttcttgggcagatcgcggttctgagcgtcggcgaagtgcttggccgtggtggcggcgcaggcgatggccaggatgcccatggagtagttgtagcacttccacagggcgttgttgatgtcatcgggccagtagaaaccccagatgttggggaccgaggctaccaggcagaagatggacgagaagatgatgatggggatgacggagataaagccgtcgcggatcgccttgaggtacttgttgcgggcgatcgcgttgaaaaagggctggcccttttcgatgatggcgatgagttgctccatgcaatgctcctaagagtcggtgggttagcaacgatggtagcttttgactttcggttgccaaaatgttgacgttgccattttgtgacacaaaaaaaaagaagcgaaccggtggttcctgtgcctgcgaaccgtcgattccttacgcgtaaacgtttgagccgcccggtggctctgtgtttgcacaatggcaacgttaacatttggtcgacaaaagccgtttggggaagcaaaaatgtcggtgaacggtaggttttgggtggtgagcgtatggtgggggaggcgttggatatacttgaaggcggtaaaaatgactgcgcaaggtgccatcaatggcatcgttgacatagaaagatcgacctatggccgctgttaaaaaatcggtatccgttaaggatgtggcgcgtctcgcgggcgtctcggagcagacggtctcgcgcaccgtgcacgattcgcccagcgtgcgccccgagaccaaggaacgcgtgcgtgccgccatgcgcgagctggggtatcgccccaattttgccggtcgatcgctgcgccgcggtaagtttaagaccgtcggcgtcgccatgttcaacattaccggcaccggcaatctcgaccgtatggagggctttgccgccgcggccgataagcacggctatgccatcaccctcactaaagtagacgggcatccgtataccctcgagagcgcatcgtcgcgcatgagcgcactgccagtggacggtatggttgtgatcatgaatcgcatgccggcagactttggcacttttgagccgctgcccggcatgcagacggtgctcgttacgatgttggagcacccgctctgttcaacggtcgataacgaccagttcgattgctcgcgccaggtggtcgagtacttgctggagcgggggcacaagaccgtgcactttatctcgtgtcccgagcgctcgctttcgggcatgcggcgcgaggaaggctggcgcgagacattgcgcgcgcatggcattgagccaccgcgacttatccgtggcgattggacggcgcagagcggatatgccgcaggtcaggccctggcggatgatccgacctgtacggccatttatgcttccaacgacgccatggcctacggctgcattcgcgggctcgagtcgcgcggaaagcgcgtgcccgaggacgtgagtgtggtgggtgttgatgacagcctgggcgatatcgtgcccgaccgtcgcctgaccacggtgcgctttgacaacaagcgcgtcggcatgtgggcggtcgacaagattgccggcgccgagggcgttgcgcccggtgtggagcacatgctgtttccgggcgtgctcgtcgagggcgatacggtgcgcgatgtacgctaggggcgcaggtctgtttgggttgccgctaattgtgttcgatattgttcagattggtttaaaaaccgttcacgggcgaaaagcgaccgttcatagctcgaaatcacgttttgcgctgttcttttttgtttgaatgttaatgtttctgtcatacagaacgcagcgcgtatgcccggacgcgatgctctccattggttcatatgtgaaaggaacgcaatatggcaaccaaagaagaaatctcgatggttggattcgagattgtcgcatacgcaggtgacgcccagaccgatctgcttgcagcgctcgatgctgctcgcgagggcgattttgagaaggccgaacagctgcacaaggatgccagcgatgcacttatcggcgcccacgacacgcagaccaagctgctttcgcaggaggccggcggtggcgagatggagatgaccttcatcatggctcacgctcaggacactctcatgaccactatgatcctggagaagcaggcccgctttaccatcgatgcctacaagcgcatcgccgagctcgaggccaagctcgcctaacgagccctcacaaccaagtccccttccaaaagctctgccgctacccgcggcagggctttttctgtcctcctccaagttgcggtgaaatagggactgaataggggccgacgggcgcaaaacaatccctattccaccgcaactcatccggagatagtcattggggacagtcttggtgcgctctgttcgtcttcccgttcgttttttgctcggtgggtatacttcctttcgcattaagccccggactgaggaggtatccaaatgccggataacgggtcaatacaaaaaagagacgcgcacgagatggctcatgggcgtcctgtccagataaccgagcacacgacggtaaccgagctgcagcccagtctgtccgatgtcgtgtgcgcaaacaaaaagctgcagattggctttatcgttgcgctcgtggtactggcgctgctgtcgggctttgtagctcgtccgcatttcgccgataccaagacttgggactccaccatcgaggtcatcgatcaaaagaagggcaatgttttggcgctcacgacctcgtgcgtcgccctatctgcgggtatcactgcgctgccgggcgatacgggaacgccggttgccgagcagctcgcgcagctttcgggtaacttgggcatcgtgcttgccgtgctctacctcgagaaatacctgctgaccattttgtggtcggttggcctgggcatcctgatcccgtttgcgctggtgctccttgcggtgtcgctcggcattcacgggcgctggagcacgagcgccgtcctgcgccgcgtggcgactcgcgtgctggtggtcgccacgatcggcatggcgttggtgcctgcaagcgtatgggtgtcgcaaaaggtcgacgaaacgtatcgagtgagcatcgaagcggccgagcaaaaggcggccgacgctgcgggtacggcaaatagtgatagctccaaagcaagcaagaaaaagaccgagtccacagagtccaagaacgtgcttgagcagcttgccgacggtgcctcaagcctggtcacgtcggtaaccagtggtgccaagcagatgaccgacgagatcgtgcagcaggtgaccgaccttatcgaaggcgtcatcgtgatgatcgtgacctcgtgcgtgattccattgctggtgctcgcggcgtttttgtggctggggcacaccctgctggggattgatatttccggcccggcgaactatttgacgggtcgctttctgagcgctccgtccaagcacgccaaaaagggcgggcagtccgagtagctaaaacagctgtatataccggggaataccgccgaagggcggccgagacacgttctcggccgcccttttgtttgttgaatacgtggcagggtgggctttccccgattccaaacggtcagcaatcatccgcgaacggtatttgttcaaaaaagaacaaagacaaacaaataattcttgcagttgatgttcgaatgtgttcaaataaacatgaacagtgaagaaccgcacattcagatgcccggacctgaacgcgattcaacacttccaaacagaaactacgcacctgcgtatctctcaaggaggatgtcatgagggttgtaatcgcttccgatgccgacggtatgtcgatgaaggagtccatcaaggagatgctcatcgccgacggtcacgaggtcgtcgactattccgagacccctgccgcggactttgtcgattccgcgaccgccgttgccaaggacctgctggagcacaaggattcccagggcttcgcattcgataagtacggcgtcggctcctatatggccgccgtcaagatcaagggcatggtcgtcgccaacatttccgacgagcgttccgcttacatgacccgcgagcacaacggctcgcgcatggtcaccatgggcccgggcgttgtgggcaccgaggtcgccaagaagatcgcccgcgagttcctgcgtgcccagtacgccggcggccgtcaccagatccgtgtcgacatgctcaacaagatggcctaacgagagccaccgagaactcgaacttctacctcaacttgtgaattcagacgaaaggacgttctgatgaagaagaccatcgcaatcggttgcgaccatatcgttacggacgagaagatctatctggccgaccgcctggagcaggctggctacaaggtgctcgactgcggcacctacagccacacccgtacgcactatcccatctacggtaaggccgtgggcgaggctgtcgccagcggcaaggccgattttggcgtggccctgtgcggcaccggcatcggcatcaccaacgccgtcaacaaggttcccggcgcccgctgcgccctggtccgcgatatgacctctgccctgtatgcccgtcgcgagctcaacgccaacatcgtgggctttggcggcaagatcaccggcgagttcctgatggccgatatcatgcttgccttcctggaggagccctacgagaagacccccgagcacgatgccctgatcgccaagatcgatgcctgcaataaggccgatgccgaggctcaggctgacccgcacttctttgacgagttcctcgagaagtgggaccgcggcgaataccacgattagcgggtatccggcgtaattaactagtccgttgacggctcgcgtttctgtgagggggcgcgagccggttttctatcagccctattgacttggcgggctgtcgtaagaaagggaaggctcctatggagtttgttcttgataacggttctgttcgcgtggtactgagcacggctggcggatcgttcacttcgattaaagccaacggtcgcgagtacctgtggcagggcgatccttcggtctggtcgggccaggcacccatttgcttcccgatctgcggcggccttcgtgatggtcacgcaatgaccatgggcggccgcgaggtaaagttcgcccgccacggctttgcgcgcaaacaggagtggaagctcgaggagcagagcgacaacatggttgcgctgagtctaagctctgccgaccatgccgagttgctcgagcagtacccgtatccgtttaagatcgttgctcgttacacgatcgatgcggagaaggtggccgtgtcgtacgaggtgaccaatgagggcaccgaggacatgccgttctttgtgggcggtcaccctggctttaagtgcccgcttgacgagggcgagtcctatgacgactacgagctccgttttgagcagcgcgaggccgccgagctctgtactgccgttccctcgacgggcctgattgatgttgagcatcgcagcaagaacccgatggttggccatgacctgccgctgacccacgaactctttgacttcgcggagaccatctttgacgtgctcgagagccgcgtggttacgctgaccaagaagaccgaggacaagggcgtgcgactgacgttccccgatatgccgtacctgattgtgtggagcaagcccgagggtgactttgtggccgtggaaccgtggggcggcctgtccacctgctccgacgaggacgatatcctggagcacaagcgcggctgcctggtggccaagccgggggagaccgttacccgcggctttgagatcgagatcctttaacgagctatcgtatgtttggggccgcgcgtgtcgtgccccggaaacaggagttcaatatgattctgaccgttaccatgaacccgtcgattgatacgcgctatcagctcgacaagctgatcatcgacgatgtaaaccgcgtgacgcccgaaaagaccgctggcggcaagggccttaacgtgagccgtgtgctgctgcagttgggcgacgatgtgctcgcgaccggtctgctcggcggccacatgggtgcctatatggccgagcttatggatgccgacggcgtcaagaacgactttgtgcccatcgccggtgagacgcgcatttgcctgaatattctgcacgagggtaatcagaccgagcttttggagagcggcccgcagatcgccccggccgagctcgaggcctttacggcaaaattcgccgagcttgcagcaaaggcggacgttgtgacgctttcgggctcgctgccgcgtggtgtcgatgccggctactatgccgagctcgtcaagattgccgaggaggcgggcgccaaggtgctgctcgacacctcgggtgcatcgctggaggccgcgctggagtccgacgctaagcctgagctcgtaaagcccaacctgaccgagattaacggcctgctgggtacgtcctttacgaccgatgatgtcgatgccctgcgcgaggcgcttgccgccgatgaccgttttgccggtatcccctgggttgtcgtttcgatgggcgctgccggttcggtgggcttccatgagggccgcgcgttccgcgccaagacgcccgcgattgcggctgtgaacgcgacgggttccggtgactcgaccattgccggttttgcgcatgccattgctgctggtgccgacgacgtcacggtgctcaagaccgccaatacctgcggcaagctcaacgccatggatcccaagaccggccacctggtcatggaccgctgggacgaggtctacaacagcgttgtcgtgactgaactgtagggttacgcggttttaccaaaccgcgtaacggcgcgacgctgcaaacgcccctaagcggcaatctgacgttcaatcgtcgggcatgaccaaaaggtcaatgccctcctctttcacgtcaccttgctcgcttaggggcgttttcgctgtcgttgccaagacaccggcgttgccttggtcgcaaatagtcattggggacgctctttaatgactagtcgtttaagaacgccccttaagaatgaccccaatgactacactcaaaaacggcgcccgtcggtgatgttgccggcgggcgccgttgtcttgaagacgaaatgatctgttttcctccgtccccaagggaccattacagtgagtcgataaagcgctgttgggcggcgcggccggcttcgtcccacttaaagacgccggcgttgtcgagcacgtggccaaacaccacgccgacctcctcgtgcaggatatcgatggcgttgtcggccgtaagctcgttggcgcggcgggcatagacatcctcggcccatgcggcgtggctgcggcatagatcatcgccctcgagtgcaccggcaaggtcgtagctggcatcggccttggctgccagcagatgctcgcggacagcgccaagctcgggaaccaggcgcggcggcagaattgccaggcccatgacctcgatcaggccgatgttctcctttttaatgtggtggtactcggcatgcgggtggaatacgcccagcggatgctcgtcggtcgtgatattgcagcgaagcgccaggtaggcctcgtagatttcgccgccggcgttgccgcgggagtcgacgcggcggatgacgggcgttacggtgttgtgcgctacgccgtcggctgtgtgtgcgataacgcccacggactcgtcggtccactcgcgccaggcgaggataatcttctcggcagcatcgagcagctgggtgcggtcgtgcgagcgcagtcgcagcaccgaaagcggccactgcaacacggtgccgctgacctggtcaaagccgggcacgctaaactgcgagacctcggcggcatgcatcatggggaactcgtgcgcgccgccctggaagtggtcgtgcgacagaatcgagccgcccacgatgggcaggtcggcgttggagccaataaagtagtgcgggaacaggtccacaaaatcgagcaggcaggtcagccccttgcggtcgacgtgcatcgggcgatgctcggagctcatagcaatgcagtgctcgttaaagtatgcgtacgggctgtactggaagccccagcgctcgtcgttgagctgaatggggataacgcgtaggttctggcgggcgggatgggcgccgccgtcggctgcggcggagcgtccgggatagccctcgttctcgatgcacagctggcaggcgggatacttctcgcccgtgttctttgcggcgccggctgcggcaatgtcgcgcgggtccttctcgggcttcgacaggttgatggtgatctccaggtcgccccagttggtgggggtgcgccatttgatgttgcgcgcgatggcggcacggcgcacgtagccggcgtcgcagcacagaccgtagaaccagtcggtcgcggcgcggggctcgttgacgcccatgcggccgttgaactcctcgtttacaaccgaaggcctcggcatgagcgcgcccatgatgcgcatggcgatgcggtcgcggcccgacaccgtgtcttcggcagcaccgttggcaacggcggcctcggaaagcgcggcgagcgtgccctccaggtcaaaatcgggcagggtatcggggtgcaagagcgaaatcttctcggtcttgagcgcccaggccatgttgagcgcggggcccgtggcgccgatgcactccagaatggtgttgtaggcccagatgcggtcgtcctgtccgatcatcgatcggtggatagcgtactcgatcaggttctgcgcagcctcgcgcgcgtcggtcattacagccatgccgcgtaagcccccttgtcagagatagcgtagtgacgggcagagccctcgcccagccagctgttcatcttggtgataaaggtgtcgaccagatcgagtggcacaaaggcctggatggtgccaccaaagccgccgccgtggatacggacggcgccgcggccgtcgagcacgtgctcggccagtgccagggcatacatcgagggctgctcggagcccagcttggcaacgacattctgcaggtacatggcagagctggcgccggactcgcgtgtcaggaccaggaactggtcgatgtcgccggcgttcagggctgcccagcgcttgtcgaccaggccgttctcgtaccagtagtgaacggcgcgcaggcaggcacggtcgcccagcttagcacgcagctcggggagcttggcgtcaaaatcggcaacgtttacctcgcacaggcgtgccttgccaaactcggcggcgacgtcttgcatttcgcgcggaacggcggcgtagtcgtcggtagcggccacgtggtcggcgccgaccttgacgagcacgagcgcgtagccgtgatcctcaaagttgagctcgagcttctgggtcttaggctgggcctgatcctcaaagtccatgtaggcgaggccgcccaagcaaacggcggcctggtccatcaggccgcagggcttgccgtagtagttgttctcggtgcgctggctcatctgggcgagtgcgacgggctcaatggcgggcgctccccagagcgtctccatggcacgaccgtatgccgcctcgacggcagcggagctcgaaagaccgccgcccgaggggacggagcaggtgaaggcgaagtcgaagccctggggctcaacgccaagggctgcaatctcatgggccatgccgcggacgaggcttgcggacgtgcccttctcggactcttgaatatccagcgtgtcgagcgtgatctcaaaggtggggtagccctcatcggcaacgcggaccttgttggtgtcggtcgctacggcgatgccgtcaacggcgacatcgagcgagccggcgatgacgtggccgccctcgtggtcggtgtggttgccactgatctcggaacggccgggcgcgtgcacatagagcacctggcgatcgccgacggtgccaaactcctcctcaaacagcttggtgagcgtggcgagtgtcttttcgtcgggggtggtcatggggggtcctttccttgacgcgggagagactggtccgtgtcattatgagtacgttaacaattttgagcaccacaaaccagacggtcgcggtgccgcacgttaatgggtatgttaacgtactcataacacaacgcatatctatttttgagaatctggtaatcggtagattttcggccgtgaacggtgtggctgtatggacatatggagcaaaagaaccgccgatagaaaaagtagagtacgttaacatgcgtccgacgatagcgggcctcggcgcgggatgtatttctgcccgggccggcattcacgctattcagatctcgcaagagtgaaggtgatcctgtggcaaggcgcccgtccaacgataccagttcgcgtccggtctccatggccgacgtcgcccgcgctgccggcgtttcgcagcagacggtctcgcgcgttgccaacggcttgcccaatgtgaacgagcagacgcgccagcgcgtacaggccgcgatgcaagagctcggctttcgtccgagttatgccggtcgctcgctgcgcgacggccgttaccattcggtcggcctgtgcgtcaacgatgtgaccaagttcggcaacctctcaatgatcgacggcatcgccagcgctgctcgcgagcataattgcgccatcacgctggtcgagatgtccaagaccgaagagttttcgcttgccgaggccacgcgtcgtatggccgcattgccggtggacggcatcatcatcggtatgagtcgcatggcgcccgattttgagacgtttgatccactgccgggcattggcacggtcatcgttaccatgtacgcgcacccgcaggtgaccacggtcgattccgaccattacggctgctcgctattgcttatggatcacctgtttgagctagggcacgagcagattcgctatattggcggcccgtcattctcggtcgacgagcaatttcgtcgcgccggttggcaggatgcactcgagcgtaaacacatcgagccggcagagccgctcgagggcgactggtctgccaacagcggctacgaggccggcaggtacctggccgagcacgatcgcaccatgacggcgatttacgcggcaaacgaccagatggcaaatggcgcgattgcagcgctgcgcgatagcggtctgcgcgtgcccgaggacgtgagcgtggtgggcgtcgacgattcgctcgatgattttgtggcacacaacgagctcacgaccgttcgattcgatttgcatcagcgtggacgcgaggtgttcgagcacgcggttcccaaggcgggggcaacggacaaaaccgttgccattcgtattcccggccagcttatcgttcgacataccacggcagctccgcgcacatagtttttgcaggtcaatggcgatatattccgcctcaataacaatcgataaggatgctggcagatagccgtggctatgaaggcgagtgttatgatagacgggttcttttgtctatctaggaggctttgcctgatggagatcaccaaggatatccgctacatcggtgtcgacgatcacgacattgacctgttcgagggccagtacgacgtgtccgagaacggcatggcatacaacagctatgttatcttgggcgataaaatcgctgtcgccgattcggttgacgctggctttgttgacgagtggctcggcaacctcgaggccgtgctcgatggccgtacgcccgactacctggttgtccatcacatggagcccgatcactccgccggtatcgccgcctttatggagcgctatccccaggcacagattgtggccagcatgggcgccttccgcatgatggtcaactactttggcaccgactaccccgagcgcaagatggtcgtcaaagagggcgacgtgctcgacctgggtggccacagcctgacctttatcggcgcccccaacgtgcactggcccgaggtactgttctcttacgaggcaaccgacaaggtgctctttagcgccgacggctttggcaagttcggcgccaacgacatcgaggaccccgaggggtgggcttgcgaagctcgccgctactactttggcatcgtcggtaagttcggcaagttcgtgcaggccgtgctcaagaaggccgccgacctggacattcagatcatctgtccgctccacggccccgtgctgaccgagaacctgggctactacctcgacacctataacacctggtcgagctatcagcccgaggacgagggcatcacgatcgcctatgcgagcgtgtatggccatctgaaggctgccgtcgaggagctcgccgcagcgcttgaggctcgcggccagaaggtctccgtctttgacctggctcgcgacgacatggccgaggccgttgaggatgcgttccgctacgaccgtctggtgctcgcttccatcacctatcagggtgagatcttcccgttcatgagcacctttatccatacgcttgccgagcacgcctatcagaaccgtacggtggcactcgtcgaggccggctcctgggcgcccaccgctgccaaggttatggccaaggagctcgagggcatgaaggacatcaccctggcgcagaacaaggtgaccgtgctgggctcgctcaacgacgcctcgcgcgctcagatcgaggtcctcgccgacgagctttccaagtagcgacacgtttacttttgacgctcaaccaccacaaaggggacaggcacctttgtggtggtttttatttagttggcggcgatgatgagtgctggacgtgcgccgtcggcggtcttggcgattgaggtggcgacggcgccttcggggtctcggtccatcacgatggcgtcgacatcggtcagctcggcaaaacggtacatgccgcgtccgttgaccttactggcgtccatgagggcgacgctttgatgggctgcggcgatcatagccgttttggtctcggccatctgcggaaagtcggtcgtaaagccgcagccgggaacaaaagcgccagggcacatgacggccagatcggcatggaccatttggagcgcctgcatggtaagtggaccgtacagataacgatggcctttgcgcagcgccccgcccagcatgacgacatcgaccgagggcatgctctcgtcgatataatcggcgatggtaatgtcggccgtgataacggtgatgccgttgcgctgatcgaggagccggacgaactcgagcgccgtggtgcccgagtcaacgagcagcgtgtcgccgtcattgacgagctcgatggcgctttgcgcgatggcctgcttggcggcgacgttgacattgatgcggcgatcctgcgtggagacggtcaggcgtttgtggagcgatacggcgccgccatgcgtgcggcgcagcttgccagactcggcgagtgcgttcaggtcggcgcgagcggtgacagaggacacgccaaaggtttgggcaatttctgctacctgcaccgaggcgttgtgctcgagcatttccatgatggcggcacgacgctcatcggcgaaagcgcggtttgttgcgtgggtcattgctgctccatcctgaaccgaaatttgcaggaattatgttgaaactattttcgttcattttcttttttagtaagaaaacgcctttcgattacttatcttttctataaaagaaagacgctgaacgcccaaaattcaatatcgaacacgcccgcccagccccaattccttccgtttacttttcaaaaacgactgtattgacctgcatgggctcaatatctcgcacatgcaaagacgctgaatttcatacaatgagcgcagtaaaacgcaaggtaaaacgctttgcgaacaactacgcccgatgtccagatgcgggcgagggagaggagcaaacgctcatggcacttgttaccaccgaaaagatgctcaaggacgctcaggccggccattacgccgttggcgcgttcaacgtcgagaacctcgagtttgttatggccgttctggccgctgccgaggagaccaagtcccccgtcatcatgcagaccaccccgggcaccatcaagtccgctggtctggactacttctacggcatggtcaaggctgctgccgagcgcgcttccgtgcccgtcgctctgcacctcgatcacggcgatggctatgaccgctgcatgcaggctttccgcaccggctatacctctgtcatgatcgacggttcgcacgagtccttcgaggacaacatcgccctgaccaagtccgtcgccgacgctggccgcgccatgggcgtgcccgtcgaggccgagctcggtaaggttggcggcaaggaggacgacggtcccgcggttgagggcgagagcccctacaccgatccggccgaggccaaggagttcgtcgagcgtaccggctgcacctcgctggctattggcgttggcaccagccacggtgtgtacacgagcgatccgcacatcgagcagtccgtggtcaaggccatccgcgacgccgtcgacgtgccgctggttctgcacggcacctccggtgtgcccgatgagcaggttgccgaggctgtgaagaacggcatctgcaaggttaactacgccaccgagctgcgtcaggcctacaccaagggcttcatggcctacatggccgagaaccccgcctgcttcgaccccaagaagccggctaaggagggtatgcgtgagatcaccgagctggttaagatccgcatgaccaacctcaactctgtgggcaaagcagagtaacagcaagggtactccgactcgctatatatcccggggagggacgagggcttagttccccaatcgtcctcgggcatgcaaaaagcctcgctgcgcacttcgtgcggcgaggctttttgccccctgcggaaagattggggaactaagccctcgtccctcccaggttgacctactcgaggtcgtcgcccttgtggcgttggggcggaaaggggtggggcgcgaggggcgctttgttgatgaggggctagtatgcccgggcttggttggggaaggttttgtctagggatgcttggagcttttcgaacgatgcttgcaagttgtggctctggtcggttgagcgtttggcttttgtggtgggggagtcgaggaggccgtttctctgtgtcggggggaaggagaaaaggtctgcatgttttagggatggctgccgtgctacggcattggaagaatgcatgcttatgcggcctcctcgatgtccaccaaaaggttgcgcatggggtgtgctgctaggtcccgtgcgctggcagtattatgccgcggctgctgcaaagaagcgctaaagaaaggcttaacctggtttggttttacgatgaaactgcaggtcagaagtatcgagtaacactcttgaaaggttttgagcttaaggactttctaaggtttgtggtgcggatgtggctcgcctgtgcggggcgtgtggatggctcgttcctagcgctgcggctctgcggtgcgcacctgctcgatgaccttttccatcgtggcgtcgatgcggtcctttttgagctcacattcccagatggttatgggtgtccagcccatttgagtgagtgctgccacggcagcgcggtcgcgctcgacgttgcggcggaactttgcctcccaaaactcaacattgcgcttgggctgacttgggttgcatttggggcagcgatgccaaaagcagccgttgacgaagatggcgatcttgcgcccgggaaaggcgatgtcgggttttccgggcaccttccattccagacggtatcccgtaaggcctgcggcgcgcaggcgctggcgaacgagcagctcaggtttggtgttcgcacgcttgttgcccttcatggacttttttatagcggcgcgacggcgcacgagctcacgctcgtcggcagaaaggtccgaggtatcgatgccgtccagcaggccgggcttggggcgctttttgctacggcgcttaggtgcgcgcttgggtttggcggcgggtttgtcggctgtgttgggcgcggcgtcatcggcggagcttgcctcgagccgatcttccttcaactcaatcagagcatcgataagccccttatcggcgggcatccattccaccgtggcaagcgaagtgcgcggaatccagcggatatcgagctggcggtcgtgcttctggggctcatcggatttatcagcgagcgagcagtagtagcactccatggagagatgaaaatcggggtagtcatactcaacggtatagaaatcgcgcaggttggtgacttttacctgcagctcttccatgagctcgcggcgcacggcgtcctcgggcgtctcgccgcgcatgagcttgccacctgggaactcccaaagtccctgcatgtcgccatagccgcgctgcacggccagtagctcgtcggatccttccttgcgaatgatcccagcggcaacatgaacagtcttcaacaggagtcctctctcaacatcaacacgtgacaggctagctacccgtaccttacacaacggtaaggcaagcgtaagccatatcgatggtagccgactcgtcttcttgcgactatagatgccgtagactaattgcaagaaaggactcggtatgcaaaccacgcacatggcgaccccggtactggaggtcgcgcatctcgaaaaggtatatggagcgctgggcaacgtgacccgcgcgctcaacgacgtcagctttaccgtcaaccgcgccgaattcgttggcatcatgggcgcctcgggctcgggcaagtcgacgttgctcaactgcgtctcgaccatcgatagcgccacgagcggcaccatccgcatcaacggccaggacgtgacgcgtatgaagcaggctaagctttcgcagttccgccgcgaggagctcggctttatcttccaggactccaacctgctcgatacgctcacggcacgcgagaacatcgccctgccgctcaccatcgcccgcacaaactcggcagagatctcaacccgcgtgcaggatgtagccgcgcgtctgtctatcagtcaggttctcgacaagtatccctaccagatgtccggcggtcagcagcagcgcgttgccgcggctcgcgcgctcgtcaccgaccccaccatgattatggccgacgagcccaccggcgccctcgattccaagagcgctcgcctgctgctcgagagcctggaggccctcaatcgccgcctgcgcgccaccgtgctcatggtcacgcacgacagctttgccgccagctacacgagccgtgtgctgtttatccgcgacggcaagatcttcaccgagctgcgccgcggcgacaccgaccgccgagagttcttcgaccgcattatggaggtcgttgccatgatgggcggtgagggctccgatgctctgtaaactcgcttggggcaacgtccgccgcgccggtcgcgactaccttgtctaccttttgacgctcaccctgggcgtcacggtcttctatgcttttaacaccatctcgatgcaggtcgacatcgccggaatcgatgaagagggcttggcgcaggtaatgggcagcatgctcggcgacctgacgtactttttggccggtgtcatggcctttttgatggtgtatgccaataacttcatcatgaaacgccgcaagaaggagtttggcctgtaccaggtgctcggcatggggcgtgggcgcgtcgccacgatcatggcgctcgagaccgtgatagtgtcggtcgtggcctttgtcgccggcattgtgctgggtgtgggactctcccagctcatgacgttctttacggcctcgctctttaagacacagatcgccaatttccacttctttttctcggtgcatgcgttcaatctgacccttgcctgcatgctcgtaatgttcgtgctcacgctactgttgaaccttcgcgccgtgcgtcgtaccaaactcatcgagcttatgggtgccgagcgtcgcaacgagagcatcaagacacgcaacccctggatctcgattgccatctttaccgtgggcgtggcgcttgtgggcgtggcctattaccgtctgctacgtgatgggttcccgctaaccgcgacggacagcaagctgcaagaggccatgacccagtttggtattacgaccgctatggttaccgtgggcacctttgccctgttctggggactctcgggcatgctcatcaagctgctgcagagcctgcgcggcgtgtattggcgcggcctcaacatgtttaccgtgcgccagcttgcggccaaggtcaacacggtgtgcttttcgatgggcgtcatcgcgatgctcctgtttttggccatcacctcggtgacgtgcggtatgtcgattgccaacgtgatgaacgagaatctggagcgctataatccggccgacatgtcgcagaggtatgtctattacacgcccgatacgctcgacttctacaaagagtctttcaatccgtctgaggccgatcgaatggtgctggccgatagtacggtcgatttgtactccgcatggcacggcgatccatggcacggcgatcgtaagggcaagtcggcggacaacaacgacgagaccggcaagaaggtcaatattgccgatgttgccggtgagcatgtgcagatcgattcgtatctgagttacccgcttggcggttcggatccttcggtgactccaagtgaaatgtgcaaggccatgggcgaaaagcttcccaaggcgttcgggggtagcaatgccgatacgatgggtctgtttgtgacgccggcgagccagtacaacaaactgcgtcagatgatgggcgaggagccggtgcacatcggtcacgaccagtatctgctcacgtgtgatatgggcggcgagctggtcgacctgtacaccaagtatatggctggcggccatgcccttaccttgggcgggcatacgctcaagcccgcaaccgataagtcggacgaagatacggcggccatcgccaactcggcgatgggcagtaatccgggtaccgtcgtcgttgccgacgagctgttgtcccagcttaatctgcagccgtattccagtagcctgctcgttaactacaaacaggggatggatacaaccgaggcagacgagagcattaaatacactgtgctcgacaatctgctcgttgacggcaaggagtcggggtcgtggggaaccttcatcacacgctccgagatgtacacgcaagcagcgcaaatgaacggtcttattagctacctagccatttacatcggctttgtattggtcgttgcatgcgcggcgattctgtcgatccagcaactctccaacgtggccgacggcagccgcagctatcgtgtgctggcacagatcggctgtgacgaccgccagattcgccattcggtgatggcgcagcaagcggtattcttcctgttcccgctggcagtgggcctggcgcactcctttgtggcacttaaggtgatcatcgagctggtgagcatattcggaaatatgagcatcggtggcaccgtgggcctcacctgtgcaatcttcctggcagcctacggcggctacttcctggtgacctacctcatgagcaccggcatggtgcgagccgccatcgccacccgctacagcgagtaactcgttcagcttggaattatcgtaggttgaccataggtcagcgaaaacgcccctaagcgagcaaggtgacgtgaaagaggagggaagcgtacttcggtacgcgaccgacgattgaacgtcagattgccgcttaggggcgtttgcagcgtcgagccgttacgcggtttggtaaaaccgcgtaacttcatcgtagaagcacgcttgcgggcggcggatgctcgtctcctgtcgcccgctcaccgaggcccggcaattgccttaatatcttaaggacctcgatttgtccaagactgagcgaaggagctcatcatgagcgacggaaagaaaaagctttccttcttgacggtcatctcgaccatcatctgcgtcgtcttcgtttgcgaggccgccgcacctgctgctgccattggcaaccagcagttcttctggtggatcttcctgattctgaccttcctgctcccttatggcatggtcgttgccgagctcggcactacctatgacggtgagggtggcatttacgactgggtacgcgatggcctgggcgacaagtggggcgcccgcatttcgtactactactgggttaactacccgctgtggattgcctcgctggccactatgttcccggacattttgggcatggtctttggcgtcgagttcaatctgattgccaagattggtatcgaccttgcctttgtgtggatcgtctatcttatgggtcgctccaaggctgccgactccgagtgggtcctgaacggcggcgccatcatcaaggttgccgttgccgttatcgtcggcgctttgggcatctggtacgccatggagaacggctttgcgaacgatatgtccgctgccaccttcttgcccgagctcaccaacaccaacgcgcttggctacctgtcgatcatcatctttaacttcatgggcttcgaggtcatctgcaccatgaccgacgatatggccgatcccgctcgcgatatccccaaggctatcatcgtcggcggcctgtccatcgccgtgatctacttgttcgctggctttggcatcggcgctgctgtgtcggccgattccatcgatcccgactacggcatgatctacgctgtccagactattgtgggcgattccatgatctttaaggtcatctgcatcgccttcctgatcacgctgttcgccaacatggctgcctggtccttcggcgtcaactccgtcgctcgctatgctgccgagcatggcaacatgcccaaggtcttcgcctcgatgatctcggatgacgacatgcccaacggcgccaacctggtcaacgccatcgttgcctccctggtgctgtgcctgcagctggttcccatcgacgccatctccaacggtgtcttctggatgctcttcggtacctccgttgtcttcctgctgctgacctacatcccgatgttcccggcattcctcaaccttcgtaagaacgaccccaaccgtgagcgtatctttacgttcccgtttaagggcgccatgatgaaggtcatgctggctattccctgcattgagctgattctggctatcgttgcaacgctgattccgttctctgtcgatgagattggcgataaggtcccgatgatcgtcatcttcatcgtgctcttgcttattggcgaggttgtccgcgtcgtcagtgctaagggccgcgagaccgagtacaagggtctcactcccgagctggctgctcagcgcctcgctgaggagtccgaggaggactagagcacccggattcggggctccaaccttcctcgcgtaccaacgtacgcttcgtcgggcttgtcgctcccgactcgggacgctctagcctcttcggaggcgtgcccaagcaacaggtttgctaacctttctctgaggtgggtgtgagctattgctccggtaaccaccgcccgccccaatctctcttccgtatccttcgtgcgttttgtctccgcgcaccgggttacgtcgtcgcttgccggtgcgacatccgtgaaaaccggtgccaggcgccccgacctttgccggggaatgggcgcctaccatctcttggttttaggctgagggtaacccgcccgcagcaagcgatcgttcgatttggaggaaatcttatgcgtacgatcaccgagtccgagtccacccctaaggccgacggcttctttatgcccgctgagttcgctccgcaggatcgcgtgtggatgggttggccccaccgcaccgacacctgggcccacggcgccaagccggctcagaagcagtatgccgccatcgctcgcgccatcgccgagttcaccccggtcaccatgtgcgcaaaccaggccgactacgccaactgcaaggccgcctttgaggaagacgagaacgtcaccgttatcgagatgaccaccgacgacgcttggttccgcgacaccgctgccacttttgttatcaatggcaagggcgataagcgcgccaaccactggcacttcaacgcctacggcggcctcgtcgacggcctctatttcccgtgggacaaggacgagcagattgcccttaagatggctgagctttccggctgccgtcgctatcgtcccgatgacatgatcctcgagggcggctccattaccgtcgacggcgaaggcaccgtggtcgtgaccgaccagtgcctgctttccccgggccgcacctgctctgcggttctggaggaggaagaggatcccgagtccatctggcccaagttccacaagaagtttgagccctggagtgaggaacttcgcgcctatatggacgagcacctcaaggattacctgggtgtcgagaaggtcatctgggttaaggagggcatcgaccccgaggagaccaacggccacatcgatgatgtcgctacgttcatcgctccgggcgtcatggcctgcatctggaccgacgatcccgagtatccgttctacgagcaatgccatgctgtctacgagaccctttccaacgccgttgacgccaagggccgcaagatgaaggtctacaagctctgcatgcctgtgaacccgctgttcatggaccaggcttcctgcgacaccatcgacgccgacgagaacgccgagccgcgcgttgccaacgagccgctgatcgcctcctacatgaactacctggtcaccaaccacggcgttatcgtcccgcagtacggcgacgagaacgatcagcttgccgttgacacgctccagaagatctacgacgaggtctggggcgagggcgtctacaagtgcgtcggcgttcagtccgagcaggtcgtcttcggtggcggaaatatccactgcattacgcagcaggagccctcggcgtaactgtctgtcttcccgaggcacggcaccttgcccttcaatcgtcgggcatgacccttaaggtctatgccctcctctttcgcgggaatctgccgcacctcggaaacccagccgatcaatcggaccgacgtagctagctatcgcattagtcattggtgccaaccctggcaacaatgcaggtcgaaaaacgtcagcgaaaacccgccagagcgagcaaggtgccttgaaacgaggcggcattgatcttttgatcatgccgccgaagttgaaaggcagattgccgttctggcgggtttgcagcgtcgagccgttacgcggtttggtaaaaccgcgtagctaaatacgttccgcgatctcgtggatgaggtagtcggtcttttcccagcccaggcacgggtcggtgatcgacttgccaaagacgccgccgtcgaccggctggttgccgtcctccaggtaggactcgatcataaagcccttgaccagcttggagatggattcgttgcggcggcagctgtcgagcacctccttgcaaatgcgatactgctccagcggacgcttgcccgagttgtcatggttgcagtcgatgaccgctgccggattggcatagccggcatgctcggtatagcgttcggccaagcgttccaggtgttcgtagtggtagttggggtaggtgcgcccatcgagaccgatgtagccacgcataacggcgtgtgcgagcggattgccgtcgcactcgacctcccagttgcggaagatgaagctctggtgcgcctgggcggcgtaaatggagttgagcataacggtggtagagccggcagtgggattcttcatgccgacgggtaccgaaatgccgctcgacaccaggcgatgctcttggttctcgaccgagcgtgcgcccacggcaacatagctcagcaggtcaacgaggtattggtagttggacgggtagagcatctcatcggcggtaaagaagccggtctcctcgatgacgcgcaggtgcatgtggcggatggccttgacgccctcgagcaggtcgtcgggagcctcggggttggggttgtgcagaagacccttgtagccggtgcccttggtgcgcggcttattggtgtagacgcgcggaatgatgatgagcttgtccttgacctcctcggcggtcttggccagtcggttcatgtactcaagcaccgaatcctcgcggtcggcagagcacgggccgatgatgagcaccttgcgtgcgtcctcgccggtaaagactttggcgacctcggcgtcaaatgcctgctttttggcggtaagctcggcagaaagcggcatttcctcgcggatctccatggggatcggcagcctgcgtttgaattccatggccataggggcctcctcaatctatagaaagagcaataagcgtattgtcgagtgttcggcattatccgctgtcgcacgctaaagtgcaagcccttgtcaccccgaaaccgaccaaaaagggacaggtttattttggtcggttttatctgggcaaacgtcggcggatgccgggagggagcggcgccgcgcgggaccctaaggctgttgtcggttccctaggaaataccctgtgggcaaaaaatgccaaatatgagtacggttgctatcttagtatcatattgccttcgcaaaataatagacataacagcaaaatatgttcattaacgcaaacacatataagtccgctatggtgttgtttgatcaatttagggacgcgtgtaagccgtgggagcggcatttgaggcggttttggctgttactaaaaaggtaacagtactcatatttgcccttttttgcccacggggtctggaaagcgccgtcagtgaggtctcagggaaggcgtttcgaggctcgaaggacacaaaacgggggtgcaggttgtcctgcgcccccgttttcttggcattgcggttgtttgccgccggtttttacgccgcttcgtcgaactgcgagttgtacaggtcggcgtagaagccgccctgggcgagcagctcgtcgtgcgtgcccttctcgacgatgtcgccgtcgcgaatcaccaagatcacgtcggcgttgcggatcgtggacaggcggtgcgcgatgacaaagctggtgcggccctgcatcagcgcatccatggcgcgctgaataagctcctcggtacgggtatcgacgttggaagtcgcctcgtccagaatcagtgccgggcggtcggccaaaatggcacgggcgatggtcacgagctggcgctgaccctgcgacaggttggtgccctcctcgttgatcataaagtcgtagccaccggcgagcgtatgaataaagtggtcgcagcgtgcggcgcgcgcagcggcctcgacctcggcatcgctcgcgtcggggcgtccgtagcggatgttctcgcggatggtgccgttaaacagccaggtgtcctgcagcaccatggcaaactcgccgcgcagtgccgcgcggtcccagtcgcgcacatcgacgccctcgacacgcagcgagccgccgtccacgtcgtagaagcgctgcagcagcttaatgagcgtggtcttgccggcgccggtggggccgacgatggcgatggtctggccgggctgcgcctcgcagctaaagtcgtggatgatggtcttgtcgggcgtgtagccaaacttcacatggtcaaactccacgtggccggggcgcttctcagggatctgcgcgtcggccttctgctcctcctcgggtgcggccaaaaactcaaacacacgctcggtggcagctgccatcgactgcatcgtgttgctcacgttgcccagctgctgcacgggttgcgtaaagttgcgcacgtactggataaagctctggatgtcgccgggcgtggcattgccggtcagcgcgagctgcgcgcccaccacgacaacgcccacgtaacccatgttgcccaccaggctcataagcggcatcatcaggcccgacaggaactgcgaacgccagccactaataaacaggcggtcgttttgacggtcgaactcctcgattgagacctcggcgcggtcgaacacctgaatgacgttttgaccggcaaagtcctcctcgataatgccgttgacggcgcccagaacctgctgttgctcgcggaagtacggctgcgagaagtgaatcattacggtcaggataatcgcggctgccggcagcgtgagcacggtgacgccggtgagcggcaggctgatcgaaagcatcatgacgagcacgccgataatctgcgttaccgacgtgatgagctgcgtcacgctctggttgagcgactgacccagcgtatcgacgtcgttggtgatgcggctgagtacgtctcccttgctgtggccgttgaagtaactcatcggcacgacggcaatcttggcggcgatttccttgcgcatgcggtagcagatcttttgcgtgacgccggtcatgagccagccctggaccaggctgcagacagagctcgccagatacaggcagagcaaaaagccgagcgtcttggcgatccagtcaaagtcaacgtcgccggtgccgttgaccttggcgaccaggccttcgaacagcttggtcgtaacctggccgagcaccttgggtcccacaatgttaaagatgaccgagcacacggcaaaggcgacggcggcaaacacggcaatcttgtgctggccgatatagccgagcagctgcctcatggtgcccttaaagtccttggccttttcgccgcgacgcatgccgcccatgcggcccatgggtccacgctgacgggtgggcttgggaatttgggtcttggtctcgtctgccattagtgctcgcctccttccgtaacggctgcaatttcttcttgggtaagccccagctcctcggcggaaagctgcgactgtgcgatttccaggtacgccgggcagctgcgcagtagctcctcgtgcgtgccggtgcccactacgtgaccgtcgtcgagtacgatgatctggtcggcgtgcatgatggtcgcgatgcgttgtgccacgaccacgagcgcggcgtcggtgacgtttttggccagctcctcgcgcaggcgcgcgtcggtcttgtagtcaagcgcgctaaacgagtcgtcgaacaccacgacctcgggctttttggccagggcgcgggcgatggccagacgctggcgctgaccgcccgaaacattggagccaccctggctgatgggggagtcgtaaccgccctcgcgctcggcgataaagtcctcggcctgggcgatgcgcgcggcctggtgcatgtcatcgtcgcttaccatgtcgccggcaaacttgaggttgctcttgacagtgcccgagaacaggcgaccctgctgcgggatgtaaccaatgcggcggcgcagttcggaaagggtcatgtcgcgcacgtcgatgccgtcgagcgaaatgctgccgcccgtgacgtcgtacaggcgcggaatcaactgcacgagcgtggacttgcccgagcccgtggagccaatgatgccgagcatctgaccggcatgcgtggtgaagttcacgccgctgatgacgtcggcacgggcatcgggatactggaagctcacgtcgcggaaggtgagctcaccgcgcggcgcgctggccgcgggcagtttgggcgagacagggtcgttgatgctcgtggggcaggtgatgacctcttccacgcgctcggctgcgacctcggcacggggcagaatgaccgacaccatggtgaggatcataaacgccatgacgatctgcatggtgtaggagataaacgccatcatgttgccgacctgcatcacgccgtcggacacgccctgcgcgccaaaccagacgataagcacggtgatgcagttcatgacaagcatcatgagcggcatcataaagctcatggcgcggttggtgtagagctgcgtggtcatcaggtcgagcgaagccttgtcaaaacgctcgagctcatgttcctcgcggttgaacgagcggatgggcataaggccgtcgagcagctcgcgggcggtaaggttcacgcggtccacaaagctctgcatctttttgaacttgggcatggtgaggcccatgagcacgccgacaacggccgaaaccgcgatgatggccacggcgatggtccactccaggccggtgtggttggccaggacgcgcataacggcgacgatgcccatgacgggggccatcaggcacatgcggataaacagggttgcggccatctggatctgctgaatgtcgttggtgcagcgggtgatgagcgaggcctggctaaacttgcccacctcggccggcgagaagtgcattaccttgttgaaggtctcgcggcgcaggtcgcgggcgatggagcaggcggtgcgcgaagccacggcaccggtcaggatggtggcgacgagcgagatcaggcacagaccaaacatcgtggtcgccatgcggcccaggtaggcgttctgcacgtcggcggggtcgatgccctgcgccttgtactcgtcttgcacatagctcacggcgcgttgggtcacgatggagcccgacatggagcccattttatccgccatttcgttggcgccctcgacgagcttgctttggtctaccagaccgccctcgacacccaggcgcaggctcttcatggtgatcttaccgccgtcggcatcaatctgcttttgcatgttctgcgccgctgcggccttctgctgcatctcggcgagctgctcgggcgtcatcgccgccatctgctcgggggtgggcatggcctgggcggcgtcgctgtctttttcgccggacgtgccggtcatgtcgcccatggagtcggcgtcaatgccctggttgaacgaaagtacgacagtctcgggcaggctcataatgtcggcaatcttgcctccatcggcacgctcttcctcggtgcccttgtacgctcgaatgccgtttttgccagccttgctaaacacggcctccacagccttggcgtccttggcgctcataaagagttcgaggtcgtcgagcgattcggcgcgaatggtgtcgggcacgggcgaggcaataccgccttgctgcacgcccacgtcgacgatgtcgctcatataggtaggcagcgccagatcggcgttgcagctgattacgatgagtacgatagctgcgagtagtgccaggatatgctttttaaagagcttgagaatcctcactcggcatctctcctttcttgattgcggtcgataatttcgttggcacgtcttagaaggcgcaccatctcttgggtatctgtttcgccgagctgctcgaggaaggccgcggtgcggtcctcgaattcccggcgtttgatttcgatgacctggaatcccttgtcggtcaccgtgacgtgtacgcgacgacggtcggtctttgagtgctcgcgctcgacccaacccttggcctcgagggcgcgcaggatattggcgatacgggcgctcgaaacccaggcacgatcggcgagttcgctcggtgtgagtgagccgccggcgcgcatgagggcgcgcatgacggccatctcgccgccgagagctttgtccgcaaagcgcgaaattcgctgatgcatgctgccaaactcagttaagagctgacgcccaagctcatggaaatcggtatcttccatcgaaaacccctaacactagaaactatttccggtgaaagatgatacccttgcacgcgcaccctatacggtagatttttgggtcatgcctagaaaacaatctttaggcgacctccgtacaccgtcggtatcagcaaagttaggggtagatctctgggcatgtcccaaaaaaaatacctggttgctaggtaatataaagagcgtataaagaattaaaataattcaataattgtagcgtttcaaagaactattatgcacgcggttaggcgaggggttgtcaccaccatgacgactgggactcatataatcgccacgtgcgatgctccaacttcccgcgaggagacaccttatataaagggggatggagtcatggcatttgacttcacgggcaagaccgcgattgtcacgggcggcactcagggcattggcctcgagatcgccaagggcatcgtcgcgggcggcggacatgtcgcgctcatcgcaaggaacgctgctaagggcgaggccgcggtggccgagcttggcgagggcaacaagttctatcagctcgatgtcgccgatgcacccaaggcgcgcgagactgtcgagcagatttttacggacctgccgcaaaccaacatcctgatcaactgcgctggcgtcatcagcaccaagaagttcgatgagatcgatgacaccgagtggcgtcgcaccatcgacatcaacctcaacggcacctttaccatgatgaacgccgtgtacccgcactttaaggcggcccatgccggcactatcgtcaacgtgagttccgttgctggcaagatcggcggtggcctgctcggcaccgcggcctacgcgagctccaaggccggtgttaacggtctaaccaaggcagtcgccaaggaaggcggcaagtttggcgttcgctgcaacgccgtgtgcccgtcgctcacccttactgatatgacctcgattctctctgacgagaactctcagcgcatcatcaacggtattcctctgggccgcgccgcccaggccagcgagcctgcgcagatggtgctgttcttcgcttccgatctcgccagcttcgtgaacggcgagatcggtgactgcgacggcggcatcgtcctggacgggtaataccccgcgacgattattcggcgacggctcctgcgactcgggaccgtcgccttctttctgacataggcgcgtgcggctacgattcgcatgcatccaaaggagatatatatgagtgaatcgactgcggtggaggcgccggcggcaaaggagccgttctttaagatgtcctccatcccgggtgccaatattttggtgccgcttttgctgggctgcctgctcaacacgctattccctgacctgttcaaaacgctcggcagctttacgcttggcatgacccagcagggcgctggcccgctcgtgggcgcttttttgctcatcgtcggtacgacgatttcgtttaagagcgctcctgccgccgctgcccgcggcgccatcatcatcgccgtcaagcagatcgtggtcgttgccatgtcgctgctcatcctttatgtgttcaacgacaacttgtttggcatctctgccatggtgatgctggcggcttgcaccggcgccaacaacgctatgtacgctgggctgatgggtaccatgggcaacgaggctgagcgtggcgctgtcgccatcaccacgctggttgtcggccctccggtcacgatgatcgtgctcggcgctgccggccaggccccgatcggctggtcgctcgtgggcgccattctgccgatcgtcgtcggcattattctgggtaacctgttccccagctttaagaagatgatggcaccggcactttccgccatcatcgtgctcgtcttctttgccatgggctcgaccatgacttttggccagcttatcaacggcggtcttcccggcatcctgctcggcgtgatctgctcggtgatctttgcaattcccgtcatcgcggtcgataagctcacgggcggtacgggtgtcgcaggtgcggccatttcgagctgcgccggagccaatgtggccacgcctgctgccatggcaagcgtcaacgaggccatgtacggcggcgcggtgctcgcgacggccacggcacaggttgctgcctgcgcaatcgttacggctattttgaccccgctggtcaccagctggtgctacaagcattttgagggccagcagagcaacggcaaggcaacgaccgacaaggcctccgcagccgcctaatgccaaacggtaatcaaagctaaaaactagctacgccacagggcggccacgggggatcccgtggccgccctgcagtttctgtagggtctttgggacactttaccctgataaagctggcataacagctagagtgaacgtcgtacaaaggcaaggaaaaaaccaaacaaatcggtgaacggtagttgttcacgctcgcatttcctgcggatttgttaaaaatgccctaatggtataaaaaaagaaacatataacagccctgatgaagggggtggctatgttatccttctcaaacgggtgaaatcttgggttttgggttgcagttccaaggtggacaaacgtttttccctgtaccaacgtgtggtgaagaacggaagaagccggtagtgcaagccgataattcaagaattcaataagtagcggtgtgagagagcgccgcattacacgtaactaggagcgtggttacacaatgcaggaggcatgggaaggcttcaaggaaggtatctggacgggagaggttgacgtccgagacttcatccagaagaactacaccccctacgagggcgatgagtcgttcctcgtaggtccgaccgagcgtaccaaggagctgtggggcgaggttctcgacctgctgcttaaggagcgcgagcagggtggtgtcctcgatatggacaccaagaccgttacgggtatcgtgagccaccccgctggctacatcgataacgcccaccgcgagaaggagaccatcgtcggtctccagactgacaagccgctcaagcgcgcgctgcacgtcaacggtggtatccgcatcgcttgccaggctgccagccagcacggctacaaggtcgacgagaacgttgttgagcgctacacctttgagcgcaagacccacaacgccggcgtcttcgatgtttacacccccgagatgcgtgcttgccgctcggctcacatcatcaccggtctgcccgatggctatggccgcggccgcatcatcggcgactaccgtcgtgttgccctgtacggcgtcgactacctgatcaaggacaaggaggcccagaaggcttccactccgacggtcatgaccgccgacaacatccgcgaccgtgaggagctgcaggagcagatccgcgccctcggcgagctcaagatgatggccgagacctatggtttcgacatttccaaccctgctaccaacacgcaggaggccatccagtggatgtacttcgcctaccttgctgccgtcaaggagcagaacggcgccgctatgtccatcggccgtacctctacgttcatcgacatctatgctgagcgcgaccttgccaacggtaccttcaccgaggagcagatccaggagttcgtggatcacttcatcatgaagctccgcatggtcaagtttgcccgtacccccgagtaccaggccctgttcaccggcgacccgcagtgggtcaccgagtccatcggcggcatgggtgtcgacggccgtacgctcgttaccaagatgagctaccgctacctgcacacgctcgagaacatgggcaccagccccgagcccaacatgaccgttctgtggtcgacccgtctgcccgagaacttcaagaagttctgcgccaagacttctgtcgccagctcctcgatccagtacgagaacgacgacctcatgcgcgtttaccacggcgacgactacggcatcgcctgctgcgtgtcctccatgcgcatcggcaaggagatgcagttcttcggcgcccgcgccaacctggccaagtgcctgctgtatgcactcaacggcggtgttgacgaggtctccaagaagcaggtcggccccaagtatcgcgccgtcgagggcgatacgctcgattacgacgacgttgtggccaagtacaacgacatgatgaagtggctcgctggcgtgtacgtcaactcgctgaacatcattcactacatgcacgacaagtactgctacgagcgcatccagatggctctgcacgacaagcacgtgcaccgctggttcgctacgggcatcgctggcctttccgtcgtggctgactccctgtccgccatcaagtacgccaaggtccaccccgtccgtgacgagaacggcatcatcgtcgacttcgagaccgagggcgagttccccaagtacggtaacgacgacgaccgcgtcgaccagatcgctcacgacgttgtgcaccagttcatggagtacatccgcatgaacgatacctaccgcaactccgtgcctacgacctcggttctgaccattacctccaacgtcgtgtacggtaagaagaccggctccacgcccgacggccgcaaggctggccagccgttcgccccgggtgctaaccccatgcacaagcgcgatagccacggcgccatcgcttcgctgtcttcggtttccaagctcccgttccgcgatgctcaggacggcatctccaacaccttctccatcatcccgagtgcgctcggcaaggaggaccaggtgttctttggcgatatcgaccttgatcagctgggcgagtaactattgttagtgctatactaacaataacgattactgattagcgcgccggtttcggccggcgcctattaatcgaaggagacacattatgaaggtttctgaagtttccgagactcaggccgataacctggtccacatgctcgacgcttacgccgagaagggtggccaccacctgaacatcaacgtcttcaaccgtgagacgttgctcgacgctcaggctcaccccgagaagtacccgcagctgaccatccgcgtttccggctatgccgtgaacttccacacgctcaccaaggagcagcaggacgaggtcatttcgcgtaccttccacgacaagttctaaagggttcaactcctgtaggattactggggccggttttgggttatttcccaaaacgtcctcggacatgcaaagaggctccgctgcgcgcgttgcgcggcggagcctctttgcgtcctgcgggatgttttggaaaataacccaaaaccggccatgtggggtcctttggagtcaccctttaggcggaactctcctaattatttggatgagtcgtttacttacttgtactgttaccgtcttcccgctcttgttggggtatgctttgttcgtatgtaaacgtatgacatgttgatgggggagggtgctatggctcgcgagagtgctcgttctaaggatacggctaagcctggcatcaaggaagttgcggcggtggcgggggtttcgcctactacggtatctcgcgtgcttaataatcgcggctatattagccaagagacccgcgataaggtccatgccgcgatgaagcgcatcaactatacgcccaacgatatcgcccgtgccatgctcaacggtcgcctgaatcttatcggtatgatcgtcccctatgtcagcagtccgtttcatgcccaagtggttcaagtcattgagcataccctggccgaaaacggttttaagatgctgctgtgcaatagcgccaatcgacccgagcttgagcgctcttatatcgacatgcttcgacgcaatatggttgatggcgtcatcgtcaactcgcttaatatcggtgccgaggcgtatgccgagatgggtttgagtctggttggtatcgactgcgaccttggcgaggcctctgttcagattgcgagcgacagctatagtatcggcgaacttgccacgcgtcgcctgatcgatgacgggtgttcgcgcatcctgtgcctgcgcagcaatagccgcatgcgcatgcctgccaataagcgtaccgatgcctacctcgatgttgttgagcaggccggtttgcccgcgcttgtccgtgaggtcgagttcgttaagcccgacgacgaaaagagcgcggtcgttgcgaagatcctcgatgagaaccccgatattgacggcatctttgcgggagacgacacgatggcggctatctgtcttaacgtgatgaagcagcgcggcttgagcgctccgggcgatattaaggtcgtgggcgcggatggtgcccgccgcactatgacgtttatgcctgacttaacaaccgttcgccaagatatcgatcgcatcggagagctcgcggcgcaatccatcattgctcttattaacggcgaaaagcccgaatcgaatatcaagctccccgttgaactcattgagggtaaaaccgcgtagttcatcccgtgccaaaagaattcctcaaacacctctgatgaccgttcgccggcatatgtcaaccgtttgccgacgactggaactgcgaaaagacgtattggtgtgaaaacgtttgacatatgaaaacgattgacatatcttgcagttgtaccgagttagtatctcgtgagaaaggaagtctcggatgcacaaggtgtattaccagcctgagggaatttgggtaggcgacatcatgccgtacggcgaggacggcacgttctatctctatcatcagcgtgacacgcgaaaccccggacctttcggagagccgtttggctgggcactcgcgacaaccaaggacttcgtcaattacaaagactttggcgagagccttgagcgtggcggcgacgaggaagtcgaccagtatgtttatgccggcacggtgtttaaggtgggcgacaagtaccatgcgctctacactggttgcaatcgcgataaggtcaaggcacgcttgatgaagcaggttcttcttcacgcaacgagtgacgacgccgtcaagtgggagaagaacatcgccgagacgctgcttccgccccaggagggttacgatgaccgcaactggcgcgatccctttgtgctttgggatgaggagaacgaagagtacatgctcatcctcggcacgcgtgtgggcgaggacaagcgtctgatgaccggtcgtctggtcaagttcacctccaaggacctggatacctgggagttccagggcgactggtggaatccgggcctgtacaccatgttcgaaatgcctgatctctttaagatgggcgactggtggtatctggtgttctccgagtacagtgatggcaacaagacccgttaccgcatgtctcgctctatcaacggtccttggatcactcctgcggacgattccttcgatggccgcgcgtactatgccgcgcgtaccgcatttgatggcgagcgccgcgttctctttggttgggttcctacgcgtgacgagggcggcgaccccagctcttacctgtggggtggcacctttatgcctctcgagatcgttcagcgtgccgacggaacgctcggcaccaagctccctgacagcatgcttggcgcctttggcgaggctaaggcagtcgaggcctttgagctttcctgcgagtcgggcaaggtcgagcaggtgctcgccgcggatgccggttccacctatatgctcgatgccgacatcgagctcgccggtgacgctgccggcttctcggtgaagcttgccgaggacgccgagtccggtcttgcctatgagttccgcgccaacctgcgtgagggcaagctcgagtttacggcggccccccagtatccgtggttccaggtcaacaacatgggcctcgagcgtccgttgttctttaagggcgagggcactcatcatgtgcgcctggtcgttgacgacgatatcgcgaccatctttgtcgatgatgttgcgcttaacgcgcgcttctgcaataagcagggccagggtgtggcactgacggtcaccgacggtacgctcaagtgcgcaaatgcaacgatcgcgtctctgtaatggcatcaaaacgttttatgatttcgtaagggaatggagaggaacatggactacaaagtagtgtctcagcaagtcgtcgataacgtcggcggtctggagaacatcgagggcgccacgcattgcgttacgcgtctgcgtctggtgctcaaggatacgagcaagtacaacaaggccgagctcgagaacatcgatggcgtcaagggcgtgctgtacaacagcggccagctcatgatcatcttcggtaccggtaccgtcaacaaggtctacgatgagtttatggctctgacgggcgttaaggagatcagcgcttccgaggtcaagggcgccgaggcggacaagaagggcaagttcttctcggtcctcaaggtattctcggatatctttatccccatcattcccgctttcgtcggcgctgctatcatcatcggccttaagtcgctgatcgttgccaacggcctctttggcatggagggcagccttgccgaccacagcgagttcctcaagaacctcgcaagcttctttgccattatcgccaccacgtttgactacctgcctgtcctggttatgtacagcgcggtgaagcgttttggcggtaacccgattctgggcatcctcgtcggtatcgtcatggttcacccgagccttatgaaccgtaacgcgttcgttatggatccgtcgggtgctgagtactggaactttggtccgctctccatccccatggttgctttccagggcggcgtgttccctgcaatcctgactgcctggtttatggccaaggtcgaaaagattgcccagaagtacatccccgaggtcgtctcgtttgtctttgtcccgaccgttaccctgattcttgctaacgttgccctgttcaccgtgttcggcccgctcggcaacctgatcggcgacgtcctcgctggcgtaatcgatgtcctgtacaacaggatgggcgtctttggcgcctttgtctttgccgcgttcctgcagccgctcgtcgttaccggtacgcatcagttcatccagggtattgaggccaacctcgttgccacgactggcttcaactacatccaggcaatctggtcggtttccatcatcgcccagggcggtggcgccatcggcatgtacctcattcacaagaagcattccaaagagcgcaacatctgcatgtcgtcctttatcccgacgctggtcggtatctccgagcccgcaatctttgctgcaaacatgcgctactcgatcatcccgttcatctgcgcttgcatcggtgcaggctgcggcggtgccttcgtgaagctctttgaggtgcgcgccatcggtcagggtctgaccggcgtgcttggcctgctcatcgtcacgcccgagacgctcgtgtggtatgtggctggcaatctcatcgcctttatcgtgccgatcgtcttgatctttgcctacaacaaggcaaagggcgtgccgaccactgatgaagagggcgctggtgctggcttcgatgtcagcttctagttgagccgttcagcgtaatctgaggataagtccatttggggaagggcgttcgactcgtgtgagtcgagcgtccttccccatagacgagaaagtcaacggcgatgtttaatcaaaaaaataaggtgacacgcgcggactatgagcagtggcgtgccggacaggatgagacggcgggtcgcatcgcgtccgaccccgataggctcctgttccatgtggagcctgagcttggctggctcaacgaccccaacggtttggtgcagatcggtgatacgtatcacatctatcaccaatacgatccattcgatgctgcgcatggcggtccagtgatttggaatcatctgacaacaaaggattttgtgacgtacgagaatcgcggccctgtgctgttccccgattccgatttggattcgagcggagcgtattctggttctgcctttgtacacgacggcaagattcactacttctataccggcaacgtcaagcattttgaccgcgatgattacgactacgtgttgacgggccgtgagcaaaaccagattcatgtggttgccgagaaccccgacgaattgggcgagaagcgcatagctgttgggccggtcgattaccccgacgatatcggtacgcacgtgcgtgatcccaaaatccttgaacacgatggtatctactacatggttctgggcgctcgtacgaaagacgaccgcggctgcgtgcttgtctatacctcgagcgatctagaggactggagctatgcgacgcgcattgagttgggcgagaagtttggctttatgtgggagtgccccgatctgtttgagctcgatggtgagcttattctcgtttgctgtccgcagggtgtgtccgccgatggatggcgttaccgcaatccgcaccagtgcgtgtggtttcccatcgaggccgattgggaggcgccgagttttaagatcgccgggcagggcatgcccccgatggtcgatgccggctttgatttctacgcaccgcagtcttttgaggatgctgcgggtcggcgtttgatgatcgggtggtcgggttgccccgatgcgacggcaaaaagcccgacggtggcacgcgggtggcagtgcgcgttgacggtgccgagagaactgagcatgcgcgatggtaagctctgtcagcagccggtgcacgagattgagaggatgcgcggcgactgcgtttgcgcgacaggcggtgaaaccgttgaggagccgggccgcctgtttgatcttgtggtttcctgtgagggcgcccaggtgatcgagctcgaaatccgcaagggtgtctttgtgcgctatgcagacgggatgcttaccctcgacatgggtgacgaaggctatgggcgcgaccagaggtcgatcgagctcagcgagcttcgcgacctgcgcgtgctttcggacactacgatggtcgagatttttgcaaatggcggcgaggcggcacttacgagccgtacctattcgccggcggttccggcgatggggttgcatgccgagggtgcggcgtcgatggatttctaccgcctcgcgcattaaccgtgtgtggagcgcgattggacttgctgggcggaatgtgtcgcagtcgctgcagcgaactaccgttcatcgcgtatagctaccgtttgcggaataagtaacactccttaataaaccgtgtagaatctcagataagcacggagttttccagggagacgctgtcctttgttgtgtgcaaggggcggcgtctctttggcgcttggacgccgttgtgcaacagtgcggcggtgcgtgccatgtattgaaaagccaatgtcgagatgggtcgtgatattaatgggcaagtacgtaatcgtggtcgagtctgggtcggatgtgacgccggagctctgcgagcgctacggcatcgtgcgcgtgcccatgcatgtcacgattggtgacgagaccgtcgaggacggctcgatcgatccgctcgagatttattcgcgctgcaatgagtttggcgtgatgcccaagaccagtggctgcgcgcctgcggattttgctcacgtgtacgaccgcattcacgctgagcagcccgacgcgactattttgcatcttgcatattccgaggccacgacctgttcgcatcagtcctcaaagattgcggcccaggggcgcgactacgtgttctccatggacacgcgctttgtctcggtaggccagtcgcttgttgtcgtcgagaccgccaaatacatcgaggctcaccccgatgccaccgtcgacgagatcttcgccttcgcgaactccgtcatggaccgcgtgctgttgggctttgttcctacggaccttgccttccttaaggcgggcggtcgcttgtccaacgtcgcgttcctgggcgcccatctgctcaagattaagccctgcattgaggtaacgggcggcaagttcgtggcaaccaagaagttccgcggctctatgctcaagtgcgcccgcgcctttattgatcacatggttgccaagggcgagattgactactcgcacattggcctggcgtattcggtaggtctttccgaggagctgcgcgacgacatggaagtctatgcacacgatcttggctttaaggacattacctggactcaggtcggcggcgtcatctcgagccattgcggcccgaccgccttcggcgcggtgctcacgcttaaggcgtaaggcctggagtctatcgatttctattgcctcggcggtgggcgggttgcgataaccctcccgccgcttttgcgtggagtcaaataggacgacctaattgacctctaaaccgtttcgccatcatatgtatgggctagaatggctctggcatttatgtaactaaaaccaatgagaggcaaggtagcgggaatggctgagatgacgctcgagggtgtggacgctcgtcccgaggactccgcgtttgccctgggccgcgtacattcgatcgagacgatgggtacggttgacggtcccggcatccgcttcgtagtgtttgtccaaggctgtcccatgcgctgcgcgtattgccacaatcccgatacctggtcggttaacggcggcaccatggtgaccgtcgagcatctgatggacgagttccagagcaaccatgagttttaccgcagcggtggcattaccgtttcgggcggcgagccgcttctgcagcccgagtttttggccgacctgttccgtgcaatgcacaacaaccccgatggtcgtgtgcatacctgcctggatagctgtggctacgccttcgaccctcagcatcccgagaagttcgatgccgtgctcaacgagaccgacatggtactgctcgatattaagcatgccgacccggtcgagcataaaaagctgaccggttgtgatcccgcacgcatcctggcgtttggcgatgagcttgcacgtcgcaatatcaaggtcgttatccgccacgtggttgtgccgggcattaccgacacggcggaggagtgcgagaagctcggtcgcctcatcgctccatggcacaacgtggtgggcctggaaatgctgccgtatcacacgatgggtgtcgtcaagtacgagcaactgggcattccctataagctcgagggcgtgccccagatggataccgcgcgcatgcccgagctgcgcaatgccgttatggccggtatgaaaaagcgccgtgcggagctcaaaaacgctatcggatagcatgccatagccctcatatcccctcgttcccagctgagttgcggtggaatagttcttgtttttaggcccatgtcgcccaaacaggaaccatttcaccgcaacttcgttttgggtagagatgcgcaacagaatcgtgccatttggataaatacgcttgtggtttctttaaagacaccttaaacgctgctgaatatctttggaaagaaatgcctgctcggtatcatgctgctcgtatataaacggtggcagtcaggagaccacgtgcgaaacatcgcatcgcgggacgagtatgtgccgcagcatggcagcagatataagacgaagggcacgtcttcgcgtggccttgccggcgctcgcatccgcgtgaggaagattgccgctattgggatgctaacgtcggcggttattatcctcggaattaccgttaaaacctacgcctcggagcgaacggggcgcccagatgcgtcaacggtacagctgcaaaacgagaaggtttcaaagtccaaagcgtcggcagatcaagctctgtcgacggcagatctcaagacgagactttcgaaggcggacttcaacgatatcccttcgggtgataccgttcggaccttctcgttggtggataacaagactcctgccttggaggatgagagccttgcctcgctccaggatgccctgtgtcgggcgcaggagctgggcgacgtgggtgtagtgttctacgacctatcgagtggtaggggcgtgacgtataacgccgatgttgaggtgtatggagcgagcagttataaggcgctgtatgcactctatatttgcgagatgttggtcgaatcggggcaggtgtcgctcgatgggcctttagccacgtatggtggttacagcatgggctggcagacagtgcgtgaccttatcgaggccgcggtcgtcaactcggacaacgattcgtttatcgcgttacgcgcggcgtttgaccatgatggctatgaggattggattgccaatctgggtgttgatgacgaaacggcactgaatccgatgagtgattttccgacctactgcccgcgcacttctgcgaggttatggcgtgagatgagcgagtatctgagcatggataccgagacttcacagtggttgtcgggccttctggcatcaacatcgcgctcgtttattcgcgatggcattgcggacgagcaggttttggtgcgcaacaaggcaggctggattagcgaggatggttactactcgacatgcgatgcgggccttatcgacatcgatggctgtacctatgtcatgggtatcatgacatcgatgccgtggagcgaccgctcgagcgaggttacggccgcgattgcaaaggctctgtttgatacgcgagctgcactggcttagcgtgttcgtttgacgaggtcaaacaaaatgctggtaccataccgtggttgagaatttcgaataggtttggggaatggcatggctaccattgcgattatcggtgcgctcgaaaaagagatcatgcagattaaggaagagctgagcgacgtttgcgaggcacgggaggcaggcttgaccgttgtgagcggtgagctcgacggcctgacagttgtcgccacaacggcgggcatgggcacggtgaacgccgccgctgcaacacagcacctcattagcaagtatgctccgcaggctgttgtgttttcgggcattgcgggcggtttgaaccccaagctccatatcgacgacgtggtcattggcaaacgcctgcgctatctggataccgataccgcgcttatcgccgagtccgcaccggggctcgaggagtttggctcgacgcccgcgctggtcgatattgccgccgaagtgcttgctgagcgtgggtttgttgacgcttcgacaaatgcagtcgcttcgaatgagggcaccaagcagttcctggtcggcacgattgccacgggtaaccgctttgtgacgggcgccaccatgcgcaacgacgctatcgaggcgacgcatgccgattgtgtcggcatggagggcgcggcaattgcccatgtcgcaaccaaaaatggtgtcgattgcctggtgttgcgcgctatcagcgataattgtgacgaggcgtacgatgcaatttgcgagcgcgagttcgatctgttcgagtacgcgcgtgtcgcaagtgacatcacgctcgatatcgtccgccgcattgccgctgcgcaatagcgcgtctatttgtaagaacctacgaccaaggagtgtccatggccgattccattaactatcagcttgccaagttcgtcgccagctacggcaaggtttcgcagatccccgagtccacctgccccgaggtgagctttgtcggccgctccaacgtgggcaagtcgtccatcatgaacaagctctttggccgcaagaacctggtcaaggtttccagtacgccgggcaagacgagcaacatcaacttctttgaggccgatgacgtgcatttcgtggacctgccgggttacggtttcgcccgtcgctccaaggccgagcgcgaccgctgggccgagcttatcggcgactttttcgactccgagcgcagctttaacttggtcgtctcgttggtggacattcgtcacgaccccagcaagctcgaccacgacatgatcgactacctacagggcaacgagttcaactttatcgtctgcctcaccaaggccgacaaactcagccgcacccagcaggcccgccaagcagcagccatcaaaaagcagctcaacgtcccggccgagaacgtgatcatcacaagctcccagaccggtaccggcatcgacgaactcaagcgccgcatcgccgaagcctgcctctaataagtgccccagcctagcaagagcccctatcaataaaaggccatgatttcagcctggcgccccttcaaagcgtgggtccctgtagacatcgctagctacgttgccatagggccacccaggggcatccccttaaaaacattccgcagcacgaggcccgcttatccgcagctccgaaggagcaggataagtgggcctcaagtgcgaggacgtttttaaggggatgcccctgggtggcccggacagaccgatcggcgatgtctacaggtactcgatttgagcgccttccgtgtcgcacgtcagaatatgcgtatcacacttagggaactgctcgcgcagcttgacctgcaggaactttgccacgatggtgtcgtcggtcacagccatgagggtcgagcccgagccgctaatccagatggtcttagcgccgccgttaaggcaggtgtcgcgcacggcgttgtagtcgggaatcaggcggcgacgatagggctcctgaatgcggtcgtcattggcggcggcaatcaggttgaggtcaccggtctccaagccgcgcgtcataccggcgatgcggcccatctgccacacggcggtggagagcggaatctcctgcggcacgaccttgcgcgcctcgctcgtgtgtacctcgtagggcggaatcacggtaataaaacgcaggcgatcgctcacctcgtagcgcaggcactgggggagcgaatcggtcggcgtaaaggagcagacggcgccgcccaggatagcgggggcgacgttatcgggatggccctcgacctcggtggcgatgcgaaccagctcggcgcggtcgacggtgtggcctgtcagtgcggcggcggccataatgccggcgacgacgcaggtggagctggagcccaggccgcgggcgacgggcacgtcggtctggatgtcgatggcaacgggaaaagccggctcgccccaggcggccagagcatcgacaaagcttacatagaccaggttattctcgttttggaactcttcggggcagcccgtgatggtgagcttgtcggcgcgctcaaaggtaaagtgcgagtagaggctgacggccatgccgagggtatcgtagccaatgcccaagttggcgcttgttgctgggacggtgatcttgatcatgtgagtcctcctggcgtgcctggctgtttagttcgctgctcgggcagtcctgcgcaagacggaaagcacattaagtgctttcctttgcgtgcggaactcgcgacgaactaaacagccaggcacgctatgcacgttcgtcatcatcccggtaggtatctgataaaagaaggtgcgccggctttcgccggcgccttatatggggtttagttggtagccatcttttttgctgcagactctacgtagttggccatgtcggctacgtcgcagacgtcttcgaagcggacgggtttggactcgagctcggcgagctgggtcggggcgaccgtgttggtggcctgctcgagtacacgcatggcctcaaaatcatcctcgggaacgtcgaggcccagggcgtcgcagcaggcgcgtgggaacttgtaggggctggcggtcgaaagcagcacgcgggccttagcgccctcggcgggggcgacctgctcaaagacgtgatagccgcaggcggtgtgcgggtcgatcacgtagccgttggcgtcccagcagctcttgatggcggcgcggacctcgtcctcgctggcccagccgcagccaaacacgctctgaatctttgccagcaggtcggcgggaacctcatagcgaccagtctgtgccagctgctccataaggccggcaacgagctcgcagtcgccatcggacaggaagtacagcatgcgctccaggttggagctgatgaggatgtccatcgacggcgagatggtcgtgaagaacggacggttgcggtcgtagacgccggtggtcaggaagtcagccagaacgttgttcttgtcgctcgcgacgatgagcttggcaacgggcagacccatgcgcttggcgtagtagccggccaggatatcgccaaagttgccggtcggcacgcagaactccacggcattgccggcctcgatggcaccggcgcgcagcagctgcgcataggcggcaaagtagtagacgacctgcggcaccaggcgcccgacgttgatggagttggcgctcgaaagcaccgtgccggcggcttcaaggcgctcggccagctccttatcggcaaagatgcgcttgacggcgctctgggcgtcgtcgaagttgccgcggatgccgcagacggcgacgttgccgccctcctgcgtggacatctgcagattctgcacgcggctgaccttgccctcgggataaaagacggtgatgcccgtgcccggggcgtcggcaaaaccggcaagtgcggccttgccggtgtcgcccgacgtggcggtgacgatcatgatgcgctcggcgccgccgtccttggcggaagtgcgggccatcaagcgggggagcatctgcagggcgacgtccttaaaggcgctcgtggggccgccaaagagctccatcacataggtctgaggggcgtcagcgcccggcgcagcgtcgagtttgacgagcggcgtaacctcttcactcgcgaacgtgccgcggtatgcctcgtcgacacacgccgaaatttcttcggtcgtgtaatcattcagtaacactcccaacacatcttgagcgatttcaaagtacgatttatctgcaagcgagctgatatcgacctgctgggtgccgagctcgtccgagacaaacagacccccgtcgggagcgatgccggtgcggattgccaccttacttgagcacgataaagtgcgtcctcgtgtactatgataagttcccatataacactgctcctcggatgccttggtcccaatcggtgaaaccatggtatcagagcgcgcaaaataggttcgcagaggctttttagaaaggtaacctccagcccatgattaagattgccaagtttggcggctcgtcggtcgccgacgccgaacactttaagaagatcaaggccatcgtcgatgccgacccggctcgccgttttgtggtggtttccgcctgcggtcgccgctttaagggcgacaccaaggtgaccgacctgctctacctggttaacgcgcacgttaagtaccacgtgtcgtgcgaggagctgctcgaggacatcggccagcgctactttgatattgccgacgagctggagctcacctatcccatccgtgaggagttcgcggcctttgccgagcgcgcccgctcgggcggctactccaccgaggagcttgtgagccgtggcgagtactttaccgcccgcctgatggccgagtacctgggcttaccgttcctggacgccgcgacggttgtggcgttccatcacgacggtacgctcagcatgaatcgtacctccgagttggtgcaggagtacggtcagcagggcggctttgttatgcccggtttctacggcgcgacgcgtgagggccagatcaagctgctcgatcgtggcggcggcgatatctcgggctcgatcttggctaagtgcctgggcgccgatctgtatgagaactggaccgacgtctcgggcttctattctgccgatccgcgtattgttcccgaggctcagcccatcgcccgcgttacctacgaggagctgcgcgagctttcgtacatgggtgcgagtgtcctgcacgaggaggccgtgttccccgtgcgcgaggccggcattccgctggtcatcaagaacaccaatgcgccacaggaccccggcaccatcattagcgagacggctgacgagggcgaggcagagcccatcattaccggcgtgaccggcaagcgcggttttgtcgccatcaacgtggcccgcgaccgcaccaagccccgcgttggctttatgcgccgtgcgctttcggtcttcgagcgctatgacgtttccgtcgagcatatgcccaccggcgtcgaccgctttggcgccgtggtgcaggagcaggatgtgcacgattcgctgtactcgcttgtgggcgacatccagcaggaggtcgagccgctcgagatcgaggtcgttgagggtctggcgcttatcgctaccgtcggtcgtaacctgcgcggccgcgcaggtatctcgggccatctgtttggcatgcttggccaggccggcgtgagcgtgcgtatgatttcgcagagctgcgacgagatcaacatcatcatcggtgtcgaggagaaggacttcgacctagcgattcggaccatttaccgtgccttctccgatgagaacggcattgtgaaggtctccgacctggaggcttccgcgccggtcgatcccgctctggctgcgctccacaagtagctgctatctcgctagatttttgggagttgcctcaaaatctacggcggggcgtttcgtttcggtttcgtttcgacggggcgggtttcgtgcccgccccgttcttgtataaactggcaacaataatcggcctgctcggcgtgcgggcaaaagccacaacctttaaagggggaagcatgaaacagtacacggttgctattttgggcgcgacgggagccgtgggcacccagatgctcgagtgcctcaacgagcaggagttcccggtcggcaagctcaagctgttggcaagcgcacgctccgcgggcaagaccgttgagttccgcggcgagcaaatcgtgatcgaagaggcttgccccgaggcctttgagggctgcgacatcgtgctcggcgctgccggcgacgatatcgctaaggagctgctgcccgaggccgtcaagcgcggagccgtcgtggtcgacaacagccacgccttccgcatggatcccgaggtgccgctggtcgtgcccgagatcaatgccgacgatatcaaatggcatcacggccttatcgccaaccccaactgcgcgaccattatcggcctggttcccacctggccgctgcaccagcttgccggcgtgaagcgtatgatcgtgtccacgtatcaggcagcttcgggcgctggcgcgcccggtatggccgagctcgaggctcagctggccgccctgggccgtggcgaggagattcccgagccgcgcgcgtttgccgcccagctggcgagcaacctgattccgcagattggcggcgtcaaggaggagggctttacctccgaggagatgaaactgcagaacgagggccgtaagatcatgcatctgcccgagctgcgcgtgaactgcacctgcgtgcgcgtccctgtgctgcgttcgcactccgagagcattacgctcgagtttgagcgcgacatcacggtggaagaggcccgtgctgcgctggctgccgctccgggcgtgaagctggttgacgatatgagcgccgaggatgcgcacgatcgcttccccatgccgatggatacgtccgaccaggacctgatctgggtcggtcgcgtgcgtcgcgacatctcgaaccccgaggccacgcgcggtattaccttctggtgctgcggcgaccaaatccgtaagggcgcggcgaccaacgccgtccagatcgctaagctgctctgcgagtagtgtggcctgtccggcggggccgggcttagttttcagaacgtcctcgaccatgtgtggcgctcctatttggcaaggtgttttttagaatccattttgcgctcggcctcgaaggcgccttccttgtgcagcaggcgcacgtcgacgatctccatgccgcgatcgacggccttgcacatgtcgtagatcgttaggcacgcagcgctcgcgccggtcagggcctccatctcgatacccgtcttgcccgtcacgccggccgtaaccagtacgtgaaagccaacctgcccgtccgcgcgcgccggcgcccagccctcgggcacgttctcgacaggcatccccgccgaagcgatgggcgcaatgtcgcacttgctcttggtaatgagcagcggatggcacatggggatgatgtcgctcgtgcgtttgatggccatgatgcccgccacgcgcgcgcaggcaagcacgtcgccctttttggcgcggtcttgcagcaccatggcctgcgtctcgggatgcatgaggatggtgccctcggcgatggcgatgcgatgcgtctcggccttgtcggacacgtcgaccatgcgcacctcgcccctggcgtccacgtgcgtcagctcgtcgcgacgggcgtcacgggcgggctcggtggcagcgctggcagacggctgcacggacgtgtcggcgctgccagcattcgccgcagccgtggctttgtgggcagacatcgcggccctgcgagcggccttggtggcatcggcgtacctgctcttggccatatgatcatcctccgatttgggacataaatcgttgcgtgccctcaattatcgcgtgttcctgcggtttgtgggccacggcatcgcgccaaatcgaaagtacctgcatatcatcaccacggcgcagcgcctcacgcaccgaatactcagcatcgctgaacaggcacggacgcacgttgccgtcggccgtcaggcgcagacggttgcaattcgcacaaaaatggttggacatggcgctaataaagccaaccgttcccgccgcgcccggaaagtgccaatagcgcgcagggcccgcgccggcaggagcgtcgttgatgtcgagcgactcgagctcgcccagtcccgccgcggtggccccggcattgatgcgcgcccgcagctcgtcgctcggcacggtgtcgctcgcgtcccacagctcgggattgagcgcgggcgcatgcgggtccacagcgcaatgcgagctcgtgtgctcgtcgccgatgggcatatattcgataaagcgcaggtggatggggcggtcgacggtcagtcgtgcgagggccgccacatcctggttgagccggcgcaccacaacgcagttgaccttaacgggctcaaagccccaagccagcgccgcatcgatgcctgccatggtctgctcgagccggcccaggcgcgtgatctttccaaacagcgtagggtcgagtgtgtcgagcgaaatgttgacgcggttaagcccggcatctttaagctgcggcgccaacttgggcagcagggcgccgttggtggtaagcgagatgtcctcgatctgcggaatcgcgcggatgtcgcgaatgagcgggatgatacggcggctgaccagcggctcgccgcccgtcaggcgcacgcggcgaatgccctcccccgccaccaagcgcacaaagcgggcgatttcctcggcactgagcagctcgtcgtgtgcgcggggcgccacgccatcggccggcatgcagtaaatgcagcggaaattgcacttgtcggtaacggcaatgcgcaggtagttgatatcgcggccaaagccgtcatgttgcacgtgcccgtccacgcagccctcccctcacgcggcgttttattcttcggaaaacataataccccacgagagaatcacgccgacacccgtacgacaggacaggtcactttgggcaagaccggcttcccaagcccatcctcagcacagaccatcacagcattcgatgcttttcccgtttttggcaaaaaacgtcgaatgttgtgatggtttgcttgcccacggcaccccgtagaagggccaaagcgcccctaaaggccgccgtcccagtgccgaatcacgaattctcgcaggtcgttctgacgtttctggaacgcttcgcttcgatcgcacttgagacccatagcaagcgcgatggcgttcatcgcccggtgcaattgcagctgatgggcaaactgagtcccggtgaggacgatcatcctaaagcccagcgcgctcagcacggtcatacgctccgcgtccgacgcgctgcgctgtttatcaagatggtccgagccgttgtattcaatccccgtaccgctcgcagacgcatatacgtcgatctcgaaatacccggcctttgcgagatacttgaactcgttgggaacatcgacccgatggttgagctcgatcttggcgtatcccagcccaccctgggaacgttttgctacgaccatgattgcggtggccgtctccatgggcgaccgcgcgccatcgtgcacgcgcttgagcgcggcggccgcgcgtatagccccctggcgagatcggttctcattgcaataagcaatcaagtcggcaacggtatacctctgccccatctcgatgtaatcgcctgtcgacagatgattcaaatggtatcgggcacagatttcgtagccatattccagctgctcgggctcgctcatccacgaacccgcttggacaaagcacatgacctcatcaaccactagaaggccctctgccacctcgataagatggcctggaggcaccggcgccccaaacacgtggcatctaaatccagccggcgtcgagcgctcaaaatcgaagttgacgagcgtgtcgatatgatcgagctcttctcgcggaataccaagcgaaaccagatagtcggtaacgatcccagctgccgttgaagccctcagccctttggcatcgagtcccaatttgggcaggctcgcggtcggctccgcatcgttagcaagcgagtcctcatcgtataggctgcttgctcgcgagggcggctcggacgggcgcgccacgttgtggtacagctaggcagtcttatgggacaggacgatcggcaggtccatgagccctccaatggagtcggataaccaaccttattcccctgcccacgggtccgcacaccttcgtgcgcaagaaagcgattccacccggtcgagcggcagaaaaaccatcacaacattcgatgcttttcccgattttggcaaaaaacgtcgaatgttgtgatggtttgaggcgaggtgaggggcacggaggggtcaaagcatcgtgctcgaacgggttaatccagctcttttaagccatgcgccagctgccagtactcgccgtgctgggcgagcagctcttcgtgcgtgccgcgctcgatgatgcggccgtgttcgaggaccatgatggcgtcggcgtcgcggacagtggacaggcggtgcgcgatcataaacgtggtgcgaccgcgcatgatgcggtccataccgcgctcgatgagcttttcggtacgcgtgtcgatggaactcgtggcctcgtccaggatgagcaccggcggatcggccaccgccacgcgcgcgatggcgagcagctgacgctgaccctgcgacaggttggcgccgtcggccgtgaccggtgtgtcgtagccccgcggcaggcggcggataaacgagtcggcgcaggcggcctcggcagcggcgcgcacttcctcgtcggtcgcgtcgagcttgccaaagcggatgttctgcgcaatggtgccgctaaacaggtgcgtgtcctgcagcacaatgccgagcgacccgcgcaggctggccttggcaatgtgcttgacgtcgatgccgtcgtacgtgatctcgccgtcatcgacctcgtagaagcggttgatgaggttggtgatggtcgtcttgccggcgcccgtggagcccacaaacgcaatcttttgccccggcttggcaaacaggttgaggtccgtgagcacgcgggcgcccggcacgtaggaaaagtccacggcatggaagcgcacgtcgccggcaagcgggaccaagccgcacgtgagctcgatgccgtcggcggccaccgcgcggcccgactcatcaacggctgccacgtcatgcaagtgcccgtacgcgcccacgccctggccctcgggaatcttccacgcccacgcggcgtcgcccgtctgcaccagctccacgcagccctcgtccacctcgggctcaaggtccatagccgcaaacaggcgctcggcaccggccaacgcgttgagcaagaagttgcccagctgcgtaaactggttgatgggcatggccgcctggcgcacaaagaccaggtagctcgcgagcgcgcccacgtcggcgagtcccttgatgcagagcatgccgcccgccacggcgacgatggcatagttgacgtagccaatcaccacggtcatgggcaccatggagttggcatagctcacggcggcggtgccggtgcggcgaagctcgtcgttgcggcaggtgaagccggcgacattcgccgcctcgcggttaaagaccttgatgaccttttggcccgagaccatctcttcgacgtatccgtccaggtcgccaagcgatgcctgctgggcagcaaagaaacgcttagagcgcgcgcccgagtagcgcgcatacagcacaatggccgcatcgcacacgagtgtgataatcgtgagctgccagttaaggatgatgagcatagccgtggtgcccacaacctgaatggcggcctgaatcacgttggcaaagctgttgttgagcgcctcggagacggtgtcgacgtcattggtgaaaaagctcatgatgtcgcccgagcgcgtgctgtcaaaataactgagcggcagcgtctggatgtgcgcgaacaggtcgcggcgaatatcggacaccacgcgttgggccgcgcgcaccatgatctgcgagtagcccagggccgaaagcacgcccgcggcgtagatgatcgccgtcaggatgacctgcttggcgagcagttcctccccgcccgtagccaaaccgttaacgatggggcgcaccatgtaggtgccggcgaggctcgcgatggcggcgacggaggcgagcacgcccaccgcgagcaacgagaacttggcatgccccatgtaggagagcaggcggcgcaccgtgcgcttgaggtcggccgggcgtgcttgggctgcggtcttaggcatggcgctcacccccttccaagggcgatccgctgggaacggaggaaaacggatcattcgcgcagccatcgtcgccgccgtcgctggcgtccgtgttccccgcaaactccatctgcgaggcgtaaatctcctggtatatgttgtcgcccgccagcagttcctcgtgcgtgcccacgccgtggacacgaccgtcatccaacaccacaatgcgatcggcatccatgacgctcgcgatgcgctgggcgatgatgagcacggtcgtattgggaatccgagcgatgtgctcgcgaatcttagcgtcggtcgccatatcgaccgcgctggtggagtcatcaaaaatgagcacgcgcggatgcttgagcagtgtgcgtgcgatgcacaggcgctgcttctggccacccgagacaccggcgccgccttggcccaactcgccgtcgagtccgccgatgcgatcaaggaactcgtccacgcacgccgcgcggcaagccgcgaggagctcatcgtccgacgcctgcggattaccccactgcaggttctcgcgcacggtgcccgtgaacagcacattcttttgcagcacaatgcccacggcatcgcgtaaggtcgcgaggtcgtagtcgcgcacgtcgtgtccgcccacaagcacggtgccctcagtggcgtcgtacaggcgcgcaatcagctgcacaagcgaactcttgcccgagcccgtgccgccgaggatgcccaccgtcgagccgctctcgatgcgaaggtcgatatgctcgagcacatcctcggctgcatccgcgcggtatttaaaggaaacgtcgcgaaactcgatactgccgtccgctggcgccgcaatcgcgaggtctcccgcggggttggcgataaagggctcctcatcgagcacctcggcgatacggcccacactcgtaagagcgcgcgtgagcagcaaaaacacgttggaaatcatcatgagcgaattcatgatcagcagcacgtagctcataaagcccgtgagagagcctacacccaacttgccggcgagaatcatgcggccgccaatccacaggatggagagcgcagccacgtacatcgacagctgaaacaccggcaggttgagcaccgcgctgccaaaggtctttgtcgcagtgcgcgcgagctcggtattgacggtgtcgaacttggcctcctcgtgctcagcgcgcacgtaagccttcacggcgcgcacggcggtaaggtcctcttgcaccacgccgttgaggtggtccatcgaggtctggagttggcggtagagcgggctcacacgcacggtaatgataccgagcacgatggcgagcatcggcagaatgacggcaaagaccgccgcgagctcgcgcgagagcgcaaaagcgtagacgaagcccatgaccagatttaccggcccgcgcaccatggggcggaagccgttacctacggcgttttgaatcacggtgatgtcggtggtcatgcgagtgacgagcgagctggcgtcgtagttgtccagattgccaaaagcgagcgtctggatcttgcgatactcggcctcgcgcaggttagcgcccagccccgaggcgacgcgagcagacgtgcgtgcatagcccaagccaagtaccagcgaaaatgcggcgcataccaacatatacgtaccctgcaacagcatgtagttgatgtcgcccgcgggcacgcccacatcgatgatatttgccatgatgaccgggataaacagctcgagcgccgtctcagcagtcacaaagaacacgccgagtatggcatcgcggcggtatgcccccagataggaaaacagaatcttgagattgcgcacgcaggttcatcccccatcaaacgttgttcgcaaacccacgtattatggcgcgccgtgcggcggtgtcaagtgttccgaaatcgatttctgcaaggctagtgcaggcgccatgctcacagggcgcacgtccgtattcaattagaaatgaacgcgagcgtgactttttcgccccaccgccaacacaaaccttgactctacaatcgttgtagggttttcactacactggtatgtaaacgacccaagccagaaagtgccccgcccatggaacacgacctcacacacggcaatgtcctcaagaccatcgcggtctttgccctgccctatatgctctcgtactttttgcagatgctctacggcatggccgatctgtacatgatggggcagttcagcggcgccgccggcatcaccgccgtgggcaatggcgcgcagacgctctatatcattaccgtgacgcttgtgggcctggccatgggaacgacggttatcgtcggccacgccgtgggctcgcgtcgcttcgaccgtgccgagaccgccatcggcaacaccatcacgctctttatgggtgtctcggtggtgctggccgttgtcctgcttgcgctgtgcccgcaggttgtggcgctcattggcacgccggccgaggcggtcgaaggaaccgccgcctacctgcgtatctgctttgtcggcattccctttatcgccgcgtacaacattctttcggccatctttcgcgggctgggagattcgcgctcgcccatgtacgtgatcggcgtggcatgcatcatcaacatcgcgctcgactttctatttatcggccacatgggactcggccccgtgggtgcggcgctcggcacggtaaccgcccagacggcaagcgttgccctcgcgctcgtgtggctcaagagccgtcgcacgaacatccacgttaagcgtagcgacctgcgcccccagcccgaggtgctcggcagcattcttaagatcggcgtgcccgtggccgtgcaggacggctgcatccaggtggcgtttatgttcatcaccgtcattgccaaccaccgagggctcgtcgacgctgccgccgtgggcctggtcgaaaagatgatcagctttttgttcattgtgccgagttccatgggtgccaccgtcagcgcgctcacggcgcaaaacgccggcgcgggcaagggcgatcgcgcgcgtcaggtgctcaaagacgccatgacgatctcggtggtgtatggctgcctgatcacggtgctgatgtggctggtggcaccggcgtttatcggcttttttgccaaggactccgcggtcgtcgcggccggtaccggctatatgcgcagctacattttcgacgcgatttttgccggcatccacatttgctttagtggctttttcgctgcatacggcaagagttacatcggctttgcgcacaacgtgctggccgtggcactcattcgcgtgccgggcgcgtggctgctgtcgaacgcctattccgacacgctgtttcccatgggcatcgcttcgccatgcggctcgattttgtcggcagtcatctgtgttgtcgcgtttaccgtgctcaaccggcgtggggcttttgacaagttggcagcgtagcggggcaacgcgaaatcgcccccatcgacgacatcatcagcgacgacccggcgacctacgtgacgcagatcacggtgccggttgtcccggcaaagtaagaaccgcccggaaggcatcgtgcttccgggcggttcttactaatcattatccagcaactcgaatcgatttctagatatcaccaatgcggcataatcttggctttggtgaaaaacatgggcaaccacaacgtcctcgttatcgtagtaataaagcattacataagaattgacgaggcaagcatggtagccaagcgctgcaagctcgggtaacttcgataagccgtagtcaactacaccactttgaagaagctggagctgactacggtatttatcaagaaaatgccgggcggtaaaaataccatgccctaatagataatcaacgatatcgtcaacctcttgttcagctgtaggcagaatcttgacgttataggccatattttgcctcaaggtcatcgagggcctcaaaggcatcacgcgccgtgccggcagcacgctcccgctcggccacagctatacgagccatcaggcgagccttagcctgttcctgaaccatgaggtcatagtcttcagatcgaagtacaacaaatttgctatagccgttttttgtaacagtcactgggcccgtagtagtttcaacgagctcagaaaactttgcggtgtcccgcatatctttaattggaacgcaaacgggcatggcacactcctaacataattgtgtacacaattatgttacaccaaaacgaccccgctaaagtcctaaagcatcttcactgacaatctgaatgtcatcgcccttggactggagttccaaggctttctttaccttactcccgtagttctttgtagtccaagcatcgctgccttcatcgcccacaaccacgtagtcgcatttctttgacacgccactcagtacctggccgccattctgcaaaataaactgcttgatacactcttttgaaccatgatagaaagtaccagagaggcagaatttctttccttcaatttgaacctgtcgatgcgctacgccatcggagcagggattgattaccccctgcaataaaccaaccaattgattggattcgcgctcatctatatcaccatccgccaaagcggcagttagaagcgagcaaactttgtcgagcaaagggtcgccttgcaacttatcatgttcttcgacatactgcagtactgacattgcctccaaggcatcaactcggccattggcgactatcatttcgcacaaacttagaaagtcgcagtaatcggcagtcttttccgacttcactctctgtgccgaagcacgggaagccccttcatttgaacgtcgtttgcaactagcaccaagactatacggtgcaaacgtggggacacgcccctcgtcttccataaccaacgagtggaaaatacgcctgcaagcatccgcatcgtccaaggctcgatgatggttccccatctcaagatctaggcatcggcaaaccgttggaagcttatagtctgggtattctggatgccactgcttggcaagctctttagtgcaggcgtaattccactcgggcctgtcaagttcataggcgtcgaatagcttccacagaaccgccaaatcaaatgaagcgttgtgagcaaccagagcggctccgtcaaacaagcttttcaatgagcgtgaccatatttccggaaatgtaggagcaccggcaacatcagcgtgggaaatgcccgttagcctcatgtttatttccgaaaacggctcctcaggatcaaccaaataggaatcctctgcaaggacggcaccattgcagtcacatcgaattagtccaattgagctaattcgatcattgtgtccatttggagtttcaacatccaaaaacagtacgtctgccgccatgacagtctccctactccacaggaacttcgcccgtttcgataatttcctcaagttggtcttcgtccagtacgggcacaccaagtgcttgggccttagtgagctttgagcccgcattcgcccccgcaactacataggaggttttcttcgaaaccgaccccgtcaccttagcccccagaagtttcaacacatccccagcctcggaacgagaacgtttctcgagtgtaccggtcagaacaaaagtcaatcctgttagtggttgctctgaagcgagattggcggaaataccagctttttcagactttgcctgcattgcgcccataaggtcttcctcgagagagaaaccgcattcacgaagtcgctgaagcacatcgagattttccggaacagagaagaactcctttatgctatttgcgatttccggtccaaccccttcgatctgggctatatcttcctcgtcagctataacaagtgcatcaattgaaaggtaacgccgggctataagctcggcgacgctcttccccaccaagcgaatccccaaagcaaacagaatccttgggagcggcaactgccgagatttattgagctcatcgactatcttttcagccgtcttcacacccaccggtatgggctcgcccgcatttttaacgattcgatcggctttgtaaagccttggagtaccgtcctcgttgagcatcggctttccatgcttatcgagcatggggtcgcccttacgatgccccccttttaccacgcggcccgtgtccaggcctgcgatgtcatcgatcgtgagctggtagaagtccgcgacatcgtggaccaggccggcggcgatcatcttgtcgacaatctcgtcgcctaggccgtcgacgtccatgcagccgcggctcacccagtggagcaggcgctccttgagctgcgcggggcagtcgatggagacgcagcggtaggcaacctcgccgtcctcgtggaccacggggctgccgcacacggggcagacctcgggcatgtgccagtcgaccgaatcggccgggcgcttatcgagtaccgggcccacgacctcggggattacgtcgcctgccttgtgcacgatgatggtgtcgccctcgcgcacgtttttgcgacggatctcgtcgatattgtgcagcgtggcgcgcgcgatggtggagccggcaaccgtcaccgggtcgaactcggcgaccggcgtgagcacaccggtgcggcccacctggatgcgaatttcgcgcaggacggtctgcttttcctcgggcgggaacttaaaggcgatggcccagcgcggcgcgcgggcagtaaagcccaggtcgagctgctgctgaaagctgtcgacctttacgaccacgccgtcgatgtcgtagtccaggtcaccgcggtgctcaagcgcctgggcacagaactcgtggacctcggcgggtgtggcgcagcgtgccacgttggggttgacgctaaagccggcgctgcgcagccagtccagaaactcgcgctggctgtggacgtgcaacgggtcggtatcggcgatggcgtagataaaggtggccagatcgcggcgtgctgtgaccttgggatccttttggcgcaggctgccggcggcggcgttgcgcgggttggcgaaggggtcgcggccctcggcatcggcctcttcattcaggcggacaaagctgcccttgggcatgtagacctcgccgcgtacctcaatggtgcgctcgcggtcggcgcccatgtgggcgagtgccggctcggacaggtgcatgggcacatccttgatggtgcgcacgttgagcgacacgtcctcgcccgtggtgccatcgccgcgcgtggccgcgcgcacgaaggtgccgttttgataggtaagcgcaacgcccaagccgtcaatcttgagctcgcaggtataggtgacgctacctgcgccgagcgcatcctcggttcgttggagccacgcgtcaagttcgtccagatccatggcatcgtccatggaatacatgcgcgccatatgcgtgaccgacgtaaactgctcgctcacgtagccgcccacacgctgggtatagctgtcgggcgttaccaaatcggggtaggcagcctcgatctcctgcagctcaacgagcattttgtcaaaggcggcgtccgtgatctcgggcgcatcgagcatgtagtagcgataggcgtggtaatcgagctcgtggcgcagctcggccgcacgtgctgccgcctgggcacgggcatcggtcggtgcagcggcatccgcactcgcgggcgtttcggtatcgatgtccacgccgtcaccaaacaggctcgattgctccatagcggcactccttcgctcgatttcaaacggatactagagtaccaccggtcaccatggcgccgaatagccctttcgaaccgcaccgaatcggcagccgacggaccggggtggatcgcgcgatcaacccatgcccttgtcagttctaaatgacccgttttcctccgtccccaacggatcaataagaaaagaggagctgtcccacgttgatgggacagcccctctggcatcggtatgtgcgatacagctcgttagaaaccctggccgtagccttgaccctggccctgctggcccagcagctcctccagatactggcgcagctgctcgtcggtaataccgccgttgccggtgtcggtcgagctgtcgtcctgctgctggttctgcagctcctcgtcggagcccagctcgacggtgaccttcttctcgtccttgccgcgcataagcgtgatctcgaccttctcgcccacctcgtggctgcgcagcgcgatgatcaggccatcggcgctcgtgatctcgtcgtcgcccagcttggtaatgacatcgccctcttggatgccggcctttgcggcaggaccgtcctcaacgacgctcgccacgtacgcgccgctatcggtgctcagcttgttagtgcgagcgttgagcgcgttgacgctcgaaagcgtggctcccaggtacgggtgcaccggcgtcttgccgccgatgatctggtcggcaatgttcttggcgtagttaacgggaatagcaaagcccacgcccgagctagagcccgagtagctctcgatgagcgagttgatgcccaccagctcgccgttgtcgttaacgagcgcgccgccggagttgcctgggttgatggcggcatcggtctggatcatgttggcgtagatagtgttgccgctggtagagctcatggccgtggagcgatacagcgccgacacgataccggtggagacagactgctcgttgccaaacggcgaaccgatcgccatgacccactcgcccacgttgagcttggaggaatcaccgatctcgatcggcgtgagcttggaggcgtcggcgtccttgagcttgatgacggcgaggtcactcgaagcatcgttgcccacgaactcggcctcgtaggtggtgccgtcgtccatggtgaccacgtactggtcgtagccgtcgaccacgtggttgttggtgaggatgtggccctcggtatcgagcacgacgcccgaaccgacgctgcccgagctatccgactcatcagcagactgcgaaagcgagccattctggctgccgctcgaagtggcggtaatggaaacgacggagggcagggccttagcagaaacggcctcggccagcgtggtgtcctcggagtcgatcgtgatcttttgcgtcgatgaacccgaagcgcccgccgtcacggcattcttgccgccgccgatatcgagcgtgccgctcataatgagcgcgatgaccagcagggcgccgcaggcgcagccggcgagtgccgtaataaagatcggcagctttttggtcttggtcttgaccaccgtgtgcttgttcacgacctgttggccgcccagcggcttgccggtctgcgtatcgtatgcctgcacgtagggaatgttgctaccggcaggcgtcgactccacctgcacacgcggctgggtctcgccagcgttgcccgcatcctgggggtgctgggaatcgttctcgctcatagctgcgatcctttcgtcaaataaccaaaggcccgccaaacatgtggcgggccatcattgttcacgttgagttgtaccccaatatgcgggcgcaagtgtatgagaacgcaatcttttaggaaggcttaagttctgccgcagacccgaaaggaatccgtacctgcgtcaaaaccaccacaaaagtgcctgtcccctttgtggtgaaaagctagtccttaaacagatagcccacgccgcggacggtggtgatgtgcgccgcgatctgcggacccaccttggagcggatgcgtcgaatgtgcacgtcgacggtgcgcgtgccgccgcagtactcaaagccccacacgcggtgcagcagcacctcgcggctgtaggcgcggttggggtgcgtcgccaaaaagctcagcagcgagtactccatcagcgtcaggtcgatgggctcatcatcgagcgtcacctggtaggtggccaggttaatctcgaggttatcgatgttgagtacatcgtcggcggtgacggtctcctcctcgcccatcaggcgctgcgcacgagccttgagctcgttgggcgtcgccgtggggcacacaaagtcggcatgcgcgtgattcggcaggcgcagggtgccaagggcctcatcgtcgacgatcaccagcatggggacgccgccacgatcgtcaagccacttggcaatctgatcgatgcggtcgctgcgaatgccgtcggaatcgaggatcagcaggtcaaagtcgtgcgccgcagtcggcgaatcgggggttgccaggctcacctcgacacccagggtggtcgtcaagctgcgggcaaactcgtggaagcgcgtcgtgcgcgccatgaacagggcactcttttcggacatatcggcctccaaagaaatgagctcaatcgtactggaacaagccagcgcgattaggagttcgccaggtagtgcttgatctcccactcggtgatcgtagactcaaacttatgccactcgtcgcgcttctttttgaggaagaagctgtggatgtgctcgccgagggcatccttcataaactgcgagtcctcaaacacgtcgagcgcctctttgagcgagcgcggcagcggcgtgtagccggcctcgagcatctgacggtcggtgagcttgagcgtctcggccgttgcctcgggcgggagttccagcttgcgctcgatgccgtccagaccagccgccagcgtgacggcgttgaccaggtacgggttggccatggggtcgggactgcgcagctcgatgcgcgtggacagctgcttgccgggcttgtagaccgggatgcggaccatgctcgcgcggttgcgcaggccccacgtggcgtactgcggcacggagtcgccgcccgtggtgatgcgcttgtacgagttgaccgtggggttggtgatggcgctgatctcgcgggcatgcgccagaatgccggccatgtagtgtttggcgatgtcggaaagatggtacttctcgtcgtcctcgccccaaaagacattgttgccgtcgtggtcgaatagcgactggcacaggaacatagcgctgccgtcctcgcccgccaacggcttgggcataaaggaggcgtggcacccgctctcgtaggcctgctgcttaatgatgagtttggccgtggtgatggcgtcggacatgctcagggcctcggcgtggcgcaggctcatgccgtgctgcgagcggccggcggcatggaaggtgtactccacgggcacggacatcttctcgagcgtgaggaccgtgttgcggcgcaggtcgcgggcggcatcgctcaccgaaagatcgaagtagcccacgttgtcgagcggctcgggggtgtgctcgtcggggaagtagtaatactccagctcggcgcccacgttgagcagatagccagccttctcggccttgtggaacatgcggcgcagggcatcgcgcgggtccccagcgaagggcttgcggtcgggagtgcacacgtcgcagaacacgcgggcgacgccgttgtggctcgggcgccacggcaaaatctggaaggtcgaagcatcggggaatgcgagcatgtcggcttcctcgggcgtggcaaagccctcgatggcggagccgtcaaagccaataccctcctcaaaagcgacctcaaggtcctcggggctaatggcaaagttcttgaggcggccgagaatgtcgacaaaccacagacgcacaaagcggatgtcacgctgctctacggagcggagtacgtaatcgatgttctgctggttcatgtcgctcccctttctttcgggcgggtttcgactggtctatatcgcagatactatcgcagaaaaatgtttccgcagggttaaagcgtatcaagcgctcaaaaaacgtgcgcgaacaggcagttgcgaacgagtgactagcgcgaggtcgatgcgcggtgctcgatgtggccggggatctcgatgcgtttgggcgccagctttgcggcctcgcccacggtggtggtaacgacgtcgatgcgctcggagaggcgctcgactacgcactcggcaatggtaagggtgtcttgcgcggccgtggtgacgccgccaaagagcacgcggttccaggggcaatcgtcaaacgtcgcgattttgagacccgccggcaacgaaggtcccaactgcgccagggcctcggtcagacgcaggaagaccaagccgttgacagcgataaggccgagctttttgcctgcatagccgcggatagtctcgtccaagcgaccgacgcccgtggcaccgccatcggccaaggtgacaacctcacccgcaaggccgcgtcgcgaaagctcatcggtaaaggcttcagcgcgctctcgacgcacggggctatcgtcgcttgcctcggtgagcaggcacagacgctcgctgcccgcaacggccaaggcgtctaccaagccggcgactagctcacggttgttagatgtcaccagatcgacaccgccgtcggcaacatcgcggtcaagcagcacaaccggcagacgtcccgctgccgcggcgatcgcctcgtcattacctccgcaggtgttgacgaccaggccgtccacgccggcatcgataagtctggtgagcgactccgcttccttagcggagtcgttgccactaatggccgtcatgagcgagcagccgcgcgcggcggcgctggcggaaagtccttcgagcatggcgctggagaacgggttggcgatgtcggccaggatcacaccgatgaggttggtccgcgagctgcgcagattgcgcgcggcggcacgcgggcgatagccggtgcgctcgataaccgccgcgatgcgagcacgggtttcctcggtcatttgcccggggcggttgttgagatagcgcgagaccgtggccggactcacgcccgcctcggcggcaatgtccttgattctcatctgcgccatagcgcaccccgtttcccaatgtcggaagtctgagccattttaggcattttttaaaaatctcggttgcaaagcgctgtaggtgagcagcatcgtttttgcgtctcgagcagatgcaatgatgggctagttattcgagtctttaggcagctcaaaatagtcgggatgtaaggcgataaccgggccctgctcctcgggcatcaggtgcaagtgcgtctctgccagataactcgccgcatcggtatcgcccctcttaatggcctcgagaatccggcgatgctgccgacgaatcggctcccaatccaggtcctgcgacaccatacgcaaccagttgtatcgctcaaaatgagtgttgacgctcttcatccaatcccacaacatgtgacgaccggcaatctcaaaacacgtctcatgaaacaggttgtccagatcgaaaaagcgacgcgtttcgccatggtcgagtgactcagactcggcaagaatctgctcgagccgatgcttttgctcaggcgaggcggccgaacagcatttaataagcacgcttctctcgagtttctcgcgcaagaaacaggcgttctcggcgcgctccatgctgatttttgagacataggtgccgcttttgggacgcgtttccaccagctcctgctcacgcaggcgcacaaaggactcgcgaatgggcgtgcgcccgattcctgtctccttttccagaccaatcgccgaaagacgcgtgccgggcttgaactcggcatagatgatcttggagcgcaatgcgttgtatgcctgatcttgcaagctctgataatgctggtgttgttccataaagccctcggatgaagctcacggtttgtcgaatatcacccgtaatactatcgcatcccctatctcatcagttgcggtgaaatagggcgcgctcgcgtcgccaggatcacaagagcaagcggcggcatcccgaaacccgggaccccgccgctgttttgctatcggatggcgcagggatgcccctcccaatgcaccaggggttgactagagctcgcaggcaaccttgtagccatcgccgatggcgtcgcggatgttgccgcacttgttggcgtcacccagcacgtgggtggcaacgccggcagcggcaaggtcgtcggccagcttggtattgggacgatagcccatggcaagcaccagcgtatcggcaccggcgatggtgtggacctcgccgtccttctcgtagctgatggtgtcctctgtgatttcggtcaccttggcctcagtcagcacgtggacacccttggagagcatgcgcgtgatgagcaccgcgcgaccggcaccgccctcgttggcggcgagcgtcttggtcatctcgatgacggtgacatcgcggttggccggcgacaggtcgttgaccaacggggccaggtaatcggccgtctcgcagccaacggtgccgccgcccacaatgacgatcttcttgcccgggaaagccttgccacccagcaggtcatcggccgtcataacctgcttaaagccctgcatgaaggccggagcgatgggctcggcgccataagccaggacaacctcgtagcccgcgtagtcgcgttgaatgtcctcggcagtaagctcggtgccaaatacgcacttcacgccgacctcggccaggcgacggtactgatacttgatcacgcgggtgagttcctgctttgccggcggaacggccgcgatgcgcatctcgccgcccggctcatcctgcttatccacgagcaccacgttgtgtccgcgcttggcggcaatgtaagctgcctccatgcccgcaggaccagcgcccacaaccagcacgttcttagcctcggcggcaggctcgtaaccagcctcgtcgcgctccacgtccgggttgacggtgcaggagatgcgcttgccgaacataatgccgttcaggcagcgcaggcaaccgatgcaggggcggatgtcgtcggcgttgccggcagcggccttattgcagaactcggcatcgcacagattggcgcggcccatcatgcagatgtcggcagcgccgtcctcgatcagctcctcggcgatccaggcctcgttgatgcggccgacggtggcgacaggaatgttgacgtgctttttgatctcgcgcgagcaggcagcgtgcgaggcctgctgggtaccggcggcaggaatcgcggaaccgcgcttgatggtggtgccgcccgacacatgaatcatgtcgacgccggccttctccaggcgacgcgagacgtagatcatatcgttgagggtcagaccgccatcggtgtactcatcgcccgagatgcggacgtcgatgataaagtccttgccgcagcgctcgcgaatctcggcgatgacctcgagcaggaagcgcatgcgggcatcgagcgagccgccgtactcgtcggtacgcttgttgtagagcggggtcaaaaagccgccgagcataccgtgggcgtgcgctgcgtggacctcaacgccatcgacaccggccttctgcatacgcacggcagcgtcgccaaactgatgcgtgagctcgtgaatctcatcgaccgtgataggacgcggcgcctcgcgggcataggacgggcccacaaaggatggagcgatcaggcgcggcgtgcccggaatgttaaaggccatgtaggcggggtggaagagctgcggcatgatcttgcagccatactcgtggacggccgcggcgagcttttcccagccagggataaacgtgtcgtcgtagcagcacatgtcacccggcagataggtataggtaggctcgaccgtcacgacctcggtgatgatgaggcccacgccgcccttggcacgggcacggtaatgatcgaccaaatcgtcggtcacatagccatgatcggccaggttggtggacaccggcggcataaagacgcggttcttgacctcggtcgtaccgaccttgatcgggctaaagagcatcggataggcagaggactccatacagggttcctttcgtttgagccgctcggcggcagttgctaacgtacttatcatatcagtaaccgcgcagcacccgaccgcacgcgcttccccaacttctgctcgacccataaaaagttgcggtggaatacggagtagatgaggcctttgacagccaaaacagtccgtatttcaccgcaactgatgggcggggtggaattgagggctcagatagtcagtcatgccctcatccgccactccctcacctacagcgcgccgtccagcataaggttcaccttgagcacgttgaccgtgggctcgccgaagacgcccaggaatcggcccttggtgcactgggcgatgatctcgcgcacctcgccttcgctcttgcccgtggccttcgccaggcgcgggacctggtactcggcggcatcgggagagatctccgggtcgaggccggaccccgaacacgtcaccaggtcgacgggcacagcgtccatatcagcatcggggttggcggcgcggatcttcttcacgcgcgcatctatcagctgccgatactcctcactcgccggggacaggttggacggggcaccatacgccatgagctcgccgtcttcgccttcgacaattgacacgttctggatacgaccccacatatgggcttcgccatcgaagttctggccgatgagctcggaacccacaaccttgccgtcaaccgtaatgagcgatccgttcgcctggtacgggaacgcaacctgggcgatgccggtcacgacgagcgtatagcccaggccgcagacaacggtaaacagcgcgaacacgcccagtgcgcgcgatgcaacacctttgaacatacaaacctccacttacataatgccgcagaacgcgagcagcatgtcgatgagcttgatgaatacgaacggggcaacgatgccgcccagaccccacacgagcaggttgtgggtcagcagctgtccggacgggacctcgcggtacttaacgcccttcagcgcggccgggatcagcgcgacgataacgagcgcgttatagatgatggccgaaagaaccgcggacagcgggcttgccagaccaaggatgttgagcgcgccaaggcccgggtagatcggcgagaacagggccgggatgatagcgaagtacttcgccatgtcgttggccaccgagaaggtcgtgagcgaaccgcgggtcatgagcagctgcttgccgatacgcacgacctcgatgagcttggtggggctggagtcgaggtcgaccatgttgccggcctccttggcagcctgggtgcccgtgttcatggccacggcgacgtcggcctgggccagagcgggcgcgtcgttggtgccgtcaccggtcatggcgaccaggtgcccctcacgctggaactcgcggatcttctcgagcttgccttcaggggtggcctcggccaggaagtcgtcaacgccggcctcggcggcgattgccgcggcggtgagcgggttgtcgcccgtcaccatgatggtcttgatgcccatcttgcgcaggtcggcgaacttctccttaacgacggacttgatgatgtccttgaggtacacaacgcccagcacgcgacagttcttggtcacgaccagcggggtgccgccggccttggcgatgcgctcgacggcctcgtcgcactcctgggagaacacgccgccagctgcctccacataggtgcgcacggaatcggcagcgcccttgcggatctcattgccctcgtagttcacaccggacatgcgcgttgccgcggtgaaggggatgaactccatacccttatcctcgagcgtgcgaccgcgcagaccgaactgctccttggcgagcacgacgatggaacgaccctcgggggtctcgtcggccagcgaggaaagctgggcggcatcggccagctccgcgggatcgacgccatcgaccgggatgaactcggcggcttggcggttacccagggtgatggtgccggtcttgtcgagcatgaggatgtcgacgtcgccggcggcctcgatggcgcggccggacatggccagcacgttggcctcgttcagacggctcatgccggcgatgccgatggcggaaagaagggcgccgatggtagtaggagccaggcacacgagcagcgccacgagcgtggtcacggccgtggggttgtccatgtcgttaagaccgaccgagaagcaggagtaacaatacagggccagcgtgaccaggataaagacgatggagagggccaccaggaagatctccagagcgatctcgttaggggtcttcttgcgcgcggcaccctcgaccatcgcgatcattttgtccaggaagctctggccgggctcactggagatcttgacgatgatccagtcggacagcaccgtggtaccgccggtaacggcagagcggtcgccgccggcctcgcggaccacgggggcggactcgccggtgatggcggactcgtcaacggaagcagcgccctcgatgacgtcgccgtcgccgggaatctgctcgccggcgcgtacgatcaccaggtcgccgcgcgtgagctcggtgccgggaacgacggtgaagtgctccttgtcctcaacggactcgatgcgatgggcctcgacatccttcttggccgcacgcagggaatcggcctgggccttaccgcggccctcggcaagcgcctcggcgaagttcgagaacaggtcggtaagccacaggatgaccgcgatggcgaccacatagtaggtgggcacacccgcgtcctgcacaccgaaaatggaagcgacggccaggacggaggtcatgacggcggaaagccacaccaggaacatgaccgggttttgaatctggacgcgaggatccagcttggcaaacgagtcgcggaccgcgcggcccatcatgtctttttgcatagtcataaatctgcgccctcctttacgcaatcatctggaagaactcggcaacggggccaagcgccagggccgggaagaagctcagggcaccgatcagcagaacgatgaacacgagcaggaatacgaacatgccgttggtggtagacagggtaccggcgctctcggcgaccttgcccttcttggccagcgagccggcgatagccagcgcaccgatgatgggcatgaagcgggcgaacagcatctcgaggccgagcatgacgttgatccagggaatgttgcagttcatgcctgcaaacgccgagccgttgttgccgccgcatgaggtgaaggcatacagcgcctcggagaagccgtgcgcgccaccattgttgagctggtcggcaagaccgggcaccatgcaggcgatggccgagcacaccagaatggcaaacggagttgcgagacacagaaccaccgcccagcgcatctcggtcggctcgatcttcttgcccaggaactcgggcgtgcggccaaccataaggccggcgatgaacactgtgaggatggcgaagccgatcatgccgtacaggccgcagcccacgccgccgaagacgacctcgcccagagcaatctggagcatctggacaaaaccgcccagcggggtgtaggagtcgtgcatggagttaaccgagccgttggaagcagccgtcgtaaaagcggaccaggtagaagaggaggcgataccgaaacggctctccttgccctccatgttgccgccggcctggccgtcggtcatctcgatattgaccgctccgccatcggccagctgcggggtgctcgcatgctcgttgacggcgatgatgccggtgaagatcaccagcaggatgaacatggcggcaaagatggccttgccctgcttggtgttcttgacgccgataccgaaggcgaagcaacaggcggccgggatcagcagcaggctggtcatctcgatgatgttggtgaaggcactggggttctcatacggatgggcggagttcacgccgaagaagccgccgccgttggtgccggactgcttgatggcgacctgaggagctgcgggaccctggggcaggaactgctcggtgaccacgcgcgcgccctcgacaaccttgccgtcgaccttgaccgtgtcgccctcaatctgggcgccgtcgatgacgctccagccgccgtctgcattaggctgaacagcgacgggttctacgagctcagccttctgagccggctggaagttggagatgacgccaccggcagccaggcagatgccgaacacgaggttcagcgggatgagcacatacaggacggtgcgggtgaggtcgacccagaaggaacccagaccctgctccttgacctgacggaagccgcggatcagcgcgaacatgaccgcgataccggtgccagcggaaacgaagttctgcacagtgagacccatgaactgcacaaggtaggacagggtggtctcaccggagtaggactgccagttggtgttggttatgaaggaagcagccgtattgaacgacaggtcccatgacacacccggcaggtgctggggattgcctggcaagaaggactgaagcgcctggagtgccacaagagtcacgaggccgatccccgaaaagaccagcacgctcgccagatagcgcctacaccccatctgttctgccgcgtcgatgcgaagcagacgatagacgccacgctccacaggagcaatcacaggcgacaggaacgtatgctcaccatccatgatatgggccatgaaccgaccgagcggaacggccaggacgacgagcacggcaaagtacaagatgtactgaatcgcagcgtccatagtttacgaatcactcctcatcagaatgtagatgtaatagataagaagtccaatgcagacgactccgatgatgggaatgaggatgtccatttaccgcccctttcacacgcggtccgatgtctcggacgcctgccctcgcaagcgtctggggacagtaaacgcttctagggattaaagaggcgtgagggccggggctcacgtccttaagatgccgtaaagatgcaggtagaaagcactattgcagctgcagtgcgcctatactcgacctcgcgagcatacagtggtgtcctcaccgcgtatgcacgcatggacaacgcttcagaaaggctacgctatgcagcgcgacgcatcggacactcgcgtcaatccagacctcatcctcaaggcaattgagaaagacgaggtcgccgatgacactcgaaccagccggggacacctcaagattttctttggctacgctgctggcacaggcaaaacctatgcgatgcttcaagccgcccacgccgccaagcggcgaggtgtcgacgtcgtcgcgggatacatcgagccgcacgaacgtccggcaactgcccatcttgcacaagggcttgagaacgtgccctgtaaactcatcgagcacaacggcattgcgctcagcgagttcgatctagatgcggctatcgagcgcgcccctcagctcatccttgtcgacgagctcgcccatacgaatgcgccggggtctcgccacgacaaacgctatcaagacgtcgaggaacttctacatgcgggcatcgacgtctatacgaccgtgaacgttcagcatatcgagagcctaaacgacatggttgcatccatcaccggcgttgtcgtgagcgaacgaatccccgaccgtatcttcgatgatgccgaccaggtcgagctcgtcgacatagagcccgaagacctacttgagcgccttcgcgccggcctcgtctaccgtcccgcacaagccgaccgagcgcaacagcatttttttaccgtcgagaacctcaccgcactccgagaaatcgcgctgcgccgctgcgccgatcgcaccggtcacctcacagacgccgcacgcgtgctgggaaaccgtgactactacaccagggagcgtatcttagtctgtgtctccccggcgccgaccaatccccgcatcgtccgtgccgccgcacgcatggcgaaagcgtttcgcagcgagctcgtcgccctgttcgtagagagcccgcgcacgcaagccatgagcgatgatgagcgcgccaagcttgcagccaatatcgccctagccgagcagctcggagcacatatggaaaccgtctatggcgacgacgtcgcgtttcagatctccgagttcgcgcgcctgtcgggtatttcgaagatcgtcatggggcgcacgggcgagcacagcagcgtccgtcaggccctcttcggccgcaaatctctcgtagaacagctcataacattcgccccgaatctcgacatttacatcattccagaccagtcgactccgccctcccgacccaaaggacgccgccatgcgctcgccctgcagccgcccagcagccgaaacgtgcttcgcacgctggccctctctcttgccgccacggcgatcggcacggctttccgccatctgggatttgccgattccagcatcatatccctctatatcctcacggccctgctgaccgccgtcaccacgacgggacgtatctgcacaatcgtatcgagcgtgctctctgtagtgctttacaacttctgcttcgtcacgcctctgttttcgctcgccagctacgaccgaagctatctggtcacgttcggcatcatgttcgctaccgctatggtcgccggcgagttaactgcgcgcatcgccgacaacgcccgtacatccgccgagaacgcattcaaaacgcgcgtactcctcgaaacgaaccagctcttgcagcaagcccatagcgcggaggagtgcgcccgcgtcgccatgaaccaactcgtcaaactgctaaaactcgacgtggtcttctaccccgccgaacacggcacgctcgacaaggcgctctatgagtccgctggcaccgaaaaccgatccgcgtcgctgctcaccgactacgagcgcgccgttgcaacctggacctacaccaacaacaagcgcgcgggcgcaagcacgcggaccctgcctgaggcgcgctgtctctacctcgcggttcgcaccggcgacaaggtattcggtgtcatcggtatcgccctggaggggcgcgagatcgaagccttcgagcattcgatcgtcctatctatcgtaggtgaatgcgccttggcgctcgaaagcgaccgagcggcgcaagagcgcgaagaggctgcggtcttggcgaaaaacgagcagctgcgcgccaaccttttgcgctccatcggccacgatttgagaacacccctcacggctatatccggatctgcggcaatccttcggaagagcgacgagaagctcagcctcgaacaacgctgcgatcttgccgatgccatctacgacgactccctctggcttatcgataccgtggagaacctcctcgccatcacacgcgtcgaggacggcaccattcgcctcaacttaacatccgagcttatcgacgaggtcatcgaggccgccctcagccatgtcgcccaagcatcgcatggacgcgccgtcaccatcgagcacactgacgacatcctgctggtacgcatcgacgtccatctcatcatgcaggtgcttacgaatctcatcatgaacgccttcaaatacacgcccgaggactcgactgtcaccatcagcgcatgtcgcgagggtgcgttcgtcgtggtggacgtcgcagacgatgggccgggtgtggcagactgcgacaagcctcatatctttgagcgcttcttcacctcaagcgatacgcggcccgtggattcacgccgaagcatcggccttgggctgtcgctctgccgctccatcgtggaggcgcatggcggcgtcatcgaggttcgcgacaaccacccccatggggccgtcttccgttttaccctgcccgccgaggagattgagattcatgaataatgccgctaagccacgcatcctcctggtcgaagatgacctgaccgttcaaaacctcgtttcgaccgcgcttgacctccacggctatgtcgtgagcaaggtttgcaacggccaggccgccatcatggatgcggtgtcgcacggccccagcctcatcatgctcgacctcggccttcccgacattgacggtatcgaggtcatcacgaagatccgaagctggtcggcagtccccattatcgtcatttcggcgcgcaccgaagattccgacaagattgcagcacttgacgcaggggcagacgactacctcaccaagcccttttctgtggatgagttgctcgcgcgcgtccgtgcgaatttgaggcgctcctcgatggcgtcgagcgagtcgacagaagcgagcacgttcgacaacggtccgctgcatatcgactacgccgcgggatacgcaacgaaagacggacgcgagctctcgctcaccccaaccgagtacaaattgctcgtccttctggcgaaaaacgtcgacaaggtgctcacccacaccttcatcacccgcgagatatggggcacgagctgggacagcgatctggcgagcctgcgcgtgttcatgcgcaccctgcgcaagaagatcgaggcagacccctctcaccccaagatgattcagacgcacatgggtgtcgggtaccgcatgcagcgtctctagcccaccccacaaaagtgaaaaacgccccgcgaacggatgctcgcgaggcgcttagatgtctgggccttacttgataccgcggcccaagtcttcggcgattttgtcgacgcctttcagcgcggcgcacgtctttttgttggagcaatgccccgtgcaaacgccaccctgagcgcagtcggcgcaggtgcccttgcggtagatgcgcacgcataccgcgacaaacgcaacgccgataacagccagtacaacaatatcgataggtgccatagcaagcctcccctagttaaccaccacttactttaccccatcctccacctaccaaaaagggacaggtttattttggtcggttttatctgcggaaacgccacatctcccccaccaaaaagcccgagtgtcgctgggacacccgggctcgtgaaaaggggctaatccttattcggacttaagcggaaactgcggcggaagcagtgttggtctcgtcctcgtcggtccatgcatgtttgggcatggggcggaagatctggaagagcatcgcaaccagcagcacaatggccacaatcgtccagataccaaattgtccaagaacaagcaagttgtagaactggttgatgaacaggccgatcacccaagcgaaggcgcactcgtaaccgatggcgatcgcagtccacttgccggaatccatctggttgcggatggtgccaatggcggcaaagcacggagcgcacagcaggttgaaggcgccgaaggcaacgcaagcgcccatggtggggaacatgccggcaaacgcggtccacaggctcgggtcggtctcgcccgcgtcggcgacggacagcagcgagccggcggtggcgacgacgttctccttggcgacgaggccagagacagtcagcgcggtggcctgccaggtgctaaagccgagcggggcgaagatccaagcgaccaggttgcccagcatggcaagcacggagtagtccataaactcctcggggatgccgtccatcgcaggcaggaagccaaaggaaccgttatagctaccaaagttggagaggaaccaaacgacgacggtggacgcaaagatgaccgtgccggccttcttgataaaggcccagcagcgctcccacacgtgcagcgcccaggaacggatcgccgggaagtggtaggcaggaagctccatgacaaacggggtcggacggccggcgaagagcttggtcttcttgagcatgaggcccgaggcgatgacggcaaagacgcccaggaagtagaagagcgggctgatccacgcggcggtggtggaagaatcgccgatgatggagcccatgagcagggcgatgatcggcagcttagcgccgcagggaataaacgtggtggtcatgaccgtcatacggcggtccttctcgttctcgatggtcttggtagccatgacgccggggacaccgcagcccgaagacacgagcataggaatgaaggacttaccggacaggccaaagcgacggaacacgcggtccatgatgaaggcgacgcgggccatatagccgcagtcctccaggaaggacagcatcacgaacagcaggaacatctgcgggacaaagccgaagatggcgcccaggccgccgacgatgccgtcacagacgagcgaatcgaccaggccaccgtcctcggtgccgcccgccacaagggcgtcgtggaccatggtggtaataccaggaacataggggccgtactgtgccgggtcgaccgagtcggcattgtcgcccgcagcctcgacggccgcgtcgtaggcgtcgcggccctgaccgagcacgtaccaaccgtcggtaccgaagagctggtcgttggtgaagtcggtcaccgtgccgcccaaggtagaaacggcgatgtagtacacgcagaacatgatgaccacaaagatcggcaggcccaggatacggttggtaaccacgcggtcgatcttctcggaggtgctcatctttgccggagccttggtgaggcactcgtcaatgatgtgggcaatcacgccgtaacgctcgccggtgatgatggactcggcgtcatcgtcgcagtcctgctcgcactgagcgaccagaccttcgacgcgagcggtcttctccttggtgaggttgatgagcttgcaggcgtccgcatcgcgctcgaacagcttgacagcgtagtagcggcgcttgttggcgggaacgctcgccggcagattgttctcgatgtggtccagaacgtcctcgatggaggaatcgaacttgtgctccggcacctggcccttggaagcagcggacttcttgacctgctcgaacagctccttgatgcccttgttcttaagggccgagatcatcatgaccggacaaccgagcttcttggagagcttgtccgtgtcgatcttatcgccgttcttctcgaccaggtcggccatgttgagggcaacgaccacgggcaggccggtctcgataacctgaagcgccaggtacaggttacgctcgaggttggtggcgtcgaccacctggacgacgacatcgggctcgccgctcatgaggtaatcgcgcgagcactgctcctcagggctgtagggggaaagcgagtagatgccagggaggtccgtgatggtaacgttcttgtcgcttaggagcttggcctcctttttctcaaccgtgacgccgggccagttgccaacgtagccgttggcgccggtgatcaggttgaaaagcgtggtcttgccgcagttggggttacccgccagcgcgacatggatctgagaatccgccattcaatccttcttccttgtgtgcctgcgctgctttctccgcgcaggctggataatgtgctttaaagttgctgcattaagttagaaaaacctaactttatctgcagatatatgcgccgcgagcccttactgaacctcgacgacggcagcctcctccttgcggatggaaagctcgtagccgcgcacgttgatctcgaccggatcaccgagcggtgcaaccttcacgaccttgaacgaagtgcccttgatgagccccaggtccataaggtggcggcgaagcgcaccctcaccgtgaagcttgacgatggtggagctctcgcccaccttaacgtcacccaacgtcttcatcctcttgtccccctttcggtttttatgaaatgctgcggactaaccgacggtcatgatgtgcatggcaaccttggaatcgataccaaagcgtgcgcccagcaccgtgacgatgatattggcgccactcgagctcaccacgtgaatttcgctgccctcgacaaagccgaggtccttgaggtggtgcttcatatcctcattgccctttacacgagacacgcgcacggtttcgcccgcttttaccatcgaaagcggcattgccggcatctgcggtccgcaagacatgagtggctcctaacgtcagttcgtcctcaacatcgacgcggtaaaagttaaccacgcctatgtttgctttagtaaactaacacgtggttaactttttggaaagggtccccattcagatttcgaaaaagtttcctatacgaaacaaaaaggcgcggcaaagagctgtcctttgccgcgccttgtcatgcttagagcgagaggtttctgatcgacgtaacgcaggaagcctcgtctacgcccgaaacgcgaaagatgatgtcctcgccgcactcgccgtagagagccatgaggcccatgacatcgcgaccgtcggtatggcggtcgccgatgctgaccgacacgtcgctacggtgcttggcaatgatgtcatagagcagcgcaaccgggcgggcgtgtagtcccaacggatctttaatcgtctttgtaaactcgaccatgtcccctcccacgacatcacacattcggccggcaaacccagccacgtggtagttattgtagcgttagatgtttatcgagggcccctccggataccccgtggtcaaaaagtggcaaatatgagtactgtcacaaatttagtagcagcaaaatcgagagcaaattgcctagcttgagcgattcgaagaggttgaaagccgtcaaacgccctttaaagggagttagataaatcgattttgagcccattttcgctcagagcaggccgaaaaatatggcacttcttttgcaacagtactcatatttggcattttttgaccacgggggccaaaaccatgccccaaaacacaaaaggaggggcctcgtaaggcccctccttaggaaagggaatcgatttattccacagccgcagattaatcctagccgctactccatcatatcgaggacggaagggcgaagctcgttctcggcggcctcgggatcggtctcgcgcaggcggttgatgtagcggttgtaccacatcacggcaaggcccaagaagacaaccacgccgccaacgttgtagaccagcgtcagccacagcggctgatcgagcggaatggtgccgcagataagcacgaagcagaagaccacaagcaggaatgcggcaacgaccaggccaaagctgcgcgaacccatgcggaagccacggggagcggcgtcaaagttcttgcgcagcataaagtaggcaagcaaaatcagcagcggtgggagcagagcggtggcagcagtcatgttggtgacgatcatgagcaggtcgtcgaggttaccggagcccagggccggaatgatcaggatggggacgacgatggcgaactgcagccaggcagcgcgggcaggaatgccgtgctcgttgagctcgacgattttgctaccaaagacgcccttggggatctcggtgaagaagaccttgatgggagcggaggtccacatcatgagggagcccagcgtggcggcgagaaggatcaagccgatggcgcgcgtagacacttccatgggaatgccaaagtgggcaaagacagcgccgaatacgtcgaagataccggtggagatggcaacgccgccctcggggatgaacaggttaaccagcagcgaagcgcctgcatacagaaggccgatggtcaggccggcgataacgacggtgcgcacgaaggccttgacgccacccttaaggtcgttaaggaacacgccgacagactcagcgccgccaacgccctggatgatccaggcaagcgtaccgaagaagccccacgcagttgcgaagttgctcatgtcgggagccatgttagcgggagtaggagccgtagcgaactcaacgccgccaaaggcagcagccagggacagtaggatgaacacggcggtcaggccgagagccgcggtcgaaccgaaggaggaaatggagccgatccacttagcgcccttggtcgaaacccacgtggcgatagcaaagacgacgatctcgataatggtgatccacagctgcgaaagctcggcgttggcaccaaagaacacgtagctcgcgtagatgatgacgttgggcaggacggacgcaaagaagaacaggttaacgaaccagtagctaaatgccgtcaggaacgcccagcgaccacccatcgaggtcttaacccatgcgtacacgccagactcggagtccttgttgaggccgacgaactcggcggtaaccagggtataggggacaaagtacaaaagcgtggcgaagaagaacgacggcgcagctgccaagccgatggccgcgttgttgttgatgatgttcttgataccgaacacggcggcgaccgtcatgcccagcagagcgaacgaaccaatcgttcctcgtttttcagagctcataagccctcccaatcatctgttaaatgtcatctaaaaccgtccgagctgcaagtgcaaacacggacggcgcacctgctaaggggaatggggaaaagggagtcaacaaagccatcccccttaacggcgcgaagcaaacgtccaggcggacgaatactacttgttggggaaggaataaccttcgactgtcacgtgcagtaccacgacgcggggatccgcggcatcggccacgacacggtaggcctcgtcaatttcgacgacggcaacgccgccggtgggaatcgtcacggtctcccccgtaccctcaaagcgctcgcgatcatcgatatcgctgtaggcgcgcgtacaggtaagatcggccttggaagccacctcaacggtcagattgccgtcgagcggggcgagcacggcatggtagcgacggtgaccgaccagatcggcagtagccgcctcgtgggcgttcacccaccaatacaccagcgagtcgccgatagagtacgccacatcgtgctgcagttcagaaacgccgtcgagtgcctgaccggtacgcatccacttcttgacggacttcatctgggcgtcgaaatcggcacgcgagttaaagatatgcatgacttatgcctccttaatgggtgccagcgcctgagccagatcggcagacgtcagcggtcgcagggacacctcaaagctgaagctctcaaaacgggtgcgataggaatcgagcacctcggaaccccaagagttcgagccaaggccgagcagctggtcgttgatgttgaccgtaaccgtgtcgtccgggacaagatcgtagacatgcttggcattatcgatagcctcgcagctatagggccatgcggagaacgagaacggattggaagcggcgtcgctcggacgcgtcacgaccagaccgtcaccgtggctggagcgcagggcgacccagcgggtaccctcgcggttggcgcagtcctggggcataacgtagggcgtgaacatgtcgtcgaccgtagtgcggtaatgaccgaccgggttggcgcgcagcgagtccggatagttctcgcccgggccgtggccataccactcgacggcacgatcacaaccgggaacctcgaaggagatgccgatgcgcgggataatgtccgaatagtcgccgtagggctcgccggaaaccttgaggtcgacgcggccactcggaagcacggtatagacgagctcgacgcgcatgccgaacgcgcggacgggaggagcgatacgctggctcacggtaacgacaaccgcattgtcatcccgcttccaagaaacattgcgggtagacgtctgcatcacatcgatgaagttatccttccacagggagtcgtactcctgggcgtggttatcgacgagcggatgccaaaaaccaacctggggaccggaggtcatgacgtcgcgaccggatgccttccactcgctcacggtaccgttgaccttgctgaaggtcagctcgccgttgagggagcgaatacgaatctcctgctcggtctcctcgaccgtaagctcaggacgagtgggggcggcaattgccggcgccggatggtttgcgatggcaaactggcttgcacccagttggaacatcggctcgcaccaggcgtgagccgccatggtgtaggcgtgcacggtcagcagggtctcgcccactgcggcctcgcgaatcaccagcggaagctggacggactcgccgggggcaaccgcaccgggcatgagcgtcttgcggcagaccacgtcgccgtccaccagggtctccgccgacaggcagacatcctcgagggtggtaaaccaacgcttgttggtgacggtcagctcgcctgcctcggcatcgtaggccatacgaaccgggcagatgacctggccgtactcggtaaggcccgggctcggctgctgccaggggaacaccatgccgtcgatgcagaagttgctgttgttggggtagtcgccgttgtcgccgccatacatgtcgtaggcaacgccgtcctcggtcacagcagccagaccgtggtcgcaccattcccaaataaactggccctggatgcaatcccagcgatcaaagacctcctggtactcggacaggcccccgggaccgttgcccatggagtgaccgtactcgcagttgatgcgcggcttggggaacggatgctcgccaaagtcgttcatctgcgaaacacgggagtacatcgtggaaatgacatcaacggtatcggcgttgcggtcctcctcgtaatggaccggacgaccatcgagctcgtgagccttggcatacattgcacggatgttgcagccatagccgctctcgttgcccatcgaccacataatgatgcaggcgtggttgcgctcctgcatcaccaggcgctcaatacggtcgacgtaggccggctcccatgccgggtcgtcggtgaccagggcgatattgccgatattctcgaagccgtggctctccatatcggtctcggcgaccagcatgatgccatactcatcgcacagctcgtagaagcgcgggtcgttggcgtagtgggacgtgcgcaccgcgttgatgttgtgctgcttcatgagctccaggtcgcggcgcatgcgatcgaggcccacggcgcggcccttgtgatcgtcgtgatcgtggcggttgacgccatgcatcttaaagtaagtgccgttgaggtagatatgattgccctcgaccgtcacctcggcaagaccctggcgatgcggaacgtactcgctgacctcgtcaccgtcgtagacctcaaacgtaaggtcatagaggaaggggtcctcggggttccagaagtgggcatcggtcacgctgcactcggcatggccgtcgatgcactcacccgtagccaccacgttctcgccatcgctgagcgtatacacgacgcgggtagcgtcctcggccaccgtatcgagcgtaatcagagcggtatcgccctcgcggtgcgtgcggaacctaaagtcgaccaggtgcgcggcggggcgctgcataaggtacacatcgcggaagatgcccgaggcccaccacatatcctggtcctcgatgtagctaccatcgctgtactgcagaaccttgaccgcaaacaggttgtcaccctcgacgagcgcgtcggtcacgtcgaactcggcggacaggcgcgagcccttggtcatgccgataaactggccgttgacgtacagctcgccatagctctcgatgccgtcaaagcgaatgatctcgcgagcgccggcaggaacggcgggaaggttgacgatgcgctggtagacgcccgtggggtcgtcggagggaacgaacggctggtccaccgggaacgggaaaccctcgtcggtgtaggcaaggttgccatagccgtccacctgccacaggtgcggaacctccacgtgatcccactcgggcttgtacgtggagagttcctcgttggagacggcagcggggccctcaaagaggcggaactgccacgagccggacagctggacaaacccgcgcgacagctcacggctgtacgttgcagcgagatcggcggtctcgtagcccataaagtacgcatggggtgccaggcggttcctgtgggtgagcgcttggttttcccaatcgttaatggcgtccatggtgatgctccttcgtcatcgtagtgattcttgtgcaaccggttgtccttatcttacgggcgatgcaaaaagctgtgcaaccggttgtccgctgaacggtcgatttgaccgggttaacggtgcaaccggttgtacaaccgcggcacttatgtcaccctgagtatcgaaactcggcgcaagacatcgttctcaagctcgtaggcaaccgccacgcccgctaatatctcacccacacgagacgtattcgatttcggcttggttgcaaaacgacaccggtcaccggatatcatgaacgctgttcaggcgcactatagtaagctgtatccgcactagcccgtatcagtgacaacatcgaccgcattttccaggagacgccatgacccaaccagttcgcaccgcacctacgcttgccgaggttgccgcagctgccggcgtgtcgcgctccacggcatcgcgcgccctcaacgattcgccccgcattagcgaggaaaccaaaaagcgcgtccgcgcggcggccaaggaagtcaattttgtccccaacgctcgtggccgagcgctcgctgtcgggcgcacggaaatcatcgccgtgctcgtgaccgagcccctgagtgaactcttcagcgaccccacctatagcgagtttttgagcggcattaccgaggagctgtcggagtcgtcctatctgcccgttatcttgcaggcgtcttctacgcatgagcgcaaccgcgcacgcgagcactttgagcgccgctcgttcgacgccgtgatcgatgtctccccctacaagggcagcgagctgctcgaggtgctgcgcgagctgggcgtacccaccgtgttgtgcggccagctcgagggtcatccctatcgcgatgtgttctcgacggtctactctgacgacgaagagggcggacgctttgcagcgctcgctatgaaagagcgcgggcgtaaggatatcgtcgccgtgttgggaccgcaagacaacctcgctgttgtcgaccgcctgcgcggctaccgcgccgtcttgtgcgaagacctcccagacgcaaacgttatctataccggctggaacagcggagacggctatcaggccatgcaccagattctcgcgcgcgagattgctttcgatggcgtgctctgcggatcggaccgtatcgcggctggcgtcatcaccgcactcaacgaggcaggcctatccgttccggcggacgtttctgtcgtcggcttcgacgatcacgagattgcgacgcgctgcgtccccgcgctcacgaccgtccgccagcccctgcgcgaagaaggccacatggccgccaacattgcgctcgatatgatcaagggtgccgagcccaccacctccgtgatgcacatgcagctaatccagagagactcgctataagatattggggcaggctttccgccagacagttgttgcggaaagcctgccccgttttgagcgctcattctggggcacagtttccgttagacagctcaaccggaaactgtgccccattattttgccaaattctgggtcgcgctttcccagaggaccccctttgggaaagcgcgacccgttctggacccagattccgggacgcactttccgcgacgcccggtcaccccatgccctcacaatctcggcgtataaaaaacgagggaaggcacgcgtccttccctcgttgcgggcaatatgtagccgctcgcctacatcaagcgcaggctgacgtccttgagctgggcgccggaaacggcactcggagcacccgacataaggtcggagccactggccgtcttggggaacgccatgacatcgcggatggagtcggaaccggtgagcagcatgcacgcgcggtccagacccagagcgaaaccgcccatcgggggcgcaccaaacttgagggcctccatgaggaagccaaactgagactcggcgcgctcctcggtaaagcccaggagcttgagcatggacatctgcatctcggcgttgtggatacgcataccgccgccgccggcctcaaagccgtccatgacaaagtcgtaggtgcacgaaccggctgccagcggatcggcctcgatcttggcgatgtcggtctcggtcggcagggtaaagggctgatgctcggcagcataggccttgcgatcctcgtcccaatggaacagcgggaagttgacgacccacaggaagtcgtgaccctcgcgcttgatctcgagcgcattggccatgtgcgaacgcataccgcccaggatctcatcagaaagcaggcgcgggccggcggcgaacatcacaaggtcgccgggctcgacgtccatgcgctcgcgcagagccgccatctcctcgtccgagaagaacttgacgatggggctgttgatggaaccgtcctcgcggaaggcgatccaggccaggcccttggcgccaaacgtggaggccacgccggcgagcttatcgatcttggcacgcgcccaggcaccggcgcccttggcgttgatggccttgacgacagagccctcctcgttcgcagcggtcgcgaagaccttgaacttggagttggcaaagatgtcggtcaggtcgaccaggtgcatgccgtagcgggtatcgggcttgtcggagccataggtgtccatggcctcccagtagttcatgcgacgcagcggcgtgggcatctcgacacccatgcgaccgaaggcatcggcaagaacctcctcgagcgcgctcatgacatcgttctggtccacgaaggacatctcgatatcgacctgggtgaactcgggctgacggtcggcgcgcaggtcctcgtcgcggaagcacttggcaacctggtagtagcgctcgacgccaccgaccatgagcagctgcttcaggagctgcggggactgcggcagggcgtagaagttacccggctgaatacggctgggaacgatgaagtcgcgagcgccctcgggcgtggacttgaacagggagggcgtctcgacctccatgaactcacggttgtgcagcgcctcgcgaatggcaaaggtaaagtcggagcgcagcttgaggttggccatcatctcgggacgacggaggtccagatagcgatagcgcaggcgggtgtcctcgctcgtctcgatgccgtcctcgatctggaacggcggggtgacggacgtgttgagcacctcggcgtggtcggtcaggacctcgatctcgccggtcgcgagcttggtgttggtggtctcctcgccacgggcgcgcacgacgccgtggatcttgatgggccactcgggacgcatggtctcggcgatcttaaaggcatcgccatcggagtgctcggggtcgaaggtgagctgcgtgatgccctcgcggtcgcgaaggtcgcagaagataaggccgccgtggtcgcggcgacggctcacccaaccggtgagggtgacctcttcgcccacgttctcgaagcgaagctcgccgcaggtacgggtgtgcatggaatgctcatcgatgggacgggtctggctcataccagtgatcctcctttatggatctgtgccgccccgtgtcgttccgggcggcgtcgtacagatttgcccagcctgcgtaaaccgcgcagccggacatggcgttctatcttatcgcacccgcgtcgatgtaccacgaaaaagtagctcttgcccaaagacttgacggagacgaaacaattgacgcaccgcggcacccgcccgcgctattcacgtgcgacaatatgccccaataaaacagcacttggaaaggcccgtcatgactgcacgcctcattgttatggatatcgactccacgctcatcaaccaggaggtcatcgacctgttgggcgaggaggccggcgtgggcgagcaagttgcgcaaatcaccgagcgcgctatgcgcggcgagctggactttaagcaggcgctcgaggagcgcgtggggctgcttgccggcttggacgagagtgtgttcgagcgcacctttgagcgcgtgacgtttacccccggcgcgctggagcttgtgcgctcggcgcacagcaaaggctggaaggtcggcgtggtaagcggcggctttcacgaggtcgctgacaagatcgtggccgccgcgggcatcgatttttgcctggccaaccgtctggaagtcgtggacggcaagctcaccggcaagctggcggcagacattgtgaccaaggagtccaagctcatccagctgctggattgggcggttgagtgcggtgtcgacatggcccacaccgtcgcgatcggtgacggcgccaacgacatccccatgattcaggccgcgggcacgggcatcgcgttttgcgccaagcccaagacgcgcgaagccgccccgtttgccatcgatgagcgcaacctgatgctcgccatggacatcatcctgcgcgactagtcgatctttctaacaagagaatcagtctgtcctatagtttccgaacaattttgtcttagtgttcggaaacataccctttgagtgctagactttgcgccgtcgaagggaacatatatggataagcgagatcttgagcaattgctgagcgatgttgccgacggagtagtcaccccggcagtcgccctcacgcgcctccagacggcgccaaccgccgatctgggttttgcgcagctcgatctttcgcgcggggtgcgccagggagccggcgaggttgtctacggcgccggtaaaaccgccgagcagattgccgccattatcaaagcattactcaatgccggccaggtgcgcatcctggtcacgcgcctggacgccgaaaaggcagcccgcgcctcgaagctcctcggcaacggcatcgacctgggatatgtcccagacgcacagctcgccctcgtgggcggcaagccctcccctaccggcaacggacgcatcgttgtcgcctgcgccggtacgagcgacctgcccgtcgccgaggaagccgcgttgacggccgaattctatggcaacgaggtcgaccgcctctacgacgtaggtgtcgcaggcctgcaccgcctgctcgcgcatgccgaggaacttgcccaggcgcaggtggtcatcgccatcgccggcatggagggcgccctggcgagcgttatcggcggtctggtgagctgtccggtcatcgccgttcccaccagcgtgggctacggcgcaaattttggaggcgtagccgcgctgctcgccatgctcaactcctgcgccagcggcgtatcggtcgtcaatatcgataacggctttggtgccgcctaccaggcaagtcttatcaatcatctgagcgccggcacatcctgcgcccgttaaggagcattccatgtccaaccatcagcacacgcttatcatcgacggcacttcgggcatcagcggcgatatgaccgtcgcggccctgctcgacctgggcgccagcgaggagcacctgcgcgaacagctcgccacgctgccggtcgacggcttttcgatcgctgtaacgcgcgtaaacaagcatggcatcgacgcctgcgactttgacgttcagttggcagaggggctcgagaaccacgaccacgacatggcctggctctacggcaacgaagcagctgccgagcacgcacatgagcacgaacaccatcatcatgaccatgacgagcacgaacacgagcacacgcatgagcatgaggcccacggccatggccacgagggccatcatcacgcccaccaccatcaccaccgctctttggcggacgtcaccgccatcatcgacggttcacagctaagcgatggcgccaagcgtcgcgccctcgccattttttccgcactcgccgctgccgaggcaaaggctcacggcaaaacgcccgacaccgtcatgttccacgaggtgggcgccgtcgactccatcgtcgacgtctgctctgtcgccatctgcctcgacgacctgggtattgaggacatcgtagtcgagtcgctctccgagggccacggcaccatccgctgcgcccacggcctcatgcccattcccgtccccgctgtcgtcaacctgtgtcaggcgggcaatatcgccctcacgcctgcaccggtcgccggcgagctcgtgacgcccacgggcgccgccatcgtcgccgcgctgcgcacgtccgagcacctgccggcccgctaccgcatcgaggccgtcggctacggcgccggtaagcgcccctacgagggttgctccggtacgctccgctgcctgctcgttgacgcggacgcataaccatggatgcccgcaaggcaaaaagccgtgccgccatcgttgcggcgttttccgagctccttcgcgaggaggactacggcaagatcaccgtcggcgacatcattgctcgcgcccatgtgggtcgggccacgttctacggcctcttcaagagcaaagatgacctgctcgctgagctcgtgcgcgacatctgcacccatgccctcgacgatgacggtacgcccctcgatgacccgctcgtacaggtcgagcatatcctcaacaacctctgggagcgccgccagggcgttcgagccctcgtagccggcgccggctcacgcgtcttcgccgactgcctccgcaagaccatcatgtcgcgcgcagccgaaaccgtccctaccgacccaaacggccccgccgccaccatggaccgaagcttcctactacaccacatagcctcaagcttcgtaggaatggtccaatggtgggcctggcacaacttccaagccccaaaagaggacgtagccaaagactacctctcagccataaaacccctcttcaactaagtaagaacctcatcccaaagcatcgccccaacccaggccgccacgcatcccaaagcgtcactcgcacttcaacgcccctaccagcaacaagcccctcccatccaaattcagatatatatgtcgggttgcttgttccaacgcgactaagatcccgcagctgtccgcatggggtaacttcccagcgcattccgcaggacgaaagaacccccgccgcacgaagtgcgcagcgggggttctttcatgtccgaggacgcgctgggaagttaccccatgcggacagcggacaactatgtagccttggactagaacatgcccaagaaaccgtgcacaaacagtgcagccagagcggcaccgacaaacggagcgatgccaggaacgagcaggccgtacttccagttgttgtcagccttgttcttgatcggcagcacctgataggccatgcgaggaccaaggtcgcgagcctggttcatggcgaagccggtgatgccgcccatgcccatgccaacggcccaaacgatcaggccgacgcagatggcgagcatcagaacgttctcgccggcgcggctagcggcagcgaggatggcgctgatgaacacaaaggtgcagatagcctcgcagaagaagttacgggcgtagttcgtaccctcggtggtggggttggtcgagaagatgttgcgctgggcaatggggtcgacgacgccatcggaagccttgaactcatcggcatacatcaaccacgcaatcacggcgcccgcaaagccgccgagcatatcggcaatcatgaagggaatgcagctgctccacggcaccaggcctacgatgcactgggcaagcaccatggcggggttcatgcacacggcgccgccaaagataaacagagcgaccgagatgccaaaagaccaggtggtgatggcaaacatgtggccggagccctgatacttggtgcccttaagcacggtatcgcagtgtacgcccacgccaaagatgatcatgagggccgttgcgccgaattcgcagaggagtttggtaagcataaaaccttatctttcttgtcggttataaacgattcgtttgggccgtgcactagtgctgcgcgacgacaacgcccaggccatcgggaatgacggcaaccttggcatcggcacccttcatctcaaaggcgagcttgagcgcctcctcgatagtgttgaccggcgtcatgtgcatatccttgagcatctggtgatcgcacaggtcggtgaccataatcacagggtgatgcgccaggatgcgggcgaaaatctggctcgtccactggtcgggcagggtctcgtccttaggacggtcgatgcaggcgcgctcaaactccgccggatcgttgtcggcgatgttgtgatagaagccttcgccaccgtgaccgtcggcgcaaccggcgacatcaataatcacgccgccctcgggaagcgtggcctcggcagagcacatgcccttcacggcctggtagatgttctggtcgagcgggtagccgccgttggtggtgatggcaatctcgcactcaacgggctcaacgccggcaaggctcttcacgaactcgcagccagcctcgtgcgccttgtggatatcgccggcaaaggagccgatgacctcgtgcttgccgttgagcaccacgttaagcacaaaggcaaggtgagccatctcggcagcggcaaacatgtcctcgctcacgtggttgtggcacaggttgccggcacgcgaatgggaatcgttcacaaactgaccgttatggttgtacatgatggtcttatagctggcaatgccgggcagcacggacttgcggctgccagagaagccagcaaagaagtgcggctcaataaagccctcggcaagcagcagatcgcaatcggccgcaatcttgttgatgatgcactcgccgccagaaggcagggtgccgatctttttcatcatgctgtcgtcagtcgcgacgtgcataacgatttcctcgttggcaacgatctcctcgccgtacttgttgacgagctcctcgtgcgtcgacggacggtgcatacccgtagcaaccagaatgcgcacgcgagcctcgggcgcagcggaatggatgtgatgcagcagaataggcatcgtcacacgcgaggggacgggacgcgtatgatcggagctaataatgacaatatccttcttgccagcacaaagctcctcgagcgaaggtgagccgtaagggttggcaagcgactcttctaccagctcttcctgcgattttgtagtcttaaactcgttttgatgaccttccatcacacccacgaagttcttatcctcgagctctagatgcaacgtcttgtggtcaaacggtagttcacattcaaacaatgacgagcgccctcttcctttcaactgacacactagataaaccgttggaaggatacgccgctcaccgaaaaacaccaccgtccaccgagtcattaacacaacgttcatatttgacccacaacaaaacggccgcgatcccaaacggaaccgcagccgcctgtaaaagacactatgggcaggatggtcaacgcaatgccgagacgaacgttcaccccgatggcatgcgcgcgtaagtcatcttgtataaatacgtcaactaattgcataaaatggcgcatggatttctagccgtaacagggtagtaccctccggagcgtgcatttttgcgagtattcagcatcgcgggataagattttggtgtcaaaagtctttcaaaaggtagatagtcctcatgactcgtcccatctggatagcatgcggcgagaaaccagccatatacgggcatcgccaaggcccaattgtcgtgcaaaagcatcaacaaaggtagcgaaagccggctatggccttatgcatcaatctttggctgctgaaaactccgttttttgcacgtcgccccaagcaccaccctcacccagcggctgattcgccaaaggtcggacatcgcagggcccgccataggtttacttttaggcacactccacaggacgcaagaagccctcgccgcactccacattaggcgcgaagcgcactttattttcatcagctttaatccctgaaaaccgaggacgaaggaacccgatgggtttccccctgaatgcattccgcagcacgaagccctttccaaacgcgcgaagcgcgcctttatttccccagcaagtaatccaccgaagaccggacatcgtaggggccgccgtttgttttctttccggcgcattccgcaggacgcaagaagccctcgccgcacgaagtgcgcagcgagggcttcttgcatgtccgaggacgcgccggaaagaaaacaaacggcggccccggacaatgactacagggctatcgattaccccgtgttctgcagacctgccgagacgccggtcacagtcgaaagaatcaggctcatgtactcggccttcttctcctcggccatctcgtcctgattcatgcgcacctcgcgaagggcgcggacctgggcgatggacagagcgtcgacgtaggggttacgcacgcgaacggcgcagccgagcacgcggcggcgctgcagcggccattcgtcaccgacgatggcaaggacccacttacgcgtgagctgcatctcggtgaagaccttctcggacagatcctggcgatcgcccaggtgcagatacatcttggcgatgcgctggtcggtcttggcgatcgacatctcgatgttgtcgataaaggtgcggaagaacggccactcctggtaggcagccttaagctggtccagatcgccaaactgctcgcaggcggtacccaggccgtaccaagcagccagattgatgcgcgcctggctccagctgaagatccacggaatggtacgcaggtcgtcgagcgactttgcacccaagccgcgcttggcgggacgcgagccgatcggcagcagaccgacctcggtcagcggcgtcacggtcgagaaccacggtgtaaagtcctcggtgttcagcaggtccagatagcgctcgtggcttgcggcgttgagcttctcggccatatcccagaacttctgcgtggtctcggtgttggtcttctcgacactcggggccgactgcaaaagcgttgcggcggcaacggactcaacatggcgctgagccagcgtgcggttgccgtaacgggcaaagatgacctcgccctgctcggtgagcttaaagaagcagttgaccgaacccttgggctgagccagcacggccttgttggccgggccgccgccacggcccacggcaccgccgcgaccgtgcatgagcaccaagtcgatatcgttcttctcggcccacttggcaatgcgctcctgcgcggagtgcagcgcgagcatggccgtggtaggaccggcatccttggaggagtcggaatagcccagcatgacctccatgcggcggttggtctgggcaaggcgcttctgcaccacggggagcgtaagcatctggtcgagcacgtcgacgcagccctcgaggtcctcgagctgctcgaacagcggaatcacgtcgagctcggggacatcctcctcgtgcgcaaaggacagatgggcaagctcaaagacgtcggccacatgctgggcgctcttggtaaacgagatgatgtagcggtgcgccatcttcttgccgtagcgcttttggatggagccgatagcacggaaggtatcgatgacttcgcgcgtcatgggctgcaggtcgccatggataccgttctcgtggatatccttgagggcgcgggcatgcaccacggagtgctgacggaactccatctcgaccatatggaagccgaaggactcgacttgccagatgatggtctggaccgggccgtaggcggcacggacggcaccgcaggcggccagcgaacgctggacgacgcgcaggtcatccaggaactcgtcggcgctgtggtacatggtgtcggtgatacggcgcacggtggcgttcagacggtcggccatgacgagcatgacggcgcgatgcggctcgtgctcggagatcagctcggcgcgggccgtgtaccgagggctcatctcgacctgatggttccacaggttaatgagctcggccgacggcttgctgtaggtggcctcgagcgtgaggttgcggccgatgtggcggcacttgtcctcgagcttgagcaccatgtgcgtaaagtacttggcggcgacctcacggctcaccttggcggtgacgttggggttaccgtcgcggtcggaaccgatccagctgccgggatggaagaacgccgggcacagcggcggcacagtaccggccttgtcgcccagcacccaatcgtcaaaacgacgatagataacggggataacgtcgaacagcgtgttatcgaagatgtcgatgatggtatcggcttcctcgaccggcgtgggcttcttgagcgcgatggggctcgtacgcaccagggcgtcgatctcctgcagcatatggcgctcgttctccaccaggtcggagccgcccagacgcggacgctcctccagcaggttggagatacggcggatcttgccctcgacggccttacgacgggcctcggtgggatgtgcggtaaagacagggtggaactcgagcttgtcgagcagctcgttggcaccctcgacacccagctcattcaccagctggtgataggcaacggtaagctcgttggcaggatcgacctcggtatcggtcgacgcaccggcctcgcgctcgcgcagctgcgccacacggtagttctcctccgacaggtttgccagatggaaaaagctcgtaaaggcgcgaacgatgacctgctgcttatcgagcggcaggctgtcgatcaaatcgacgacctcacgaaatgccacggcagtgggctcgtcggcggtgggcacgccctgctcgtcgacggcttcgtcggcagcgcaggtaccggggttgccggcattgaccacaatctcggctgtcaaaatcttgtcgaacaggtccgcgatctcgggatcatactcgctaagcacacggcgctccaggcgcaagaacagcgccagattgtcgcgcagctcctcggggatctcgatctcggcgagacgctccctggactcggcattcgagccgattcggttaacgaggcggttgaccacggcagcgacgcgcgccgcggcttcgggtacagactggttgcttaggttctcagccacgtttcctcccattcctccttctatgcacgtaacatgcggtattcattataggcgcttgagaaatactttcgacactgattgcgctttaccacacaaaagtattttctgcattgcaaaggtttttgccctaaatggtcgtatttctcggtgggcggcatacgtaaacgggggcattccgcataaaagcgaaacacccccgtaacaatcgctctccatgagcagggcacgttagcaggcccgaagctcaaaaagatgcgctacaggcgctcgcgaaccgcctcgacgacgttgtccagatcggcgagcacctcgtcatggctctgcatgtcgcgcactttgaccttgccggcggcaagctcgtcgccacccaggaccaagatgagcttggcgcctaccttatcggcttgcttaaactgggccttgagcgaacgaccctgatagtcggcctcggtcacgatacctgcggcgcgaagctcctgcgtaatggcaaagacgttctgacgcagctccttgccggcgttggcgacatagacgcacggggcctcatcggcacccaaatcgctgccaaaggcctgcagggccagcagggcgcgctcaaaaccgacagcaaagccgacgcccgccgtgggcttgccaccctcgagctcgaccaggccatcgtagcggccgccgccgccgatggagccgacgccggcgccaggggcctcgacctcaaagacagtacgggtgtagtagtccaggccgcgcaccaaggtgggatcctcgacatactcgataccggcggcatccagatagcgcttgacctgctcgtagtgctcgcggcactcatcgcacaggttgtcacccatcagcggagcctcggccatgatctcgcggcagtggtcgttcttgcagtcgaaggcacgcagcgggttgagctcggcgcgctcgcggcactcgtcacacatctcgtctgcgtgatcgaggatgaactgcttgacctgctcgcggtaagccggacggcactgggcgtcacccatcgagttgatgagcagacgaagcttggaaagatcgaagcccaggcgcttgtagaactccatgagcatgatgatgcactcggcgtctgccgccggatcgggagcgccgagccactcgatgcccacctggtggaactggcgcaggcggcccttctggggacgctcgccgcggaacatggcctcggcgtagtaagccttaaacggcgtggagccctggggcaccagattgttctcgacgacggcgcgcaccacgccggccgtgccctcggggcgaagtgccaggcgctgcttgggcttgagtttggtgtcggtgccctcggtaaagacgcgctccaggttggcaccgctgaacacgcggaacatttccttgcgcacgacgtcggtcgactggccgataccgtggacaaacacgtcaacctgctcgatcgcgggcgtctcgatgggtttaaaaccaaacggctcgaacacgccggccgcaatctgctgcatcttttgccaggcgcgcatctcggcgccgataaggtcgcgggttccctccgccttctgtgcctgcatgggcaaacacctttcttttgtatcgcgtcataggtagtggacattatacggcacaaagcagcaacgcggcggcgcgcctgaccgaacgagggtatggggactcgttcggccagacgcgccgccgcggacgaagcggacaagcggcgatgcgctttggcctacctactcccccgccacgctcgcgcgcagcttggcggcgatgggctcggatgccagcaggaacacgagcatgaccacggagcacgccaggcacacgatccaggtgctcgcaaaggagcccgagacggcaaagagcacatagacctgccaaagctcacccacaaagctcatgcccgcgagcaccgtcgaggtggcgataacggtaagcgagcccaatacgcggccactcaccttatcggcaacatggccgataacgagcgaacccacgacactcaccacggtggagatggcattggagatgttgtactgcgcaagggaaatgcccaggtcgctgacgatcagcggctggaacaggctcatgcagttgacgaaaatcgtgtagcacgtggccatgatcacgaagccggaggtcacaacgagccagccggggaagaacttacgctgctgggacatactgctccttatttaacaaacgaatagccggcgccgggcgccggtagtgcccaagattgccttgaaagacaagggcataggccttacggccatgcccgcaggcttgaaaggcaaggttgggtgctaccggtggtcggcgatatagcccaaagcgacggcggtataggccgcggcgccgagaggaagctcggcatcgttaaaacgtgccttgggatggtgctgggcaaagtgttcgtccgtgtcggttacggccgcgcccacggtaaagtacgcactcggaatctcgctcgagataagcgcaaagtcctcactcgccatggcatggaaaagcggcaagaaagccaccttgggcagcactgcgcccacgtagccaagcgacgcctgagtcatatcgctgtcgagtacaagcggcggaacatccgaaagcgtctcgatggtcgccggcgtacgatatgttgcggcaacgccgttaacgacctccgcgatgcgggtctttaggtgctccatgagctcaacatcaaagccgcgcagcgttccctcaagcacgcaggtgtcggggatgacgttggccgccaagccgccggcaaacttaccaacggtaagtgcgacttccttggccgccggcacctcgcgggagatgagctcctgaagtgccagatgcacatgcacgccggccgtgatggggtcgatgcaaatctcggggctcgagccatggccgcccttgccttgaagcgtgatgcgaaaaccgtacacgcccgagagcgccgggctgccgtagagcaccaaaccaagcggcgactggctattgacatgcatggcaaaggcgacctgaggacgcgggttctgcagcagaccgtcggcgatggcggcgcgggcaccctcaaaggtttcctcgcccggctggaacagcaacttaaccgtggcgttggcatcaacaagctctgcctcgcgcgctttgagcatacgagccgcaccaagcagcgccgtcgcgtgcatatcgtgaccgcaagcgtgcatgcagccgttggtggatgcaaagggctcgccggattcctcggcaacgggcagggcgtccatgtcgccacggagcatgatgaccgtaccggcctgctcattcgtgcagacgccattaccctgggccgcggcggcaccggcgccgacaaggcccacaacgcaggaaccatcgacgagcgtggcaaacgggatgtccatctcggtcaggcgcgcttggatatacgcagaggtctgtgggaggctattacccagctcgggcatctggtgtagatcgtgtcgccacgcagcgagctcgtctgcaaaagcctgagcttctgcaacaagaccgtcaccgatagcggtctgcgccgctgcggtggccttgggcgctgattgcggttgaagatcggacaaagctggtgccatagatgccctccagtatcgtttttgcagcaagcactttgatagcataaagtgcaaggtactactttaagggcgaggcataaaaaatgccgccccgggagggcggcgcaacaagttgtttacaattgcgggcgcggctttcgacgcaaaaaatcgaagtgagtctcgctcaagataatcgacaggaagatgagcgcgaagccggcgagcaggcgcgaggtgagcgcctcccccatcagcagcaccgagaacagcacacccgaaggcgactccatcgaaaggagcagcgagcccgtcgaggccgggacatgcgccaggccgacgttttggatgagcagagccacgcatgtgcagcccaccgagagaaacgccatcgcagtgataaagctcggcgtccacacggacagaggcgcttgggtctcgaatagcagcgacgttgccaggctcagcacgccgttgcccacaaacatccaaaacgtgatgacgttgatgtccattttgcgaccgtacttggcagtcaccgccatctggatggcgaaaaagaccgcacccgccagcgtaatgacgtcaccgatgttgaattcaacgctatcgagcgccaccaaaccaatgcccgccaagcacagcagtgccgcgcccaggttatagcgggtgagtttttcgccgctcagaaaatagctcgcgaacggcacaaggatgcagtacgtgcccgtcaaaaaagcattcttgcccgccgtagtatgtgccagaccgaccgtctgcaacgcataggccgcccacatgagcacgcccatactcaggccaacgatcaggttgcgagcgttgaaatgtgcaatgatgcgcttgtggaagacggcaaacatgaccaacgctgcgggcagaaagcgtacatagagcagctcgaacaccggaatggtgtcgagcgcatccttcatagtggtaaaggagtagccccagataatcgccaccgaaagcagcagaactttccagaacagcggcgagcgagcgccggcgccgcgggaggtgccgcccgcgcctaggtcctcgcgagcaacagggctatcgggcaagttttcgatttcgttggcagcgtattgggccatggaacatcctcacactcaaactgggcgtggtgtccgcacgcgtaaggctgcgtgccgcctcatggtcaaataaaaacgggacgcgccggacccccggcacgccccgctactgtagcaacaaccaagcaacccgtgcaatccagcccactaaagcgttttgttccgccgttctaccgaacggcggaccggccgacgctgcgcgagccgcattcacaccaatctgacgttcaatttcaagggcgcgaccagaaggtcagcgccctttcatttcacgtcaccttggcgcaaatgcggctcgctcgctgacattgccgcagcatcagcgtttacattgttgcgctagattaatttagtactctccagcttttcgatgatccagtcgttagctttgataaccggacggcggaagacgacgcccagggccagcgacggaatcaggtagctcgccaagatacccagctcaatccagtactccatatggtaggcaccggccatggcggcgtgcatggcgttgatgccgtgagtaaacggcaggaacgggtagatcgcctggaacacggggccggtcatctcgatggggaacgtaccgcccgaaccgccgacctgcatgaccagcagcacgacggcgagggccttgccgatatctccaaacgataccgtaagcgtgtagacgatattggagaacactagactcgcgacccagcccgccagcacaaactgcaggggattgtcgcactggatgccaaagaacagaatgtcgcccgcgcacacgagcgttgcctgcagcagagccagaccgccaaagaacaggtagcgacccaggtagatctcgtgcaggcgcacggggatgagctcgttgataagctcatcgtcaaccgaaaccttcatcatggccgccagtacgatcgagccgacccatagcgacagaatcgtgtagaacggcgccatagccgagccgtagttgcggatcggatagaccggcttgcgatcgagtgcgacagggccggaaagcgacacggcgaggccctcggggtcgttgccgatcattgtcttaatcatggccaggtcacccgagatcagagcgctatcaagctcgtccttaaaggcactgatcttgttcgacgcctcgcccagctgatcggaagccttgttgaccagctttgcagccttggagagacccttcgcgagcgaaccagaggcgtcggtcagaccgctcacggcgctatccaagtcacccgagataccgttcagggaatccagaacgcccgaaatggtcttcttgagttccttggccttaaccgagaacgtagaatcgtagtcggacttggctcccgagatacccgccttggcatcggcgatggcctggtcgacctcggcacgcgagttgttgacctccgccatgctgtccgaaagggactttgcggtcgccgtcagatccttcgcattgttgcggtactccacggcaattctgcccagcgacgtcgcagcggacttgaggccgtctttgagcttgtcatcgctcatctggtcggcaaggttgcggagccgatcggccatcgcatcgatatcgtcagcacgcgtattgagcgccgctgcggcttcgttgagctgagacaccgtaaggtcaacatgctgattcgcggcatcgaatgccttcgcaagctcggcggacacgttgtcgaacgagcccgcgcttccgtcaatcgccgcgtcaacggcatcgttggcggccttgagcgcttccttggaatcattgatgccgctcttggcgtgctccatcagctgcttcgtcgactcatcaacggtgcccgtctgctcgagcatgccgcccgccgatgtcagcgaatcggacgtagagctcaaaatgcccgcgagcgacgtcgcgctcgcctgaacgtcctgcaggtcctcgaccgaatcgcccagcgtagaggacagattggcgataaagttgctcacttggtcggtgctcatgtaatcgagcaggctggacaccgtcttaaggccgatggacgtgatggtcttggtaaaggtctcgttgacctggctctggacggcgctcgagcccttctcggtcacgatctgtgcgatggcgttggccttctggttctcatagaactcgatatcggcgtgcttcacgtcggtcgagaagagcgtcatcatgtctgcgctaaaacttttagggataacaacggcagcgtagtacgcgcccgacttaacgccctcaatcgccttatcacggtcgttgaggacgacccaatcgaagttctcgttgccgcgcagggtggcggttacgttttcgcccacgttgacctcgacgggaatcagatcgctctcgtagccctcatcggtgttgaccactgcaatcttaaggttgccggtattgccgtagggatcccagcttccggcgatgttaaaccacgcgtacaggcatggcacgatgatcaggcccatcacaacaaccaagccgatcacggagcgagacacgttttggacatcgcgcttaaacaggtgcaggatgtttttcatttatgcctcacctcctttagagtgcttgccaagcggggtggtgtccccgtcgtttccgcttacgttgtcaacgtcgtcggcatcttgagccttacgatgcacaccgatatgcggcagacggctcgtgggctgttcgctgtccttggtgccccgctcgctggcgttgagaccaaacatgcgacgggcagcagggatggcggccgtgtgctcgcgcatctcacggcgaaggtcctcgtccgaaagcgccgagatacgcatctgggtattgaggctcgcacggatatactcgatgttgatgagccagccacagatggcgataaccgaaatgatccagataacgagcaggatgatcttgccgttattgtcgatatcgagcaccgtcgagagcacaaagagcaggacctgcacgcctaccacggcagcaaaaccgcccttgatgtagtacgggtagcgatgctcaaacgccacggcatgatcgagcagctcgcgacggtacgaatccgaatcgagcatgacgcgcatggccgtgcgcagcgaatagcgctggcgcggcaggtcgttggactcgcagatcatgaggcccgtcgtggaaagctgcttatcaaagagcagattgaggttgagcagcaacgggcgcagctgcagaccgataaagagcgccacgatcaagaacacgcccaggatgcacaggttgaacaggtagttgaacgagtacatgccgccgacggtctcgcgcagcaggttgatgccataggtgaagggcagcagcggatgcagccattggaagaagccgggcatcatctcgatgggatacatgcccgacgagccggggatctgcacaatgacgaggatgacgccaatggctttaccgatatgcttaaaggtggtggacagcgcatagatgatgttgacgtaggtgaacgagatagcgatgccgcccagcacgaacagcagcgggttgacgcactgcacgccaatcaccaaatcgcccaccgtaacgatgatggcctggaacgcacccaggatcaccatcagcagccagcggccaaagtagccctgacgcgccgtaaagctaccgatgccctcgcggtcgacctcgagcttgtagatagcgatgagcacatagccgcctacccacagcgccagattggtgtagaagggagcgatgcccgagccaaagctcttgactggatagattgacttggacgtcagctcaaccggagatgccatgaaatctgccacgtcatcgacgtcgacgtccatgaggtcggctaactcgcccatagactcagaggtctgtagcgccgcaatgtcattggcggcggtcgcgagcttgtcctgaaccttggcaagggaggcgtcggtttgggacagcgtggtctttgcctgcttgagcgtggcgtcgagctgcgccagcgtgccgcgcgcatttgcaagtgtaggtgtcatacccgagacgataccggtcaggtcgcccgaaacggcagcaaaagagtcgagcgcgctcgaggccttcggcagcgcgttttggcccaagtccgtctgggcttggccaaggttggtcgcaccggtatgaattgcgttattgatagcgtcactggcacccgaaacagccgctgcgtcattcgccatggcgctcgactgcgcggacagaccgtccttgatgctctgaagcttttcattctgctctcgaagcaaatcgatggtcgatacaatgcgcgcgtcaatttcctcggaacctgtcgacgtgtcattggcgagaatctccaagtgcccgataacggccttattgtggtcgatcgtcgcttgaagagactcgagcgagttgtcgatacgggtggtcgtagatgtgaccgcgcccgtcagcttgccgatggcagcgttcgcagaggccgacgtcttggtgagcgcaaggctgccttccgagagcgccttggagagcgaggtgatggagttgcccgccgtggtgcgagcttcgctcagcaggtcgttgccctgggagatcgcctgcgtcagcgacggtgcctggccttgcaagccggcaagtgccgcatcagccgaggcgatagcgccgctcgtcttatcgatggcggcattcatatcgccaatcgaatcgcgcacctcgcccaaggtgtcggacgcctcggacaccgaacttgccagcgagtcctgagtctgggttgccttgtcctttaaatcgacaccggcatccttggcgataccggcaacagtcttgcctaccgtagagacaaattccgagttgatctgctcctcgatggtgtttgcaccggtatcggtaaccttgggcgcaatggcgctcttcttctcattgacgtagtacgtgagcttgggctgatggtagttgccgtcgagcatcgaaaccaggttatccgagaagttcttgggaatcacgatagcggcatagtactcgccgctctcgacgccctccttggcatcggccgtcgagtcgacgaacgtccagcccaactgatgattctccttgagctggtcgaccactttgtcgccagcgttgagctcacccaccaagtcgttttgggtgcctcgatcgttgttggcgatagcaatcttgatgccttgggtgtttccatacggatcccagtttgccacgatgttataccaggcatacagcgagggaataacgcacacgcctagggtaaccaccagggcgacggggttcacaagcagtcgcttaatgtcgcgcttaaatatcgcaaaggacacctttgcattggatagtttgctgccgagactcacgcttggaccatccatcctgtcgttaaatcgaatcgtactatcgacaaccattgtagtaggcgctttaacgtctcaaagcacaatggtgttgagttttgcgggtagcaatatactacgaagatgagttaacgtacagatgtacagtatcctaaatttcagcaggtcacaaaaccacaacccgcacaaattagcaattcaaatagtcatcggggacgttcttaaacgactagtcaaacaaaaacgtccccaatgactacttaggaccacggcaacgtcgatgttttggcaatgccagcgagcgggcgccagagcgaacaaattggcatgaaaagaggacggcatagaccttctggtcatgccgtcctctttgaatgacaagttgtcgctctggcgcccgcgcagcgtcgactggtccgccgttcgttagaacggcggaactgagggcagcgtcgagccgttacgcggtttggtaaaaccgcgtaaatacctaactacatcaagttgcaaacagctgctgcgaaggcaacggggtcctcgggcagaatgccctcgaccagcagggcctggtcatagagcaaaccggagtactgcttgatcttgtcggcgtcgcccgccttctgagcggcgacgagcttggaaaagaccgggtgcttggcgttgagctcgagcacgcgctggctcttgggcataccgtcgggcgcgccctcgggacccttctggagcaccttctccatctcgagcgaaagcgggccctcggtggtgatgcacgcgggggcatcggtcaggcgcgcagagacggcaaccttctcgaccttgtcgccgagtgcctccttcatggcgttaaagaggtcctcgttctccttggtggcgtcctcggcctcctttttctcgtcctcggtcgccaggtcaagatcaccggttgcgacgttcttgagctccaggtgacgatcctcaacctcgggctcggcaccatcggccacggccttctcggcagcctcgcgggcggcatcgtcctcgtagatcttgggcatatcagcggcaacgtactcacgcatagcctggaaggtgaactcatccacgtcctgcgtcagcagcagcacgtcatagccgcggtcgagcacgccctttaccacgggcatcttggccaagcgctcacgcgagtcgccggcggcgtagtagatggccttctgatcctcgggcatgcccttggcatactcggccagggtaatcatcttctgttccttggcagaccagaacagcaacagatcggcgagctcatcggccttcatgccatagctcgagtagatgccgtacttaagaccgcggccaaagttctcaaagaacttctcgtaggcctcgcggtcgttgtcacgcatatcctcaaggtcggcggtgatcttcttttccacacgcttggcgatggccttgagctgacggttctgctgcagcgtctcacgcgagatgttgagcgacacatcggcggaatccacgacgccgcggacaaagttgtagtagtcgggcagcaggtcgtcgcacttctccatgatcaggacgttggagctgtagagtgccagacccttctcgtaatccttgctgtacagatcgaacggcgcgcggcccggcacaaacagcagggcatcgtactcgagcgtgccctcggcatggaagctgatggtgcgcgcaggatcgtcaaagtcgtggaacgtggacttgtagaactcgtcgtagtccttctgctcgacatcggagctgtgcttcttccagatcggcgtcatggagttgacggtctcgagctcctggtagtcctcgtactcgggcgtgtagtcatcgccagcatcctcgggcttgggcttctggcggctcttggacaccatcatctggatcgggtaacgcacatagttactgtactgctgaattaggctcttgaggccccactcggtcaggaagcgatcgtaggtctcggcctcgccgtcggcatcgagcttctcgttctcgcgcagcgtcaggatgacatcggtaccgtgctcggcacgctcgccgtcctcgatggtgtagccctcaagaccgtcggattcccacacatgggcgacatcctcgccgtaggcgcggctgacgaccttcacatggctggcgaccataaaagccgagtagaagcccacgccaaactggccgatgatgtcgacatcggagccctgctgctcggcgttctcggtcttaaactcctcggagccggaatgggcgatggtgcccagattgcgctcgagctcctcggcggtcatgccaatgccgttatccgagatggtaatggtgcgggcgtctttatcaaaggagacgcgaatggccaggtcgccctggttgatcttgacgctcggatcctgcaggctcttaaagttgagcttgtcgacggcgtcgctcgcgttagagataagctcacgcaggaagatttccttattggtgtagatggagttgatcatgaggtcgagcagttttttgctctcggtcttaaattgacgcatgtgcagtcctttcgcgctacccccgtccgcaaaaacggcccggttgcccgagccgcatcgcagacctgctatgttcagacttagattttataacccaatagcgcgcatatatacatacggaatcgaaaaactgtatgtccgagcgctccaatgcgtcaattgccaaggagtgtccccagctgccggcagaaaaggaacgtccctatctgccatctacgcgcttggccatccagacatggggctggccctcgtcttcgtaatctaccggggcaatttgcgtgtagcccgcctttgcatagagcggcaacacgtattcctgcgcatgcagcttaataagcttagcgccggcatcgcgtgcacacgaagcactggcctcgacgatcgcactcgccagtccgcgacgacgcatagccggcagcacggcgacgcgccccataatgtaggcctcccccgccgcaacgccttcgtccatgtcgcatgccggcaacaccggggcctctgcgtcagccacgcgctcaagctcctcgggaaacacgcgcgagcaaccggcaagctcgccgtctacatagagcgtcacatgaatgcagttctgatcctcgtcgatagcgtcgaactcattctcgtagccctgctcgtccataaaaacgacgcggcgcaccaacgccgcgtcatcaaagcatcccgtcttaagttggatatccatggctgccctttcattcaatgcgaacgttagggacagatattagcgaaaatgagctccgcgcacgctaaacttcgcgcgagccttcgccaggcagtcgtaatgacccacgttatgggcatcgctcgcgatgaagctgtacaggttctgatcgaacaggcgctgtgccggctttttttcgcgaccaaagcgaccgccggcaataaagtccgccgaagcctgcagcttgcagcccatatcgaccaggcgctccgccacgcttacatccttttgaaccgcacgatagcgctcaggatgagcgatgatcacctggtagccacggcactgcaaatcgtaaatcgtgttctcgtactctctaaacgcatacgcatcggcatgcgtcgaaagctcgagcagaaactcgttggttccatcgaaatgcaagtgctccgcggcatcgataccaagttcaacgagctttcgatggttgacctcgaagcccatctggagcggaaaaccgtcagcgttatcacgcagcagttcaaaggcatcccacatcttgtcgtaatcaaaatagggatcacggcagtgaggagtgcaaacgattctggttacaccggcccgcttggcagcctcgagcatcgccaagctctcatcgagatcggcggcgccgtcgtctacacccggcaagatatggcaatgaatgtcacgcataggtcagccttaatcaactaaacgtttgctcggttggtgaagatgccctttttggaagtcccctgatcgtccgagcccttcttcaccttcttaccgtccttggtgtagtaggagtagtagtactcgctggtctcggtctcgcagtagttcataacggtaccgatgagcttgaccttttcggacttcttaagctggccgatagcgttgagtgcctcctcgcgcttggtgaagtcctcgcgcaccacgaacagcgtaccgtcggtcaggctggcaatctcggcagcatcgatgaaggtgccgaccgggggagcatcaaagatgacgtactggaacttggcggacagtgcctttaccaacttggcaaagcggtgagagacaatgatgtcggcaggattgggaatatgcggctcggcatcgaggaagtagaagttcttctgacccgtctcgacaattgcctggtcaatggagatctgctcggaaaggaccgcatagagtccgccgcgcgaacgaacgccgagcatatcggaaagggacctgcggcgcatatcagcctcgaccaggagcacggacttgccgctcgtggcgatagcctgggcaaggttgatggaaaccgtagacttgccctcgttgggaatcgaggacgtgacggtaatagtgcgaatggggtcgtccacgctcgcaaagcggatgttggccagaagggtcttggcggcattctgtacaacgagcttatcggtgttctttgccttagccatgcctatttaccacctttcatagccggaattcggccaacaacgggaatgcccaggagctcttctgcctcttcggcaccgcggatgcgggtattgagcatgtctgccaaaacgacataggcgactgcgataaagataccggcgaggaacgcgacagcaacgtacagcatacgcttgggaccgctgggggcttcgggggtcttagcctcgtcgataacgttgatgctctgggcagcgccgacgttctgagcgaccgtactcaccgagctggccatggcctttgcgaccttagccgtctccttggcatcggtgccggtaaccgaaagcgtaatgacacgcgtggtggtctcggaggaaacagacaccttgtagtcatccagatcggtgaggcccagttcattggctgcgccgctcttaacgctatcgctatccagcagcgtggcgatatcgttggaaagcatctgactcgccgagagatcgttgtagctcatctgaccgctatcgtcggtcttggcgagaatgtacatgctcgtcgtcgcggtataggtgttgtccatcgcaacgaaggacacgatgcccatggcgatcgcgcagaccaccggaagggtgatgaccagctgaaggtgcttcttcagcagctggaacagttcgagaagggtcatgcagcttgcctttcatttccccagttcggattgacaaaactgtccgtatgttatcgcatctttttaccgagaccaaactctatacataagaaacaggctctcctgtaaaaatgtcggaagcaatcgtaaaattgcacaacaacgccgcacccgaaagtcaaatgcggcgtctgcatcaatatctatgttatatcgctatgcgaatggctcgtcctgctgtatgggaaacgtcaccgtaatggtggttcccacgcccaactcgctcgacagatcgagcgtggcgtgatgatacagggccgcatgcttgacaatggcaagccccagaccggttccgccgcgtgccttggacctactcttgtccacgcgatagaaccgctcaaataccttgccctgttcttcaggcgcgataccgattcccgtgtcggcgaccgcaaggaacggatggccttcgtcgttggtgccgcactgcagcgtaaccgtaccgccgggtcgattgtagcggatggcgttgcttgccagattatagatgagctcgtcaatcaagcgcgacacgccctcgatgaccacaggcttggtctcatgacttatcgtcacattcgcctgacgggcgacctgttcaagacgctgctcgaccgcgtagatggcacgcgagagctcaataggctccgtggacccaatgggcaccgcctcgccctcagctgcacgctcggcctcgtccaagttagacagcgtaaggatatcgttgacaagcgctgccaagcggcccgcctcacgatagatgcgaccgccaaagttgcgcaggtcgccctcgccctcgaccatgccgtttgcgatgagctcggcatagcccgaaatcgccgtaagcggcgtcttgagctcatgggtgatattcgccgtgaactcgcggcgcatacggtcgttgtccgccagcaccgccatttggcgcttgagctcctggcgctgcgactcaatacgctcaagcatggggaccatctcggcataggcgtgctcatagctacggcgtgggtggtccaaatccacctcttgcaaaggcgcgatgatggcacgggactcgcggcgcgccataaaaaacgagagtaccgcacccgctgctgcgataagcagcatcggcgccaccatcgacagcaaaatcgccgcaacgccaggctgggcctgcgccaagcggacaacctggccgttatcaagggcgacggcgcgatacagcataatctcgtcgagcgtagagcttgcgcgctccgcggaacccgaaccactctcaaaggcctcgatgacctcggggcgatcgccatggttgggcagtgtggaaggcggcgcctcgttgtcgtaggcaaccgatccatccttgttaatcagcgtgatgcgcaagtcctctcgatcgaggctacgcaagaacgggatgggctcctgctgctcgtcgagggcggcagcaatgagctcggtttcttgcgccaggttggcactcgtggcatccgccaaggtgttttgcacaaagaacgcacccagcaccgtaaacgccacgataaccgccatggcgcagacaaagatcgtcacaaaaacgcggtgcgacagcgtatgttttccctggggggcgaagaccacgggttactcctccgatgcggtggccgcggtgtcgtcaccttcggcaccatcaccggcagaaggctcggccaagcggtagcccacgccgcgcacggtctcgatggcgctggcatgctcgcccagtttttggcgaagcgtctgcacgtgcacgtcaacggtgcgcgaaccgccgtcgaagtcccagccccacacgctctgcagcaacgactcgcgggtaaagaccacgccgggcttgcgcatgaggtactcgagcaggtcgaactcgcgcagggtgagcttaagcgactcgccggcaacagtcacctcacgatggctgggcgagagcacgatgtcgcccacgctgagcacatcgcttgcctgtttgaccatgccgccgcgacgcagcagtgcgcggcagcggctggcgagctccatgagcgaaaacggcttagtcaggtaatcgtcggcaccgccatcgagcgccatcaccttgtcgagctcggtatccttggcggtaagcatcatgatgggcaccgtcgccgtcaggcgatcggcacgcagtcgacgcataatcgccaagccatcggtatcgggcagcatgatgtcgagcaggacggcatcgggtacccgtcgcgccacggcagccttaaactcaccgtcgcacgaaaagccttcggcctcaatcccctgcttgcgcagcgcatagaccgtcaaatccctgatgttgtcatcgtcctcgacgtaatagatcatgttgaacccctttgcggccggcatgaccgcatcttaaccctaaaggtacctttactagatggtatcagccaaaacgccccgtcaaataatccgccgtgcgcggatcggtcggattcttgaagagttgcgcggtgggcgcgtgctccaccagctcacccagcaaaaagaatgcgaccgaatcggagatacgcgccgcctgctgcatattgtgcgtaacgaccacgagcgtgcaggtctctttgagctcgcaggccagctgctccaccaccagcgtcgatacgggatcgagtgccgaggtcggctcgtccatcagcagaatgtcgggctgcacggcaagtgcgcgggcgatgcacaggcgctgctgctggccgcccgaaagacccagacccgactctttgagcttgtccttggcctcgtcccacagggcggcgcgtcgcagggagtcttcgaccagctcgtcgagcacgacgcgatcgcgcacacccataccgcgcggcccataggcgacgttgtcgtagatgctcatgggaaacgggttggggcgctggaacaccatgcccacgcgctggcgaaggcggcagatgtcgtagtcgcccaggatatcttgaccatcgagcgcaatcttgccctcgattcggcagtccttgatgccgtcgttcatgcggttaaagcagcgcagcaacgtggactttccgcagcccgaaggcccgatgaacgaggtaatctgcttgtcgcggatcttgatattcacgtccttgagcgcatggtggtcgccatagaacaggtcgaggccctcaacatcgattcgcgtcggcgaggcggcaagatcctctgccgtggggcgagtcgcatccccaacctcgcgctcgtgcgcggcctcggcctgcgctttcatgagttcttcaagctccgtgggctccacagccgcagcagccgtcataccgcatacctccacatcgatatcaattcagcagtatcgatagtaggaatcgcggctcatatgcacgtgagcgcattgtcaagtgtttgtaagggcacgctggctatgcggcgggcagctcgatggtgaatatcgtgtgttcgggcgtcgattcacatgcaacggtaccgccgtgcgcgcatacgatctccttggcgatggcaagccccagtccagcgccgccgcgattggtcgcacgcgccgcatccaggcgatagaacttctcaaagatcaccttgagcttagccgcagggatgggatcgccctgattgataaagcgcacgcgcacgccaccgccgtcccggcgtctggcctcgatcgtgatggtcgagccctcatagctataggcaatagcgtttttcatgatgttgttgaacacgcgagccattttgtcgccatccacgagcaccgtcaggtcctcgcgaatatcaacttggacttccttatgctgctcgttgaggatgggatagaactcgtcagtcacctgagccagcagcaaccccagatcaacatagccgcgcgtgagcacgatatcgtggaagtcaaaacgcgtgatatcgaagaactcttcgatgagcgtatcgagccggtgcgccttgtcgagcgccacgcccgtaaagtgcgcacgttgctcaaccggcagctcgggagcctcttgcagcagcgaaagatagcccaccacactggcaagcggggtgcgtaggtcatgtgccaagtacgtgaccaaatcgtccttgcgatgcgactcgtcacgcagagcttgctgcaccttgcgctcacggtcacgcacgcggttaagggcgccctcgacctccaagaagtcgccgtcgatgttatcccaggtgtcggggtgatcgatcaggcgatcttgaatacgagcggccagcacacaatcggcatgctgctcgccctgctcgtagccctggtagtacagggcgcggccacacaagaacagcacgcacgctgcaagcgccagcacaaagccaagcatgttgaatacaaagccggcatcgaacagcaccggcccttcgatgccgccgagcgccatggcgccaatcgccaacgtcatggcccacgcggcgccgccaatcaccacgcagcggcacacgatctcaaatcgatcgatcagcaaaaagccgacaagcagcaccgccaagattccgacgatgttgtcgatgccaatcagcagcaggctcagcaaaaagagcagcaccgttgcaagcgcgcggttgtcgacgaccgacctcacgtattcaaagagccgatcgggcacctcgaacgcttgcctatcgtcttttgtcatatcaagatcctcacaagcgaaaagcgttattcgatgatgtagccgacgccccagacgtttttgataaagcgtggcttttgtgcgtcgtcgccgatcttttcacgcaagtggcgaatatgcaccatcaccgtattgttggagccgggcataaaatcctcgttccacaccgcgcggaacagatcctccacggccaccacactgccgcgatgctcgaccagatacagcaagatggaatactcgatgggcgtgaggcgcaccggcgcaccgtccaccgtcacggagcgagcgtcacggttgatctcgaggccgtcgaactggatggtcggcgactcggccgcctgtgcacggctaccgtagctggtgtagcgacgaagctgagcgtgcacgcgcgcgatgagctccagcgggcggaacggcttaaccacgtaatcgtccgcgccaagcgaaaggccctcgatcttgtcttgctgggcatcgcgcgccgtcagcatgatcacgggataggtatggctggaacggatcgtacgcagcagctcaaagccatcgatatcgggcagcatgacatcaagcagcgccagatcgaactcctgctccaaaatcgccttggcagcatcggccccgctataggcaatctggacatcaaagccctcttttgtaaggtagatgccaaccaagtcggcgatggccttctcgtcatcaactaccaaaatgcgctcgttcatgcgtgctcctctcgcgctccattatgcctgaggcgacgcacgccacacacaacaagcgtgggtgattaagtcggccttaagcacccttgtgcccgttcgggtgcggatgtgggccaagcgcgcacgcgatgatcgccgacgccggcaaacgatatactctagtttcagaagagaccatcccgtcgaaagcgaaatctgtgaagtccctcacctcttttgcaaagcgctcagcccagcttgccgccggctttgtctgcgctatcgcccttgccgctggcgcgcccaccgtcgccggcgcccaagtgctcacgaccgacaatgtttgcggcaaaaccgccgatgcgcgcggcatcacggccgaaaacctgcccgatatcgatgcgaccaatgccctcgtcatgggcaaagacggcaccgtctactatgggcgcggcgccgatgagcaggtcaagattgcctcgatcaccaaggtcatgaccgcaatcctaaccgtcgagaattgcaagatggacgagaaggtcacggtgagcaacgccgcagccaccgtgggtaattcgaccgccggcttgctcgaaggcgacgagcttaccgtggagcaggcactgcgcggcctgatgattccctcgggcaacgacgccgccatcgtgctcgccgaatatgtgggcaagaaaatcgaccctaagaccaaagacgccgaggccacatttgtgaaggccatgaacgagcgcgctaagaagctcggctgcaccggtacgctttttgaaaacccgcatggtctggactttgatgagtgggctggcgatatgcactcaaccgcacatgacgtggcgctgatgatgcaggaggccatgaaaaacgacacgatccgcgaggtcgtagcgagcgaggattcctggatcgaggtcacgggcgccgacggcaccgaccattcgcattccatggacacgcataactatttgctgggccaagatggcaacatcggcggcaagaccggcaccaccgacgacgcgggctattgctttacgagcgcctacaaccgcgacggcgacgagatctacaccgtcgttttgaactccaccaccaccgaccagcgctttaccgataccgcaacccttgccaattggtactacggccacaaggtcacggtcgcgatcgccaacacgcaggaaaagaccgccaacggcaacccgcttatggcacgcattagccagacagattggacggacaagacgatcgacgccacgctcgccgaccccacggcgcaagcgaccgtgttttcccttgccggcgaggtgaccgaaaaggttagctacgacgatctttcgggcacggtgcatgtgggcgacaaggtgggcagcgttacgctcaagcaggacggcaccaagattgccgtcgtggatttggttgccgacgaggaaggctcggggccgaatcccattgagtggctccttgtgaagctcgaccgcctgggccgccgcatcgacaaccgcccacttgcggcagagagcgagaccgtagccaaggcacccgaggtgtagggcgcaagaataataagtccactgaaaggaggcgtccgaaaggatgcctcttttttgagggttcgaatccccagctaacattcttctaattaaaaaagggccccaaatgggacccttctttaaagttaaactggcggagagctggggatgtccgggcatgctacgcatgccctccggcttcaaagcctgacggcttttcgcccacgggctacaaacgctctcgcgtttgcttaacgcccgtgccctctcgggttcgaatccccggcttataggacaaaatgtgtgtcccgatagaacatccgtttccatccattaatctgccaaggttggggtcgcgggttcgagccccgttgtccgctccaaacgcaacagcccggctactacggtagccgggcttttttgtatccatcgcatgggctcgaacccgagagggagcgagcgttttggggcgtggctgtggcgttgtttgccgcgaatgtccgctttgggcgtatcatcgtgggcatctcgcataacctcgttgcaagggagatacgccccatggctacagaaaagtcttcttcgcgctcatggatgtccgacgctgcgatctatcagatctacccgcgctcgtttaaggattcgactggttcgggtctgggcgatatcgcgggcattacccagcagatggactatcttgagcggctgggtatcgaggccatctggctgagcccgttttacccatcgcctcttgtcgatggcggctatgatgtggcggactactgcgatgtcgacccacgtctcggctcgcttgacgacttcgatgacatgatcgctgcggctcacgcgcgcggcatcaaggtcatcgtcgacatcgtgcccaaccattcatccaaccagcacccctggttcaaagccgctcttgccgccggccccggatctcccgagcgcgcccgttatatcttccgcgatggttgcggcgagcatggcgagctgcctcccaccaattggaatgccaactttggcggccccgcatggacgcgtgttgcggacggtcagtggtatctgcacatgtttacgcccgagcagccggactttgactggtcatgccctgaggttcacgcgctcttttgcgacgtcctggcgttttggagcgatcgaggcgtcgacggctttcgcattgatgtggcgcagggtctcgccaaggatctcgaccgcgatgacctcgaccggtggcatctcgccgagggcgatgacatggttgacgacggcacccatccgctgtgggaccgcaatgaggtccacgagatctatcgcgagtggcgccgcgtgttcgaccgctataatccgccgcgcagcgccgttgccgaggcgtgggtgttgcccgagcgccagtatctctacgcgcgtcccagcgagcttggccagacattcaactttgagtttgccaaggccacttggacctatgatgacatgcacactgcaatcgagaagggcttgaaggcagccgtcgaatccgattccgcctcgacctgggtactctccaaccacgacgtgccgcgcgtggcgacacgctatgccctgccgcaaatcaaggcgacgcgctaccaccagattgcgctcgactggctcttacgcgacgggtcgtcttatgacgaggaccgtgaactcggcgagcgccgcgcgcgggcggcccttttgcttgaactggcgcttccgggctcggcatacgtgtatcagggtgaggagctcggcctttttgaggtggctgatatcccgtgggctgcactcgaagaccctactgcgaccaatacgcacggaccgaagcgtgagaaggggcgcgacggctgtcgtgtgcccctgccgtgggtggcggcggacgatcccgcgcatggcggatcgtttgggttttcgccggcagacgccgatgcggcgccccatctgccgcagcctgcatggttttccgattatgctgccgataaggaagaagcggacccgacatcgatgcttgcgctctatcgtgacgccctctggctgcggcgcaagctgcgcgggtgcgccaacgatcttgcgtggctcgatcttgacgggcgcaccggtcttgcggatggtgccgagggcgctgagggcggcgtcatcgcctatcgccgcgataacggctggacgtgtgtgacgaacttcggtgcagcacccgtggagctgccggcgggcagggtcctgctcacctcatcaccgctttcagacggcaggctcgcgcaggacagctctgcctggatcatgctcggtgatatgtaggggcatctcgctgcgagcctgcgtttgttcgcgcctttcgtgacgactgatgccctcgcgagagcgtcgcaaaacttttcaaaaaaagttcttgcataggatgcgggcatcacgtaagattaatcctcgtaagcggacatggctcagttggtagagcacaaccttgccaaggttggggtcgcgggttcgagccccgttgtccgctccatttgggcgtttagctcagggggagagcgcttccctgacacggaagaggtcagaagttcaaatcttctaacgcccaccaaatgttcgcagctcagaggctatgtcctctgagctgttttgttttgctaccaagcacgccgtcaaatatgccagcaaatattgatccaaggtccccgtagaggtgccggcaggttgcatacgtcctggccgaccgtgaccgcaacatgttggtcaagcataatcttttggattcttttggcgtgagcggcttggttttggtaggatttgtcagcggcttgactaagggggttttataactgccatgcaggtagccgtgttggtaacgttttaccgacttgccaagaacccctcataattaatgcgtctgcaaaatgactaattgctttgacctgctgaaacactatatgttgtgtttgacctaaaaaaagaatacaggatatagatgcctctttgtcgtatgatagatggcggacagagaacgaggaccttattcgccccatttggatggatcttcgagccccttgattggctgcgaggattgtccgcatgagggcctatggttttcgaaaacacagattgcgcgacggcgccgcaagacaggggcaagccctgccgggcatcgtttggctctgaagcgcaatacgatttcgacgcgaaagaggcaagaggatgaagatcatcaagcgcagcggcaccgaggttgtctttgacatcgataagattgtcaatgccatccgcgccgcaaacttggaggtcgaggagagctctcgtcttaccgaccgccaggtggtttacgcggcacaaaacgtcgccgaggcatgcgagaacgcgggccacaccgtgtcggtcgaggagattcaggatctggtcgaggacgagattatgcgtctcgactgctacgaggtcgctcgccattacatcatctatcgctatgttcagagcctgaagcgccagaagaacacgaccgacgacaagattctgtcgctgatcgagtgcaacaacgaagaggtcaagcaggagaactccaacaagaacccgaccgtcaactccgttcagcgcgactatatggccggcgagatctccaaggacctgacccagcgcgtgctgctgccccaggagattgtggatgctcacaatgagggcctgattcacttccatgattcggactactttgcccagcacatgcataactgcgacctggtgaacctggaggatatgctccagaacggtactgttatctcgggcacgctgatcgagaagccgcacagcttctcgactgcctgcaacatcgcgacgcagattatcgcccaggttgcttcctcccagtacggcggccagtctatctcgctgacccatcttgccccctttgttgaggtgagccgtcagaagattcgcggcgaggttgcccgcgagctcgatgagcttggcgtctctgcgtctgccgagaaggttcgcgaagtcgttgaggaccgtctgcgcgatgagattcgtcgcggcgtccagacgattcagtatcaggtcgtgacccttatgaccacgaatggccaggcgccgttcgtgacggtctttatgtatcttaacgaggcccgtacgccccaggagaagcacgaccttgccatgatcgtggaggagacgcttcgccagcgctacgagggcgttaagaacgaggccggcgtttggattaccccggcattccccaagcttatctatgtactcgaggacgataacgttcacgaggattccccgtacttctacctgacccagctggctgccaagtgcaccgccaagcgcatggtgcccgattacatctccgagaagaagatgcgcgagctcaagctgtcgaagggcgagaccgccggcaacggcgactgctacacctgcatgggttgccgcagcttcctgacgcccgaccgttcgggcaacggatttaacaacgtggccaacgcgctgaactatgacccgaacaagcccaagtactacggtcgctttaaccagggcgttgtgaccatcaacctgcccgatgtcgcgctgagctcgcatcaggacatggataagttctggaagatcttcgacgagcgccttgagctgtgccaccgcgccctgctgtgccgtcatgagcgtctgatgggtacgctttcggatgccgcgccgattctttggcagtacggcgccctggcgcgccttaagaagggcgagacgatcgacaaactgcttgtgggcggctattccaccatcagcctggggtatgccggtctgtatgagtgcgtcaagtacatgacgggccacagccacaccgagaaggagggcacgccctttgccatggcggtcatgcagcgcatgaacgacaagtgtgcggagtggaaagccgcgagcgatatcgatttctcgctgtacggcacgccgttggagtcgacgacctacaagttcgccaagtgcctgcagcgtcgttttggcattatcccgggcgtgacggacaagggctacattaccaacagctaccacgtccacgtgtccgaggagattgatgccttcgacaagctcaagtttgagggcatgttccagcagctttcgccgggcggggccatttcctacgttgaggttcccaacatgcaggacaacctcaaggctgtcattcgcgtgatgcagtacatctacgacaacatcatgtacgccgagctcaacaccaagagcgactactgccaggtgtgcggctacgatggcgagatcaagattgtcgaggacgatggcaagctggtgtgggagtgccccaattgcggcaaccgcgaccaggagaagatgaacgtcgctcgtcgtacgtgcggctacatcggtacccagttctggaaccagggccgaaccgaggagatccgcgaccgcgtgctgcatctctaataaccatcccaggccgccccgtagcgaggccccggacctttactcgctatttcggacagtcctggctcacgacggaggcgccactggcgcctcctgttcgtgcggaactcatatcgagcaaaggtccggggcctcgctacggggcggccaagttgacgtagctgagatgcggcatgcggtctgctcactcctcgaagttcttagcggaaataatttgagctgcagctgcgatttacttgcgatggcggttgagccgcaacccagtttttattagatctcgaaccctatgctcgatgttcgcttcgttcattgagttaccctttgcatgaggccgggacatatcgtcccgcccgcagtttcgcaggccgcaggccgagaatgtttgaggacgggatgatatgtcccggcctcccgggagagttacctatgaattacgcgaacattaagtatttcgacattgctgatggggaaggcgttcgtacttctctgtttgtgagcgggtgccgtcgtgggtgcaagaattgctttaactctgtcgcgtgggactttgctgcgggtgagccgttcgatcgtgccgtcgaggacaagattatcgagagtctcgatcatccctttatcgatggcctgacgattctgggcggcgagcctatggagcccgagaatcaggcggggctcgttgactttatcgaacgcgtgcgtgcggcctatcccgcggggtcgggcaagaccatttggtgcttcaccggcgacgtgctcgaggagcttatgccgggtggtcgtcaccataccgaggcgacggaccgtatccttgcctgcctcgatatgttggtggacggcccgttcgttcaggatctgtacgatatctcgttgcgctttaggggctcgagcaatcagcgcgtgattgatatgaacgccacgcgcgcccgtgctgtgcgcgagggcgttgcgctttgcgacgctgtggagctttggcgggacgatccggtctattcgacccatactatgtagcttgtggccgatgccaaagggcgtggtaccatagcgcgaacgtgaaatcggaaaagtgaggcccagatggtcgatcaggaaaaagtcgaggccgccattaagctgttgcttgagggcataggcgaggacccaactcgtgagggcctgctggagaccccggcgcgcgttgcccgtatgtatggtgaggtcgccggcggtatggatcagagtgccgaggagcacctgtccaaaacctttgccgtcgcttcgaacgacttggttattgagcgcgacattacgttttactcgctgtgcgagcaccatctgctgccgttttatggcaaggctgcgatcggctatatccctaacggtcgcgtggcgggtctgtctaagctcgctcgcacggttgaagtctatgcccgtcgtctgcagctgcaggagcagttgtgtgcacaggttgccgatgccctcatggaatatcttgctccccaaggggcgattgtgctgatggaagccgagcacatgtgcatgacgatgcgcggcgtgcaaaagcccggcaccaagaccgtgacgctcgctcgccgcggcgtctttgagaccgatcccgcgctcgaggagcggttctttaggatgctgggccgttagcatgagggtcgtcaacgactttacatcgaagaccgacgaggggacgtcgcgtcgcggctttatggcttcgggcctggccccctttggtgccatgcctcgtattgattacatttgtgccaacgggctgttccggcggcacctgggcaacattgcacagttggaatcggggcgcatcttctgccgccatggtattgaccatcttctcgatgtcgctcgcattatgtggatcaagaatcttgaggaacagctcgaatttgaccgcgaggtcatctacgccacggcacttcttcacgatatcggcaaagatgaacagtatgaatcgggtatatctcatgatgttgcaagcgaacgcgtcgctgatgcgattctcggcggcatgcccgatgacgtggcgtttgagccggccgatgccgcagccattaagacggccattctgggccatcgaaagctgcgcgtgaacagccaaccgcttgagcgcctgctctatgcagccgacaaagcgtcgcgcgcctgctttgcatgccccgcgcgcaatgcttgcaactggagcgatgataaaaagaacctgtcgattcgcgtgtagttagtttgcgcggtcggggtcctaaacgaaggagacgatcgcgatgagcaataagaaactgcccgagaatgcaaccaagactgaaggtgccgagctcgcccgccgtggaaggggcgaaatatccaccgcaacggcggtaccccacgtgagctatgacgatctgcgccatgccgaccacatcaccgttgaaggtcttgaggtttttgctaaccacggcgtatatcccgaagagaacgcgctgggccagaagttcatcgtgtccctggtgctctatgccgacctgcgtgcagcgggggagcacgataacctggacgcctcgattgactacggctcggtatgccacgatgtcgatggctatctgcgcgagcatacgtttaagctcatcgaggctgcagccgagggtgtggcccagatgctgctacgtcgttaccccctgctgcttggcgtgcacgttaagctcgataagccttgggcgcccgtcggtcttcctctggcaagctgcggcgtcgagatcgagcgcgtgcgctaaccggttctaatacgtctctatgggtggctgcttgagacgctgcgacagcgctctattgttggggcagtacgtgtcgagcagggtgtgaaaccgatgattgtggcttggctcgagcaagtggacgagctcgtgggcgacaaccatgtcgaggcattcgacggggtaagcggcaagttctcgtgcgatgcgaacggcaccggatttgggcgtgcatgagccccaacgcgttttcatgctacgtacggaaacgcgggccacggtgacgcccattgcgatctcgtacgcgtgcaccatatcgcgcagcgccgtggtgacctcggatgcatagagctggtcgatgcgggtctggagctcatcggacgtcaggccgtcgaggattgcgcaccgctcggcttgtgggcgttcgtccgatttgtcggcacccataaaacttgcgaaggtggcctgcttgggccgcggtgcgggtgatgcaaagttgtggtcgagcgcatcttgtaccgttatgggcttgccccaaagtgcaatgatggacgaggggctgagcggctctcgcgccgttgcctgacgttgctcgcgctgggcaagtcggctgataatccaggcgctgttgcgcttcacaaacgcttcgatacgctcgcggctggcgtcgagcggtgcgctggcgtggacctcaccgctcgatgtgacgcgtaggttgaagtttttgacgcgctttttggtaacgacgacggggatgggcgtcccatccggtcgggatacggaaatcgtaaactgctgcgtcaaaagtgatccttcagattggggacgggccggcatgtcgaccgttcggcatgccggcccgctcaaggggtgtgaaattaataacgctcaaagaaggcaagcgcgttgtcgctgcagagcttttgcatcacggtcttgccaaaatgcttggagagcatgttctggaactcgggcatcttgctggcatcggagaggaaagcgggcaccgtggcaccgtcccagtcgccgccgagcgcgatgacgtcctcgccgcccaggtcgagccagtgctcgatatgtgccgccagctggtcgaaggtgacgtctgcggcggtcttgtcggttgcgtcgttggataggaactcgctgcagtagttgaggccgacgatgccgcccatgtcgcgaatggtgcggaactggtcgtcggtgaggttgcgcttgacgccgcaaaccgcacgggagttggagtggctggcgacgaaggggcgcgtggcgtgggcgacaacctcgtcaaagcactcatcgttgaggtgggagacgtcgagtaccattccggcgtgctccatctgcgtaagtgtctcgatgccggcggcggtgaggccggcgtgggtatcgtgtccgctcgcgagcggtccctgcgcgttccaactgagtgacgacataagcacgcccaagctcttgagcacttcgatcagcgcggggtcctcggcaaagaacgtggcgttttcgatggtgtggatgcaagcgaccttgccgtccttgagcgcggggcgaatgtctgcggcgctgcgcacgttgaccatacggtcgtggttgagcattgcctggcnnnnnnnnnncaggcaatgctcaaccacgaccgtatggtcaacgtgacgttgaccatacggtcgtggttgagcattgcctggccgctcatatgcgccatgatctgcgcctggaagcgcgcggcgtgggcggtgggaatctcgtcggggacaaacgtggcgaagcactgtgccaacggcgtgttgccgatctttgcgagcgagatggcacaggcgttaccctcgatgaggtcgaaatcttgcggatgcgtttcgtcgccggggaaataaccgtcggtgccggcggtaaagcgcaggtcgagatcgagcgtggcccagccgattcggtcggcggtgtcgcagtgtaggtcaaatacgggatatgccatggttcctccggttgcagcgtttctttgcaaactgtcttcaaattgtatgactagggtatagttagcgccatatgttcatggcggcccgtgttgtgcgccgcccttatcacggaggtttccatgtccaaccagggcaagaaggtcaagactcattatcgcggcacgctcgacgacggcacgcagttcgatagctcctacgatcgcggtgagccgctggagttcacctgcggcgccggccagatgatcaagggcttcgacgccgctgttgtcgacatgcaggtgggtgagaagaagaccgtgcacattcctgctgccgatgcctacggcgagcacaatcccgagatggttctgaccttcccggccgaacaggttcccaacatcgagcagattgagaagggcatgaagctcttcttgtccacgccgagcggtatgcccgtccccgccgtggtcatcgatgtaacgcccgaggccgtgacgctcgacgccaaccacgagctggccggtaaggatctcaacttcgatatcgagctcgtcgaggtcgaggattaggctatgcctgcaaatctggtttcgacaacgtgcctcggaaatctcaacgacccgtcctatgagcttttgcttcgccgggagctgggcggtgtctttgaggtcgatgagctactgctcgattgggaccaggctgatgtatacgcgtttgtgggcgtgacggagctggggcgcacggtcgatgttcggctggatactgccgacggcggtcgtcttgccgacggcgacgtgctcgccattgaccgttcgggcatggtgcccgtggcggttgtcgtgcgcttgcgcagcgccgaggtttatttggtcgaagttgaccgcatggacccgattgcgctcgcgcattcgtgctgggagatcggcaacatgcatgcgccgctcttccggggcgactcggacgagcatactgtgcgcatgtatacgccggtgcagcctgttttgggccgcatgctccggggtgtcgagggtgttcggctctcgctggttacccgtgaactcgatgcggaccggcgctttgcgtcgagtgcggcggaggtcgtcgtgagcatggctcccgactttaccatcgtaaaaaaggcgcgcggctaagcgcgcgtatgcgcaagacgggctttgaggggcgaccgatcaaggtccgtcttgctgttgatatgaggctttgggggaagcatatgggtcttgagggaatcaaactgattgcatgcgatttggacggcacgttgctgcatccgggggagcgcgagctgcgttccgaggcctttgagcttatcgatgagctgcatcgtcgtggtatcgtgtttatgccggcgagtggccgtcaatatgcgagcttgcgctacctgtttgccccggtggccgatgagctcgcctatgtatgcgaaaacggaaccctggtgatgagcgaggggcgtgccgtcgtcaagcgttccatggagcgtagccttgctatggttatcgcgaataccgtggttgcgtatccccataccgacatgaccctttcgtgtgaggggcacatctacaccatgagcggcaacgatgcgttcgtcgaccatttgcgctatgtggtccactgcgatgtggcggtggtcgaccgtcccgaggacatcgacgaggatgtcattaagattggcttccagacgcccgaggtggattatccggcggcccgggagtatttcgagcgcctctttggcgaccgtgtcgatgtgatgacgtcaggaaccgcatggacggaccttatcggtttcggttcgggcaagggctccgcgcttgtcgattacggtcgtgtcctggggatttcgcccgatgagatgatggcatttggcgacaatgagaacgatcgcgacatgctcaacgtcgtgggccatccctatctgatggagagctgcaaccccaccatgcgcggtatcaacgatcgcgtccgttacgtgcacacggtcgaagaagaactgcaccgcctgctcgccgagtaggttttcgggacatgcctagaaatgtactgtttgctgcaaagcgcggaaaggtggattttaaggcatgtcccgaacatctaccggcagtcggggcagagaccctcgaagatggtgtagtgcgacgtgacgtgccagccgatttgctcggacgctttggcgtcgagctgggcatcgaaggggagcggtacgtcgatgacgcggctgcacgaggtgcagatgatatgcgcatgcggctcgatcgtgcgatcgaagcggctgccgcccggcgtcttgatggagaggatctcgccggcgtcggccaagagattgagattgcggtagaccgtaccgcggctgattttgtcatcctgcgcgcgcacggcgttgtagatttcgtcggcggtgggatggttatagctttggcgcacggcgtcaagaaccagctttcgctgcctggtattccttctttgcgccgccatgcgcctcgcctcttttctatcaacggtcgtaggtaaatgataccgtatttagcacacaatactaataatgaggactgaaaccgtcttcattggcaagtggggctcgggcctgggcatctacgaggcgaaaacgcgttcccatgcgctcgtaggaggcatgaagtgcctcgagatgagataggatgcttgccggagctccctgtatctccatctcgactgagccgtcttccatgttacgtacccagccggtgagtgcgcgtgcctgcgcgaggttggtgttggtaaagcgaaaaccaacgccttggacttgcccctcccagcgcaggaaatagcgcaggggagtgtcttgagtggcctcgtcgcttgcgagcacagtaagcctgcggcgcagctcgagctcgacgtttgatggtttttgaggctctcgactgccgccggtgacgctggagaagaacgtatcgaagaagcccatcgctatgcctgcttgcctgcgtcggccgggaaggttatgccggcctgctggcgcacggcatccatgatgcgcagtgagacgagcgtgacatcgcggtagtggccaagctcgtggcgtcccgccggggtctcccaaatctcttctttaacgttatcgatgccgccgatggcggtgataaagtctgtgagttcgtattccatagtgttgctcgatttgggtaggtcgagcacgcggccgttgtcgccctgtccgcgcggcgcctcggtcgccgagccgcgtacgacatcgccgcgatagtcgatacggacgttgcggggcgtggacagatggtcaatctggatagtgccacgctcgccttcgatctgcgagggaagcaggtcattcgtaattttggagtgcgcgagctcgacggagatacggccaccgccgtagctggcgaggatggaaccgcagccgtcgatggggccgtgcgtgagctgtcgcgtggtggggtcgagcagagtagccatgctcgtaaggccggagggcatgccgaaaatctcgaccatgggctcgacggtgtagacgccaatatccatgagggaacccgatgccatattgcagtcgaagatattggtggcgcgtcccgcgagaatctcgttgtagcgcgaggaatacttgccaaagcgcaatgaggcgcggcggatgggcgcaatctcgcccagggcgtcctcgatggcgtggaaagcggggtcatggagcgggcgcatggcctcgagggctacgacgcccgctgcctcggcagcgcggaagacttccagcgcctgcgcctcggtggcgcagaagggcttctcgacgatgacgtgcttgccaccagcgatgcaggcaagggcctgctcgtagtgaagtgcgttagggctgccgatgtagacggcgtcgacgtcgtcggcagacgcaagctcgtcaagtgcggtgaagttacgctcgccgccgtgcttagcggtgaaggcggcgccgcgatttgcatcgcgcgagagcgtgcccacaaacgcggcttggtcgttggcgttgacgacctggataaagtcgtcggtaatcatggatgtgccgatggtcgctatacgcagcatgtatccccctcgtgccgttcggtttacaggatgagtgtagcgcgggaggacacaaaagcgtgcgaaaacgccgttacaggtcgctctcgttaaagccggcgtcgatatcgaggttgctgccgtcggccgccgtggtggcaagctcgtcgcagcgctcgttgagctcatggccggcgtggcccttaacccagatgaactccactttgtgcttgctctttgcggtgagcaggcgctcccacagatcgcggttcttgacaggctgcttgttggcagtcttccagccgcgtttcttccatccgtcaatccagtgcttgttgaaggcgttgacgacgtactgcgaatcggaatggacttcgacgtcgcaggggcggttgagtgcctcgagcgccacgatgactgccatgagctccatgcggttgttggtggtcttggcgtagccgcgcgaaagctcggaggtgaaggtcttgccggcggggttggtgtatttgagcacggcgccgtagccgccgcgtcccggatttgatcgggccgagccgtcggtatagatgatgaccttcacatggttcctttcgttgggtatgtttcgtgcgagtgaccattgtagcgccatgcccgccgggggctagcaatctacgatttctaccccgtcttccgacagttggttggcatggatgatgcggttgagctcgtcgaggtattgctgcaagaggggagagggcttgcgatcgtcgtgcatgatatagcctacgtgcatcgtcggggcgtctactaacgggatcgatgccataccccattgcatttcattggagaggacaccggtcgacagggtgtaaccgttcgacgtgataagtaagttggtaagtgttccacggtccgagattcgtatgttgcggtcgcaagggatatagctaaaaggttcctcggcgtaatagaaggagttcgaggttccctgctcaaagctgtagcgcgtatagggcgtgaggtcggcaagggacagctgagggcggcgtgcgagcgggtgacgctcgctaacgaacacgtggactttcgcatcaaagaggggatgaaagctcgctcgggcatcggtaaaggccttctgcaagacacgggtattaaagtcgtccagatagaggatgccgatgtcgctgcgaaacgcgcgcacgtcgtcgatgatctgcgctgtggtggtctcgcgcatgatgaactcgaacttgctgtcgcggcagcgctcgaccacgttgacaaaggcctcgaccgaaaaggcgtagtgctgggcggaaatggcgaggcgggcttgcggggtaccgccgtcctcgtagcgggcctcgagcatgtcggcctgctctacgacctggcgtgcataacccaaaagctcggtgccgtcgttggtgagtgcaacaccgcggctggagcgcgtaaagatttcgatatgaagttcctgctccaggcttttgacggcattggagatattggactgtgccgtatagaggcgctgggctgcggcgttgatcgaaccggactctgccacggcgatcaaaaagcgaagctgttggagggtcatcggcgcccgtcctttcgagtgttatctataaaaccgataacaggttagcgctttaaagtgattgaccgaggaaaacaatgctcgtactattcaaaacacacaaagacggtaggtaattaagccaactacggaaccgggatgcgaaaggaggcccgcatatgaattgcttaccaagacgaatgccgggctcctgtttgcgcccgtcggcgtgatcaggagacagcgactcacttctcttactcttattacttttgttcgatcaaggagatcatcatgagccagttcatcaacaaccccgagcacacctttggtttcgataccctgcagctgcacgttggtcaggagagcgccgatcctgcatccgactcccgtgccgtgcctatctaccagaccacgagctatgtgttccgcaactcccaacacgccgccgaccgctttggtcttgccgacgccggtaacatctacggccgtctgaccaactccacccagggcgtcttcgaggaccgtatcgccgccctcgagggtggcgtggcaggtcttgccgtcgcctccggtgctgctgctatcacctataccctgcaggctcttgcccaggccggtgaccacgtggtggctcagaagaccatctacggtggttcctacaacctgctggagcatacgctctcccagtttggtgtcgagaccacgtttgtcgatgcccataacctggaagaggtcgagggtgccatcaaggacaacaccacggtcatttaccttgagacgctcggcaaccccaactccgacatccccaacattgacgccacctccgaggtcgccaagaagcacggtctgccggttgttgtcgacaacaccttcggcaccccgtatctgttccgtccgctggagcatggtgccaacatcgtcgtccactctgcaaccaagttcatcggcggccacggcacctcgctgggcggtgtgatcgtcgacggcggtaacttcgattggaaggcgagcggaaagtacgcccagatcgctgagcccaacccctcctaccacggtgtttcgtttgccgaggctgccggtcccgctgccttcgcaacctatgtccgcgctatcctgctgcgtgacgagggcgcctgcatcagcccgttcaacgcctgggtcctgctccagggcaccgagactctgtcgctgcgcgttgaccgtcatgtcgagaacaccaagaaggtcgttgagttcctgaccggtgacagccacgtcgccaaggtgaaccacccgagcctgcctgagcaccccgatcacgagctctatcagaagtacttcccccgtggcggtgcctcgatctttacctttgagattaagggtggccaggaggcagcttggaagttcatcgatcatctgcaggtgttctcgctgctcgccaacgtggccgacgtcaagtcgctcgtcgtgcacccggctaccaccacgcactcccagctctctgccgaggagctcgccgagcagaacatcacgccctccacgatccgtctttccatcggtaccgagaacgccgaggatatcatttgggatctgaagcaggccttcgtcgcgctggacgagtaaggcgacttgtgcaaggaccccttgcgactcgataggtataactgcataaaatgcctgctcaaggcgcctgtgcgaacaatggttgcacaggcgccttttttgcatagagagggtgcaaaaacagggtttttgatacgatttatgcatttgagttgtggaaaactcctgttgagaggatgtgagttttacgcaattgacgtgcgccttttgagtaaaaccgcaggtcgcgatttgctcggggtactatgcagcgcgatcgaatcacacgcagcctaaacgcagcaaaaacacactacggaggtttccagctacatgaggatcgattcacgaaaaccgaaagccgccgccctttccgccgctctgaccgtggcacttttggcgggcgtcggcgcaactgatgcccacgcggcaacactatccgatacggtcggatctacgccgtccgaggcgacgctggtgcagcccgtcgactaccgcggtgacggttacggctctatgcaggagtggaacgcctcgatgggggcgaagcgcgattccctggagatgcgcgctcagatcattatgaatatgtatggcgactatgctaccgatgacgagcgcgctgtgttgcagggctgcatcgacggcgcgagtagcctgttgacgatgggggaggtcgacgccaagtcgaccgagctcgacgagcttcgctccgcgctcgaggatgccaagcgcgaggcgctcgaggctgccgcagccgaagccgaggccgctgaggccgttcaggcttcgtattacaacgccggctccggctcgtcttacgcgtctgctgcgtattacgcgaacggctcgggcctgacgcgctcgagcggcgtcaataactataacggccgccgcgagacttattacagcagcaacgtgttgtatcaccaccgcacgggcgaatggacgcaggacgccgagggcttttggcgcgattccgatggctactacgtcgttgccgcgggcgataaggcccagggctccacgtttaccgggtccaagggcgagtgcaaggtctatgactccggctgcgctgccggaacaaccgattactacactggctggtaatttttctgcatcacggatatttgacggacgggcgtctttaccgagctttagggcaacgtaaggacgcccgttctatgtatgcgtttgagttaacagagcgcttaccgtggcagtacgccgcgcatatgggcgcggggcacactagttcatgagaaataaggtctttctcgtggaggaagtggtcttgtgaacgctcgagatattgctattgccgccgtcgcattggtgcttggctgccttggtcctacggccgcgctcgttgtgggcatgcaggggtcttgtggggctgcctctatcgtggtcagtgcgttgatcgcggccgcactgctgggaagtgcgggtgtagccctttgtcgcgacgatgaggaccaggcgtcggagtcgcagctctaaccgtcgggacatcgactactggttatagatgaagatgaaagccgccgtaaggggagtgctccttgtggcggctttgctgttgagcctgttgacgtggtgagccgggcgctaccagcttttctcgatatcgcggatgcgctgatagagccaatcgttttgcggcgcttggatatcgtgtttgacggccaggcggcaaatggtgcccgcgaactcctcgacttcggtttttcgttgtgcgatgcggtcctgcgccattgagggcataccggcggggtcgattccctcgatgaggtgcaccatctgcgtcaggtctgcctcggtcagctcaatgccctcggcgttggcgaccgcaagcgtttcgcgcatggcagaaacaaagcagcgacgctgctcggagcccggctccgtggcgcttccgtaggtcccgccgtaggccatgcacgtctggttgatgccgtcgttgagcatgagtttggcccacatgcggtgcgtaacgtcgctctcgacggtatgggcgatgccgcagcgcgtgtagagctcgtcgatggcggtgacggttgcgagctcagtgccggccgccgcgccaaagcggatttcgcccgcattggtaaaggtgagctctccgttgaggaacacggcgtccatgccctggcaaataccaagaacggtatgctcccagccaaagcgctcggcaatcttctgctcgctcgtaatgccgttacacagcgaggcgatgagcgtattgggtcccacgacgcgctccatagtcttgagtgcttggttgagtccagtcgtcttgaccgtgagaatgaccagatcggcgggcgttgcctcgctggcgcggacggacttgagcgcacagggcttgccattgacggtgagcgcatcgcccgcgtgacgctcaaaacgggcgtcatccataacgtattcgacggcgtcgttaccgagtgcctgggcgatcatactgccgtagagtagcccgacgccgcccttgccgataaaggtgaccttgttgatctgcatgtgaattatctccccatataaaaggtgcccgcgtaaggggcgcctgatggattgtatgccgccagcgcaccttgtgcatgcagggtggcgatttttaaatgaatggacgcgtggagcttacgctgcggggcagaccgcgaaaacgcgtgcgggatatccaacgccatcgcgcaccttggggaaggtgcagaagatgacggcgcctgtggcgggaagctcgtccagatggtccatgacctcgatctgatagcggtcgaccgagaggatgtactgctcgccggggtaggggtaggcgtcctcacgtgtggtcacggtcgcttcctttcatcgggctttttgctgatgttaaagcggtgtcgtgacggctcgatttctgctacgttacgatacattctcgattgcgattccacgatgtttcggctgcgtgaccattgtgtttcgccttgccggggcgctgatggcgaagggaggggccgtgcaataccgtgttgaccccaaaagtggtaaccgaatatccgctctgggtctgggctgcatgaggtttcccggtgcgccgggacatcccgatgcgaagacggccgatgccatcatctcccgtgcggtggagcaagggataacctatctggacacggcctatctctaccccggtaacgaagcttgtgtgggagcttcgcttgagcgcctgggtctgcgtgaccagattttgctcgcgaccaagttgccgcacgcttcgtgcaaatgtgcggaggatttcgaccgcttttttgacgagcagctgcgccgtttgcggactgaccatatcgactactacctcatgcacaacatcacctcgcctgcgcagtgggagcgcgtggcagctttgggtatcgaggactggattgcgcaccaaaaggctgcggggcgtattcgccagataggtttttcgtaccacggcggtgcggcggatttcctcatgatgcttgacgcgtatgactgggatttttgccagatccagtacaactatgccggagagcgctaccaagcgggaacggcgggactcatggcagccgccgagcgcgggctcgcggtgtttgtgatggaaccgcttttgggtggacgcctggcgggcaagctgcctccgcgggcccgcgccgtgctcgatgacgtacgcgatccgtacctgaagacgccggctgcttggggcctttcgtgggtgtggaaccatcctcaagtcacgatgctgctttcgggcatgaccgataccgcgcaggtggacgagaacgcggcattggcggatcgcgcactgccggattcgatgacgacagagcagctcgataccatcgcacgtgtgctgggagagtttgagaaatcgaatcgcgtgccctgtacggggtgcggctactgcatgccgtgccccaagggcatcaatattcccggttgctttggcgcctacaacgcgagctacgcgcatagttggtttacggggctgtctcaatactttacggcgagcgcggtgcgcacaagcgagcccaagctggtgagcaattgcgtcaagtgcggtaaatgcgcacgacactgcccgcagcacattgatattcccgagcgtctcgacggtgtgcgccgacgtttccaacctggtcccgtaacggccgcgcttaaagccttttgcaaaacgcgctcctgatgccccttttataacttgcggtggaatagttcctgtttgcggcagaataggggccaagcaggaactattccaccgcaactgaagggggctgtcgtgggctatcgggattcatgtgatggtttgcgtgatgttcgctggggcgttttgggcgctggacacatttcgcatcgattcgcatcgtcgctcaaggaggtggacggggcacggcttgtggctgccgccggtcgcactccttcgcatgttgaggagttttgcagggcgttttcgattgacgccgcgcgcagttatgccacggctgacgatagcggcgatgcggcttatgatgcgctgattgccgatcccgatgtcgacgcaatctacttggctcttccgcatggcatgcatacgcgttgggcctgtcgcgcgctgcgcgctggaaaggccgtgctgtgcgaaaagccggccgttttgagcgaggaagaggctttctcgattgcctccacctctcgcgagcgcggcgtgctgtttatggaggcgatgaagaatcggttttgcccgatgcgcactcgcgtgaaggacttgcttgcgtcgggtgagcttggccgtattgtctcgattgaaagcgtgcaaaagctcgattacggcgagtctccttcgggctatctgcttgatccgttgcagggcggctgtctatatgacatgggctgctatgcagtcgggtggtttgaggatctgcttacgggcgcgtgcgatgtttcgtctcgtgaagttcgctggcgtgacgtatcgggcggccgcgtggattgggccgatgagatccatatgagtgtcggcggcatacccattcatatggtgtgcgacggcaaagcagcatatgaaagccgcttaacgattgcctgcgagcggggttcgttggaaatcgagcgcctccatcgccccgagctcgcccatgtgaagtactccgacggacgaatgttcgaaataaatgccccgtttgaggtcgatgatttctacggcgaaatccggcatgcgacccagctcatccgggcggggaaactcaagagtcccgtcatgcccctagccgccacacagcgctgtgcgcgcatcatcgatgcaatccgtctagccctctaggacctggcgctgacgcgtgagggatcatgacgcccgcgcccgtagctgtagtgcttggtggcccgcatctctgatgccccttttataacttgtggtggaatagttcctgtttgcggcagaatagggcatcgacaggaactatttcaccgcaactgatgagggggagctggagatgctgacgatcgggtgtcatctttcgacgacgaagggctatcgggcaatgggggagacggcgctgtccattggcgccaatacctttgcattctttacgcgcaacccgcgcggcggcaaggcgaaagaccttggcatggatgacgtggcggccctgcgcgagcttatggagcaaaacgactttggcccgctcgtggctcatgccccgtatacctataacccctgctcggccaaagagcgggcgcgcgagtttgccctggaggccatggcagaggacctgcgtcgcatggaagcgctgcccggcaactactacaacttccatcccggtgcgcatgtggggcagggctccgacgccggcattcagatgatcgtcgacaccctgtgtcaggtgatgtttgagggtcagcagacgacggtgctgctcgagactatggccggcaagggcaccgaggtgggccgcagcttcgaggagctggcgctcatcatcgagggcgttgccgacaaacgccccgagctgtcggccaagttgggcgtttgcctggacacctgccatgtgaatgatgccggctatgacatcgtccacgatcttgacggtgtgctcgacgagttcgatcgtgtggtgggtatcgagcgcctgcgcgccgtgcatatcaatgactccaagaacccctgcggcgcccataaggatcgccacgagtgtatcggcaagggctacctgggtagtgaagagtttggcggcggtatgcaggttatgcagaatattgtatcgaatggccgcttgcgcgccttgccattcattttggagacaccgaacgaacttgcaggttatgcggctgaaatcaaactgttaaggtccttgcagcagtaatggctgccataaagtggagtgctccattcacgttatgggttttgtttcaatcagttttctaatcgcagattcttccaagcgggtgcataataaccctcagtttttgcagacctctgaatcacatggggtcattggaaggagactgattatgaagctgaagaagcttggcgcatttgccgccacgggtgctatggcgctcgccctcgctctgacgggctgcggctcgtccaacgccacctctggctctgatgccggttctagcagctctgacgacgctaaggtcgagaaggtcgacggctccaaggagtacgcgctcgtcaaggacggtacgctgaccgtcggcacctctgccgagtacgctccgtttgagtacaaggatgacaacggcgattatcagggctttgaccttgagctcatcaaggccatcggcgacaagctgggcctggatgtcgagtacgtcaataacgactttgacacgctggttccgggcgtcgcttcgggcgccaagtatgacgtctccatcgcggctatcaccgacacgcccgagcgtgagaaggaagtcactttctccgattcctactacatggacgatcaggctatcgtgaccaaggtcgataacaccgacatcacggccgataactacagcgagaagctcaataacgctgacgctaccatcatcgtccagtctggctcgaccgccgagtcctttgcccaggagaacttccccaaggccaagattgtcccctacaaggacgccaccgagtgcttcagcgccctgcagtccgataagggcgacgccgtagtcaccaaccgctccgttgctagccagctgaccgccgagcagttcaacacctgtcagaccattaagcagatcagcaccggcgaggagtacgccatcgccatcaaccagggcaacaccaagctcaaggacgacatcaaccaggccatcaaggacctgaccgacgacggtaccgttgacgccctcatggctaagtacaacatcaagtaaaataactacttgattgcgcgcgggccctttccgttttggcggagagggcctttgcgcttctcttgacggagagcattcccgtctcgttttgccggcaacttctacgataggagccaccttgtctcgactgaacaaaggggccgcggagcagcattttccactgcccgccttgctccaaaagctagtctgcgtcatggccgtggcgctcgcgctggtttgcgcgggggcatatgcgcccacgaccgcccaggcgcttgagaccgcaaagattaccgcccgacccaacaccggttcgggcagcgctgtggtcggcggtaccgagacgcgcattacctgggaggtccaagccgatgccgatgaggagctgagcggtctttcgctgacgtttgtcgacggcacgacgtttggtaccgatgacacgcgattgacgatgctctcgggcgaggacctcatggatcgtacgcccatgaagcccacgtgcaaggctgacggccagacgctcaagatcgactttggcgagacggcgcctgccggcggctttttccgtgtcgaggtctacggcgtgacgtttcccgtcgagggcggcgatgaagccttcagcggcacctatacgctcgccgacggttcgaccaagaagatttccaagattccttccgtcgagatcaagggcgtgacggcattcgataacttcctggccgatcttaaggagcagccgtgggtcgaggcgtggaactccaatatgttcctgcgcctgttcttgaacccggtcattttggttcagagcctgccgatcgttttcaagggcttccttatgtcgctctcgatcgtgctcgtggcatttccgttggccattccctttggctttgcgctgtcgctcatgcgcatttccaagtcgcgcatccttcgttgtcttgccggcatctatgtgaatatcatccgcggtacgccggcgttcctgcagatctatattgcattttttggcctgccgcttgccggcgtcaaggtggacgactacgtcttgggcgttatcgtcatggccatgaactcgtccgcctacctgtgcgagattttccgtgccggtattcagtcgatccccaagggccagaatgaggctgctcgctcgctgggcatgaatgccttccagacactgctctacgtcatgattccgcagacgttccgcaatgtcctgcctacgttgaccagcgagttcatcctgctttacaaggatacgtcgctgcttgccgccgtgggcgtggtcgagatcgtcatgaacgcccgcaccatcgtggccacgacggggtccatcacgccgtatgtggttgccgccctgttctatctggtcattaccctgccgcttgcgcgcttggtgagcggtcttgaggcgaggctgctgggtacggccgaaaccaaaaagaagcgtcccaccaagagcgccggacaggttgtcgcgacgcctgccgatcacatcgccggtctgtaaggaggtcctatcatgagcgaaaccaataactcgaacgaggtcgtcgtcagtatcaagaacctccagaaggcctttggcgataacgtggtcctgcgcgatatcgatctggatgtgcacaagggcgaggtcgtcgtagtcctgggtccttctggctcgggcaagtcgacgatgcttcgttgcatcaatcgtctggagcatcccacgagcggctcgattgtcgttgagggcgtggacgtgtgcgccaagggcgtcgacctcaacaaggtacgtacgcatctgggcatggtgttccagcagttcaatttgttcccgcacctgtcagtcaaaaagaatgtcatgcttgcgcagcaaaaggtactcaagcgcagcaaagaagaggccgagaagatcgccatcgaggagctgaccaaggtcggcctggccgagcgcatcgactttatgccgagtcagctttcgggcggccagcagcagcgcgtggccatcgcccgcgccctgtcgatgaatccgcacgtgatgctctttgacgaggccacgtcagcgcttgaccccgagcttgtccgcgacgttcttggcgtcatgcgcgacctggcacgtgacggtatgaccatgatcgtggtgacgcacgagatgggctttgcccgcgatgtcgccgaccgcgtggtctttatggacggcggcgttatcgtggaagagggtacgccgagcgaggtcttcgaccaccccaagagcgagcgcaccaaggcgttcttgggcaatatctcgtagccgctttatatgactgacatagcagaaaacgggagccggatgtgatccggctcccgtttttgttgggacgcgaatgtgttttgttgcaatgcgcgttgcgggcggagctcattgccgctaggcgagctcggctccaagggcgcggcaggccgcttcgctctcatcatcgggggcgtcgtagcagatgacggaatcgacgacgttgacgccctcctcgtcggcgtccgccttccagttgtccatccattcgccctcggcccacgaataagagccaaagaggacgaccttcttgtcgccgagggtctccttgacctcatcccacatgggctggaactcatcatattcaagctcctcggaacccatggcggggcagccgaaggcgatagcgtcatagccagcggccttgtctgcggagaagtcggcgcaggagatgacctctgcctcggcgccggcatcggttgcaccttcggcaacgaggtttgccatggcctcggtgttgcccgtgccgctccagtagacgacggcgatcttgctcatgttgagtcctttcagttgtgcggcaggttgccacggcttctatgttctatcgggttgcctgggcaagttgcgccaagctgtagccctgctgatagacaaaggtgaagtattgggtgcaggcgcggtaggcatcaaacgtcgcaagtgcctgctcgacatttgcgtagaccttccaggccccaaagaccttatagttctcgccgcgctggacgataaactcgtgcacgtcgtcgtagggatatcctaggaagtagcctatttcgtgcggaaactcgcaggtgcagtcgttgctgcagctagcttgctggggtagtgcgcatcgagtctggctacaggcgcattccgcgacgttattactcgcgagcgtgatgcgtgatgccaaatgcacaaggcatgtcgaaaggtctctcgtgtcgtagccttccgaggcgagcgccgttttggcgcgagggtccgcgaaataggtggtgaggcttttggctcggtacacgtacacgagcgctccgcagggccgccagaccaaaacactcaggtggatgccaagcgggtcaagctcgcggttgcactgggcgataacgttgagcaggcgtgctcggcgttctgcgatggtttctgttgcggtcgagccgtccccgtgggcgtaggtgcctggataggtaaagagcgatgccggcttgatgcccgcgagcgtgggggagcagttgcgcacgactgctgcctgaaacgttgggatgtctatggttcgagtcacgtcgctccttacggatctaaactgttagcctaggaaaacttatacacgaaagtaagccatggtcaacaaaaaagtttgaagaggaaaactaattgaccgaacggacataattttgggttaagatggggacaccccatgggggtatctagatagtgctactgaaaggggaacgcatgagtgacttgctcaaccctgcgaatctcatcgtgctgaccgtcattgccgtcggcatgttttttggactgcgtcgcattgccgcttcgacacacgggaagagttgctgcagcgatggtgcgagcggcaagaaggccaaaaaggttgtggtggcagacaccgacgagtcccactacccctatcgtgaggaactccttatcggcggcatgagttgcgacggctgcgcccggaatgtgacgaatgccctcaatgcgcttgatggcgtgtgggctacggtaacgtacgcggaccacacggcacgcgtgcgctcgaagcgcccggttgatcgcgacacactcgagacggcagtgaggggtgcgggctattacgttatgaaaatgtaggcgttgccctctccggtgggtaccagcctcctgcccattgtgactatcggcatccaaaaatttgcgcaaaaataacctttagatgcggcaaaagtggagtttggtgacggtttgcgcggaattcgctaccaatcgagcatctatgaacccgtccaaaaaattacaggtgtatatttatacactgattattgctgtgctcagattgcaattaaccgtggacagaaatgaagaatgctaaaactgggctttaggacaggggaggctataaccttatgagacgagtgggaacacttggcttggtggcagcgcttgccgctatcttggtatcgccgctgccggcgcacgccgaagacgcatcgggtgccgttacctacaatgcgggaaatgggtattcctttgagaagctctcgcatcctacggtaggaacgtcgcagccggatggcatcgtcgactaccagggtaacggtgccgttgccgttccgggcgccgatggtaatacggccaacaacgaaggcgatcgcggccagagctacacttgggcggctgcgagctatggtgactggctttatgtgggcacctgctatgcggcgatgggcaacacgctgacgctcatgaacagcacgctgggcgattcctttgatgtcgaaaccatgcgcctgacgctggaggccatgtttaacggtaccttcttctatggacagcagaaggaggacggcacggccgacaaggacagcggcggcatcttggtcaagatcaataccaagaccggtgagaccaagctgctactctctgaatcgctcaacggcgtcgctcctttgttccgcaatgccgtgagctataagggtaagctctatttctgcggcagcgtcaggaccaatgacggcaaaggcggcctgcctgctgtatacgagatcgatcctaagacggatgagtacaaagttgtctatcagggcctttcgagcatgcaggattacggtgctgcctacaagcagggcatttctaccggtatccgcggcatgtgcgtccatgatggccagctcgtcatcagtaatgtgggtaaagacgcgaacggtaattttgtgtcgacaatcctgacgtcgtctgacccctcgaaggcccaggacagcttcaccgagattgccaactcggagacgctgtttggctatccggcgattcgctatcaggacagcatctacggcggcgccatttgggatatggtctcgtacaatggccatctctatgcgaccatctgcaccggtacgcccgagaacgctcccgatgataattccatgcagtcgtttgccatggtccgtggcgacaagaatgccgacggcagctattcgtggactcccattgtcggcgatcagaagacggacggtgcaaagtactgctttggcatcgatcctgcccgtacccgttctggcgctgccaacctcatcgtctacaacgactacctctatatcggtgaatacaacgacgaggagattgccctcgagcgcatcctgttcaacaaatccaacaccgaagagggcggcaagagcagcatgggtggcgttgactgctcgtttgtgaatgccaatcttgagcagtcggttaacatctatcgcatggacaaggacgagaacatggagctcgtcgttggcgatcgcaccgacatgttccccgagggcggtatttccggcctgacttcgggctttggccgaaacgagaaccagtacatttggcgcatgcagaagttcgacggcaagctgtatatcggtacctttgataccgcgagcctgcttgagccgatcggccagttctccaatggcgacattatcgatatgacgcccgaggagtgggactctcaggttcagcgccttagggacctgctcgatcacctgctcgacaagaaatcgcctgacgaccccatcgttcccgtgaacacgcttgcggacgatgattcaaacgaggccgtcgaggtcgatgattcgaacgaagctgctgaggttgatgattcaaacaaggccgtcgatgtcgatgacgagaagaccgaggttgctaagggctttggcgatctgagcgatgcgctggaggatgccgcgggcggtctttgcgatcaggccgcgacgatgtcccaggactttgaggacgacgccgcttatgtccagaagatcgatggcgagatcgcgtacttcaagtcctttgccgaccagtatcaggacatgctcgatagctatgagagccttaagcagcagtacgaggatgcctatggcaccgagctgccgagcgatattcaggatgcgctcgataagctgctgagcgaggagaacctcaagaagttgcagagtgtccttacgtgcatgtgttacctgcgcgatgccgagcgcggctttgatatgtatgtgaccgaggacggcgtgaactttacgacgctgacgaccaatggctttaacgatccgtataaccatggtctgcgcacctttgcggtgaccaaccagggtctgtgccttggtaccgccaacccgttctatggttgccaggtctggatccagcgcaaggagaattcggagaatccggttgatcccggtactccggatccgacggaacccaccgatccttcgcagccgggtggcggcgatcagcctggcggcagccagacgggtggcaacgaccagtcgagcagcaccacgaccaccgtcacgacgaccgctaagaagactccgaaggacggctcgctgcctcgcgctggcgactcgaccctcacgctggtcttgggattgctggttgcagctgccgcagtgcttggcattgctctcgtcttgcgcaagcgttctcgtcgctaggctcgtccgcgtagctcaatgtcctggatatcgtcgaagttgatggcgatatccctgagtttgagcagcttgaatgcgggtaacgcttcgtcgagaatgcccgtgcggctacgatagccgtacgtatcgtaataggtgacgcgcaccaagtcgccgcgtttgaggccctcgagcttttgcgaaagctcgagggctttttcttccgtgagctcacgtttttgctcgacggtgatttcctgcttgcgcacgagttcgtagtatcccgtgagggcggcaaagggcataaactgtgcggcgcggttggcgcgcacggcaccgttggcggtgagcttggggtcggcggatcgacgtcttccctcggggtccgctagacgttcaaaaggcgtcggtggccgcatcggctgttgttgggacttaggcacgatgtcctcctacctgatcgttgcgttcgcgtgcggtggcgccggcggtgaagcttaatcccttgacgagcgcgttcttgccgtacttgcccttcacggccaggacggcgcgcgccaggtcgcgctcgcgctcatcggccttaacatcgctgaacaggtcgatagtggcaaattcctcgggcatgaggttgccaaatcccaggttgatgcgcttgatcggtcgtttgggatcgacagtctgcgcccagagctcatcgaaatagcccatgatcttcttaaacgaattggtgcgctcgggcagcttgcgcgaggcgttggaatgcgcaaagagcgcggcatagccaccacgcggcttgccgccgtgttcgcccacaaagatgccgtcaatcgcctgtgcctctcgcaccaaacgtcggcgttcgtcgtcgcgttggatgggcttgggcgcgcggggcgcgagctcggggccgtcggttgcggcgggttcgatgctcgacgtgctcgaacgcaaatgcccgcatccgtctacatattgcgctgtgccgctggcgtcgaggcggcgtatgtcggcgcgctcgctcgcgtagcctacaaagagcgagatgctgttgcagaccacgtgcttatcgaccaagtccagcacagcgttgtcgaccatctcgcgcaagacggtgtaggcctgctcgtaggcataacccttcgagagcacctgtcctgtggtggtcgaagttgcttgcgggcgataggcttggatatcggcgatggttgtcggctcgcgtccgaaggcgtggtcgatgagatattcggcattgacgccgagttcgtcgtagagcaggttctcgtcgagtgcggcgacgcccatcaggtcgtataccccgtacttttcgagtcgtgctgccacgccgggcccgatgccccagatgtcggtgatggggcgatggggccagatctccttgcgaaaggtctcgtcgtcgagtttgccgatgcggctgggtacgtgcttggcggtaatgtcgagtgccaccttggcctggaataggttggggccgatgccaaccgttgccgtgatgccggtgcgcgccaggacctcgtcgcgcaacatgcaggcgaagccttcagcgtcggtgtgatagaggtccagatagggtgtcacgtcgataaagcattcgtcgatggagtagacgtgcacgtcttgcggactcacgtattccagatagataccgtaaatttgcgccgacacctccatgtagtgctgcatgcgcggtatggccttgatgtagtcgatgccgtcgggaatttcgaacagacggcagcgattgtgtatccccaggtccttcatggcctgtgtgatggcgagacagatggtcgtgcgcccgcgcgattcgtcggcaacgaccaggcacgtagtgagtgggtcgagtccgcggtcgacgcactcgacgctggcgtaaaacgtcttaaggtcgatgcagacataggtgtgacgctcgtgtcccacgcgtcctcccatcaaacacatgttcttatcgaatacatgttcgataatacccgcttgcgcggacatcgtcaaaacctgtccctttttggtcggtcgccgtttgagggcggattggcaacgctcgctgattgtagtcttgacctgcgctagaatagtggcatctgaatgtccgggcgcatggagacgtgcgcccgtatgctgaggaggactttatggcaactgttgccgcacctatcgatgctacgtcgactgccgcttggaaggcgctcgaggctcatcaggagaagctcgaggccgaaggtatcgacctcaaggcctggttcgccgccgatgccgagcgcgtgaacaagctgagctttgacgctggtgacctgcacttcgatctgtccaagaaccttgtgaccgatgagaccgtcaagctgctgtgcgatcttgcccgcgaggtgaagctcgaggagcgccgcgacgccatgttctccggcgagcacatcaacaccaccgaggaccgcgccgtcctgcacaccgcgctgcgccgcccggcaagcgagaagggccagctcatcgttgacggccaggatgtcgtcgccgacgtgcacgaggtcctcgaccgcatgtatgccttcgccgagcgcgtgcgctccggtgagtggaagggtgttaccggcaaaaagatcgagcacctggtgtccatcggcatcggcggctccgacctgggcccggtcatggcttacgaggccctgcgtccctatgccgacgccggtattgattgccgctatatctccaacatcgatcccaacgaccaggccgagaagctcaagggtttggatcccgagaccacgctcgtgattatcgtctccaagaccttcaccacgctcgagaccctcaccaacgcccgcgaggtcaagacctggatgctcgagcagctcaaggctcagggcgccatcgatggctccgatgagcagaacgccgaggccgtggcaaagcacttcgtcgccgtttccaccgcactcgagaaggtcgaggccttcggcatcgaccccgccaacgcctttggtttctggaattgggtcggcggccgctactccgtcgactccgccgtgggcctgtcgctgatcgtcgtgctcggccccgagcgtttccagcagttccttgagggcttccacgccatcgacgagtacttctgcaacacgccgctcgagaacaatgccgtcgcgctgatgggtctgctcaacgtctggtacgtcaacttcttcggttccaagagccatgccgtgctgccgtactgccagtacctgcaccgcttcccggcctacctgcagcagctcaccatggagtccaacggcaagcatgtccgctgggacggcagcgccgtgacctccgacaccggtgagatcttctggggcgagcccggtaccaacggccagcatgccttctaccagctgctgcaccagggcaccgtggtggttccggccgatttcatcgccttcgccaataccgccaaccctgcgaccgatagcggtcaggacgtgcacgagctgttcctgggcaacttcctggcccagaccaaggcactcgcctttggcaagacagccgacgaggttcgtgccgagggcacgcccgagcagatcgtcccggcccgctgctttgagggcaaccgtccgacgacctcgatcttcggcgacacgctgaccccgttcgcactcggcgagctcatcgccctgtacgagcacatcacgtttgtcgagggcacggtctggggcatcgactcctacgaccagtggggcgtcgagcttggcaagcagcttgccaagcagatcaccccggccttccacgacgacgccgccaaggccgagcaggacgcttcgacccaggcgctcatcgagttctaccgcgctcaccgcaagtagtctttgttgctgagataggtcattgccgaaaggggcccgtatccgttgggatacgggcccttgctgtttgcggtcgaatgtggcggactgcgcggcgttgttagcgggttaattcgacctgcgtggtgtctcgctgcgcctcgggcagctccccgtagagcgggtggtcttcgagcctaaagcgctcgacctgttcgggagtgcgaccgcgtacaaagagccacgagcgatcgatcggtgtcgccatgagcgtgctgggcagcgcgtcggcgcggtcggaaaacacccgggcactctcgggatcctggaacgccagcaccagatgcgtgtcgcagttgcccatgatggagcgtgcgcgtgcctcgccatagagcgcatcgagctggttggtcgactgcagcagcagcgttgcccagatgttgcggcttcggataatcgagagcacgttgtcgatctgggggatctgcagatttgcgaagtcatcgagcataaagcgcacgggcacgggcaggctgccgtcgggctgcctatcggcctcgcgaatgaggcccataaacgcctgcgtaataaagaggccggtcagcggatcgagattgcggtcgatatcgctcacggttacaaacagggcgcagggggtgtgtcccatggaagcgaagtccacctgatggcactcacgatagagctgtgccgcaccgtcgaatcccagacacatgaccttttcggcaaggatgccgacgatgctcgcgtgcatgcgctcggcattttgcgtaatggcgtagcgccgccatagcgagagggcatagctttgggggtcggtcgtgatcaggtcgtcaaacaatcgacccgtggcaccgtcctgcaggtgctcgatcagcttgatgaccgagctgatcgtctgctcgtcggcgggcagctgttcggtgacgtaggcgataagacacgacagcaggtttgccgccgcatgatcccaaaaaggctggttgttgtcctcgatggggcagatggcctttgccaccgagaggatgtcctgctggttgggcctgccgtccgccttgcggcgaatgtgcttcagggggttgtagccgcagcgctcgatgccgggcgcaagggccgggacggtgttgaggtcggcgaagttgagacattgcacgcggtaaccgtgggctgccagcacgggtcccacttcgcgacagagcgtgcctttggtgtcgagcacgatgtagcttgcgttcatttgcagcaggttgggcttgaggacgtttcgggtcttgccggctcccgaggggccgatcacaagtgcattgttgttgagtcccgtttggcgggtgtcgcaggaaagcgttcgatccttggcgaggatggtggacgatgcggactcagatgcggcgaggcggctggcgaggttagacatgggcgacctccttggtggtcgagaggatttcgtgggcaaagccgagctcgacggcgcgctcggccgaaaggtaggtgtcttttgcagtgagggactggatgcgcttgggcgtgaggccgctgcggtccgagaggatttgcgtgagggtcttgcgggtctgcatgagacgccggctggtttcctgcagcgcaagtgccgagccgcctgccccctgggggatcagcgggtcgtgaatcatgagctctgcatggggcgccatacggcgatcgtcgccgcccataaagatcacggcgcccatggacgcggcgaattccaggcagacggtgcggatgggacacgatgcgaggcgcatggcgtcatagatcgcaagacccgatcgcacgcttccgccggcgctggcgacaaatatggtgatggggcggctggggtcggtggcatcgagcaggcgaatctgctgacataggtcgtgggccatcggggtttcgatgtttcccatgacggagagctcgcgacgggcgagcatctcatcgtaaatgctggtgagcgtgatacctcgggcggattcgcgcatggtgagggggctgatgatgggggaatgattggtgtccatgaggactcctttctgttggttgtgttgtggaataggattgttgcccgcggaggggctggcgggctacagggttcgtccgagcctgagatcgagctcggttgtggggcaggctgcctgttcgtgcggctcgcaagcgccaagggctccaaagcgatggagcgttgcgacgggcgtggtgtaggcgagccgcagctgatgctcgacaggggcacattcgtcatttttgtaatgagccgcgtagtactgcgcgatactggcgttcatctcgctgccattgcgatggcgctcaaactggcgtctgcaggtctcgatgatctttgctaccgacttgggtgccgtcgcgggaacaagggcgagatagccctcaaatagctcgttgatgctcaggaggcacagcaggtcgatcagcgtccttatggctgctcccccggcggaaaagtgcgcggtcatgcggttatatcggtcgcggtcgacgatggccgcatggggtcttggagttttctgccccgtggtcccgggcttttgccgcgcctgtgtattgagctcgacgttgcagcgcttgaggccgtccaacggaaggaacagtgcggtgcgcagggtgttccgtttgctttcgagttcatgacgctcgtcgggttcccattcgagcttgagtttcgtgtcgagcgccgtaagcatatgggctaggcagcctacggtaagaacgtacgaatcgttgtcgcgttttggggcataggggtctgtcagcttgcgaatgtcggggtcgcccatgatctttgtgcagcgcttcagcagttgagggtagtcggccaagatcgtcgcgagcggtagcgacgcgtagttcttgatggtcgcggcggcaaaggcggcgtcatattcgtttgcatatgctcgctcaatgcgggcatctagaatgcttttcttatcgccgtcttcagcgtggtggtttgtcatagcttctccaatcggttgatgttcgtgctgtttgttgatgtgttggttgtcgtgagtgatgcgcttgccgtgggtgatgtgctgacgttggggtgctatgcggttttcaatgagcccgtgaggcagttgctgcaggggctggatggaacggcccatgcaaggcggaaggcatcgtgctcaaaatcgagacagcaatgccctgggtgcctcacatgtggcagttacctcattaagttgtcattgcgtttggggttgtactttgccgatcttccttctcttacacgctaaaactcaaacttcatatgctcgatctacttaaaaccgcaacggcggtcttttatcaacttatatgtcggaacgcgtctttgcaagtacttttttgcctttgtttcaaatggggtggttttgcaaccgtcatgcgcgcgctgtgcgaacgtgccccggctcggataagatagtgcgcgataaaaacgatgcaaggaggcatatatggcaatcaaagccatcgcgatggatatcgacggtacgctcaccaacgaccagaaagtgattagcccgcgtacgcgcgagaagctgctcgcggcgcaggagttgggcattaagctcatcttggcttcgggccgtcccgcatgggggctgcacgccttggcgcaggagctcgaccttcaaaaccatgacggtctgctagttgcctttaatggtgcgcatgtggtcgacgctcagaccgacgaggtgctgttcgatcaggctatgcctgccgacgaattgcatcgcctgattgatcacctgcgtaattttgacgtgattcctatgatttcgctcggtcgtgatctgcatgtcgaggactcgtaccattgcatgatcacgctgtctgacggctcgcagaagaatatcgtcaagtatgagcgcgatgcgtgcgatcttaagatccgcgaggtggagagcctgcatgaggttgctgatgcttatcccgtggacaagctgctgacggcgggcgatccggcctacctgcaggcgcattacgaggagatgtatgcgccctttacccagacgctttcgggcatgtttacggccgactggtactttgagtacacggcgcccggtatcgacaaggcccgcgcgctcgagggtgccctgcccaagcttggcatcgatgccagcgaggtcgtatcgtttggcgacggccagaatgacaagtccatgattgagtgggccggcaccggtgttgccatgggcaacgccgtcgatgaggttaaggcagtggcccagatggtgaccgccaataacaacgaagatggtattgcggtggcgctggataagctactgggttagaatcgccgattaatgcatggttcgggcgcctgcttgcgggcgcccttttgttagggagggtgccgtgtccgcgtttccgttcgacgccgttatctttgacatggacggcgtcattgtcgataccgagtattactacctgggcgagactgccgcgtttgccaaagagcttgggcttaatctgactcaagaggagttgaatgggcaggtcggtacctcgcatcagttcttcctgcgtatgctggtcgattggtttgagcgcgccggtaaggggcatttcactggcgaggaagcgttggcccgttgggacgagtgggcgcataagcgtccgcgcgactatcaggctttgattaacccaggcgccgtggatacgattcgagagctgccgcgccgtggcgttcgcgtggcgcttgccagctcgtctcccatggttagcatcgaggaagtgctcaacgcatgcgggctgtcggatgcctttgagtatgtggtgagcggcgagcagtttaaggagagcaagcccgagcccgacatttacctgcatgcgctggatctgctggggctgcccgcgaatcgctgctgctgcgttgaggactcggtgcctggcatcactgccggcaagcgagccggtctgacagtcattgccaagcgcgaggaacgctttggctttagccaggatgccgcggacaagattatcgaccagctgccggagctgctcacgctttcttaggagcgcggtagttgcgcgtttttcgggtctgatgagtaaatacccgacattttggtgcggcagcaagcatacttaatgctaatgcgggcttaagggcttgttgaatgcccttaagcccgttttagacgtaattgtgctgggagagggtatatgccaccgactgaagggctaactgacggtaaagcagcgataccgctgtaccaacaggttatcgatatcattaaaaacgaaatcagctccggtgcctacaaggcgggcgcgcggatacccaacgaattcgaattggctgagagctataaagttggccgcgttaccgtgcgacgcgctattgaggagctcgtccagcagggctatctaacgaagcggcaggggaaaggcacgttcgtcaatgcccctaagcttaagcgcaagattcgccagaaggatgacgtccagagtttttcggacgcatgccgcgttaacggaatggaggcgggggcgcgcgtcatttcgagaaagatactgccggcggattccaccgaagcacaattctttggtgttcccgttggaactgatttgatttgcgttgagcgtgtgcgtactgccgatggggtccccgtcatgctcgagaacaacatatacgtatacgaggacaacgcctatctatcaacggcacctctatctaaccaatccatttttgagttcgtgcgcaaccggacgggccgtacgcccgcgtttaccgacccgtgcacgctcgagatcgcgtgtgcgtcgcccgaggtcgctcggctgttggcggttcccgttggcgaacccctgttttacatggatgccttctttttcgatgagcagcggcggccgtttatcatcggtcgtcagcggatcgttggatctcgttacatttttgacatctaggacattgcgaatggaagcgcccggtggatcatctcaccgggcgtttccataccgttcacggcgcgaacgcaaccgttcagccgcgttgcggcaatcagtttgaaattatcttgatgatgggaaaaactgctggtaatctatggaacgtcatagaacgtttgccttgcgcaggcgttgaagcgagatgcgatgcagtctcgagttctttggaggtatctatgtcagatacgaaggcgaagaagacaaacagacgttttaagttcaaattaccgcatgtctatacgatcatgttcttgctgatcgttgtctttgcggtcctgacttggatcgttccctctggtcagtatcagcgcaagacgatttcgacagcggcgggcgagcgtgaagtcgccgttgctggaacctatgaacaggttgataagaactacaccgattccgagaccggcgagaccatcaatctgggccaggatatctttgcggtcctgcaagcgcctactaagggcatccaggaggctgccgacgtcgttgcgttcgtcttattgattggcggatcgttcgcagtcatcaccaagaccaacgctttgaatgccggcatgagccgtgtgattaaaaagctcaagaacaaggacatcctcatcattcccatcacgatgacgttgctgtccatttgcggcactacgtttggtatgtctgaggaagccctgccgttctatgccatcttcattcccatcatgatgggtatcgggtatgactcgatgacggcgtttatcatctgcttccttggtcctaacctgggatattgtgcttcgaccatcgacccgtttaatgttttgatcgcccaaggcatcattggtatcgagggcaatcctcagctgtggctgcgcgccgtttcttgggtcatcttcactgccgttggtatcgcatgggccatgcgctacgccatgcgtgtcaagaaaaatcccgagtcgtccattgtgtacgaggacgataagctcaagcgtgttgagttttccgtgaccgatgcctccatcgaggaagagttcactacccgtcagaagctcgtgcttatcgattttgcctgcggcatgggcattatcgtctggggtcttgttacccagggctggtacatgaatgagatttccgccgtgttccttggtatgggcttgcttgccggtatcctgggcggccttgaccagcagacgatcgccgaggagttcgttaaaggcattgccgactttgcgtatgccgctatcgtcatcggcatcgctcgcggtatcttggtcatcgcagagggtggcatgatcatcgacaccatcctccaggcgctcgctactgcactggccggtgcacctgccgccgtctacaccacgtttatgtatatcgtccttggcctgctctctttgctggttccctcgagctctggacttgcggcgctcaccatgcccgtcatgggtccgctgaccgagcttatgggcctcaatcccgaagccgccgttaccgcgctccagtttgctaatcagaccatcaacaccatcagtcccgtggcgggcatgacggttgccggtcttgccgtggcaaagatctcgtttggtcaatggtggaagaccatttggaagttcttcattttcatggtcgtctttggcctgatcgtaacggcaatctctggcatgcttccggcgtaggtggttgtgatgtctgatcgtttgacggtcctgacgtctaagagcgtctttaccggtacgggggacctgccgtttgaaggtttcgtagcggtccgtggcaatcgaattgaggctgttggcaccaagtgtgagctagcttcgtatttgacccaggcggacgaggtagttgacctgggcgaccgcaccgtcatgcctggcctgatcgatgtgcataccttctatacaggctgggcgctgcggacgttggggcctgatctgtccggcatcgctgatgccaaaggggccgtgtcgctcttgcgtgcatggaaagaagatcgtccggattgcgcggcggcttttggccacaacctacccgaaacgttggcatcggatgccgagagcgcaaatacagcagctgtgtttgacgagtgttttggcgatatccccgtcgtctgctttacaccgggcgcggatacctgtgttctcaatgctgccgccagtgcgcgatacggcttcacaccccaggcgtgctatgccgagaagatctggcgcatgatgagcgatttcctcgcgctgcccgaggtgcgtgcagggtattcggactacatgagcatgcttaacgaacgcggcgttaccgccatcaaggagatggcgtttgatgactactacggctttgccgacgaaatggctcgccgtgaggaatctggtgagctgacggttcgcgtctctatgatgtcgcagccggtgggtgccggtgcaaatcttgcatatgcccgcgaggcacgagagcgcttccggggaccgttcgttcgtttttctggcttcaaccgtatgaccgatcgcggcgtatgggcggggcttgccgagatgatagaaccctatgaggactcggccgatgcgggcgctgccggcaagacggtcgtcgaggagccagagtgggatctgattgagaacgagctgcgtgcaattgatgctgacggattccgatattccttgcattgccagggcgatggcgccgttcgtcgcaccgtggcgctctatgcctcgctgcctcgagacgagcatggacggatgcttcgccgccatgcgattaccgatctcgagaactctgacccgaccgatcttgtcgagtttggcaagttaggtggaatttgcgaggtctatccgcaggttctgacgctggaccgacgcgaggattgcctgtcgatgatgcgtcgacaaattggcgagacgcgacttttgcacagctggaatcgccgcggcatggaagattccggatgcacagtgtgctgtggaacggatttgccgctgctgattccgagcctgggcgagtcaatctacagcgcgtgcggcggattcttcgccgacggactgcctgtgaatgaggtcaacacgctgacgcttgtcgagctcttgcgcgcttggactgccgggggcgcgtacgatctgatgcgcgaagacgagctgggtacgctcgaggtcggcaagcttgccgatatctgcgtgctcgatcgggatgtgtttgacctcgattatcgcgacgcacgcgatcttgcggttgatatgacgatgtcggacggacaaatcgtgttcgatcgaaataaggaggcataagatgtctgaatccaaaccgacgctgcgccgcgagcagattgcgggcatgaatatccactacatcatgtggtcgctcgattacttccttgatgtgcagcagcgtttgggctttgagtccattgagctgtggtgcgcagagccgcatgtgacgctcgaccatacgggctactttgaggctgaggtcctggcgaaaaaggctgcagaccgtgggcttaggtatcgtactctgtgccccgagaacgttgtctatccttggcagtactgcgcacgcaagccgctgcatgaacagcgcagtctggcgtactttaaacacggcattgagcttgccgaggtacttgggtgcgaccgtatgtccatcaactcgggctggggcgactgggacgaggaccgcgaggaagcctggaagcgcagccgcgagcacttgtccattctggcggagtatgccggcgagcacggtctggtgctcacgatggaaagcctgcgtcccgaggagagcaaccttgtgacgacggtttccgatgcgaagcgcatgattgacgaggtcgcgagcccgtacttacagcccatggttgatacaaccgcgatgggcgttgcaggcgagacgctcgaggactggtttgccgcctttggtgatggggcaattcacgagatgcactttatcgacggtgacccgtatggccatctggtgtggggcgatggcaagcacgatatggacgccttcgttgccacactcaacgcccatggtttcgacggcatgctgggccaggaaatcacggacggtcgttactacgatgacccggcggcggctgatgccaagaacatggccgcattcgagaaatatctgattgactaaaacaactatcggccacgcaaccaacgtcattgattgcggcccaaacaagaaaggaactggatatgaacgcacacgatctgatcaaagaggcaattgccgagaagggcaagttcgacagcgtctactggattgcttgtggtggctccatgatcgatttgatcccggctcacgagcttctgcagcgcgaggcaaccaccttcacttcgtatatctatacggctcgcgagttcgatatcatgcgtccgcgtcgtctgggcgagaagtccctggtcattgcttgcagccacagtggcaacacccccgaggtcgttgagggctgcgagattgcccttgccgccggcgctacggtgatcgcccagaccgacaacgctggatctaagatcgactccggcaagtggaccacgtgggtctacccatggggcgagggcgtgccgcaggctgaggtccccgctggcatttcgctgtcgcttgcggccgagctgctcgatcagcaggagggctacgccgatcttgccgatatgtatgccggtatcgccgagatggataagattcttcccccggcacgtgagaaggtaaatgccgagctgggcgatcgttttgccaagctttgccaggagcacgagttcttctatattctgggcagcggtcccaactttagccagacctacggtttcgctatctgctctcttatggagatgcagtggcagcactgcagctacatccactctgccgagtacttccatggccccttcgaggctactcaggatggcgttttttacttcctgcagatgggctccagcgagtgccgtgctatggacgagcgcgccctggcgttccttaagacgcataccgatacgctgatggtgctcgatgccaaggagtacggtatggaagccgtgccggcgagcgtccgtgcctatctggacccggtgctgttctacgccatgaactgcgagctgcgtcggcaaggtgtttgatcacgatcccgatttccgtcgctatatgggtgttgtcgagtactagaagggacaaaggccatggcatttaacgttaacgcgctcggatttggcgacaacgtcgtcgatcgctacgagcatatccacaccatgtatcctggcggcaacgcggtgaacttcgccgtttatgccaagaaatgcggtgccgcacgttccgcatacatgggcatttttggcaatgacgccgctgccgagcatgtcattgcaagcctcgaggatgagggtgtcgagcttgacaagtgcgagcagatgattggcgagaacggagcggctcgcgtgaccgtcgttgacggtgaccgtgtcttcctcggctccaacgagggcggtatccgtggcgatgcgcgctatgtcctcgatcgctttgaccttgcgtacatgaagcagttcgatgtggttcattcgggcaactattgctttaccgagcgcgagctgcccaagctgaaggctgcgggcgtcacggtctcttttgacttttcggacgactccaccgacgagtactacgagcagattgcaccctacgtcgattttgccttctttagtgcggcggatgccgcgagtgaggacgagattcgcgagcgtctggcatgggtgaagggcctgggtccgcgttttgtgtcggctacggcgggcgccgagggctgcattgcttacgacggcgagcgttattaccgccagctggctaaaccggtaacggacatgaaggacaccatgggagcgggcgactcgttcctcacttcgtttttgatgtgctatctcgattccgccaagcgtggagaggatggcgccgaggctatcgagcgcgcgctcgactttgctgccgggtttgcctcgaccgtgtgcggcatggaaggttcttggggccacggagcaccaatcgtcgaatagccgagcggtcccggggaggtgcaggatcctccccgggacctcgtgtgcaaaaaatgccaaatatgagtactgtgactaatttagtcgcagcaaaatcaaccccttcagacgtgatttgagcgtctggaggggtttaagatttgcgaaaacgcaggatgaatgactgtaaaagctttaattagcggacaatcgaggattattctggcggttggaaagttaaaagaaatgtatccattccggtagcagtactcatatttggcattttttgcacaccaggggttagcgaaggtcaaaaaaagagcgcgcatttgttaaaactatcgactcgatgcgctttgcgtcgcagtttttgagcgaggtgatgcgttctgaggtccttgtgagcgacctgatgagcgactgcgcgcttgtttctgtgtttggctcggccggcgcatcggtctcgagcagtaggcggtcgagtggaatctgtcgtgcgtattcgcgaccgcgcttggtcgcgagcatgcgttcgttgacggaaaaatagcagcccgcattacgcgcgcgggtgagttcgtccgaagtgccgctaaaccagtggaagatgatagcgggggagtcggggtttgggatgagtagtccatgcgattcgaggacgtccagtacggctcctgccgaacgaacggcgtgaattgatatcacgcgcccggtaagaggatgctgcacgagcgcatcgcagagccggttaagtgcctgtatttgtagcggctcacttccagcaaagcgcgcggaaaagtcgagtccgacttcgccgatgtagcgttcttgggcagcaacttcgcaaagcagattgacttcggcaaaaccgcagtggccatcggcgagccaccaggggtgaagcccaacgccggcgatgatgcccgggtggcgacgagcgcgctcgtttgcggccgaaaagtcgcgtggatcgacgccgcaatcaaatagacccaagcccagcgccgttgcctcatcggcaacggcgtccgggtgagccattaaatcaagatggcagtgtgcatcaaataaccggggctccatctcggcgcgctccgctagtccaagcgctggccatcggcgcgcacgcgctcggtgccgcggccactgatctggcggataacctcgccggcaatcatctggcccatgatgggcggcataaagctggcggttccgagctcggtgcgctcgtggatattggaagggtcgcggggctgtgtcttaaccgattcctcgcagctaaacagtacatgcagactcttgattccgcgcttcttgcattctttgcgcatgatgcggctcatggggtcacgtaccgtatcgaaaatgtcggcaaagcggaggcactcgggatggagcttgttggccccgcccatggagctaaccaaacgaatgtcgtggtcctgagcatatttggcaatggtgagcttggccgagatggtgtcgatggcgtcgacgacgtagtcgagcttgccgtccgtctgctccaaaacgctcgcgaagaactcgtcgatattgtcgctcaacaggtattcggtgcgcttgatgacggtagcggctggattgatgtcgtggatcatggcttccataacatcgaccttgcgcttgccgatggtgctttgaaaggcgatggcctggcgattgatattgctgggcgcgatgatgtccttatccagaatgacgaaatgaccaatgccgccgcgggcaagtgcctcgcagcaattggagcccacacctccgcagccgagcaccagcaccgtggcggcggcgagtttgtcgagtgcctcgcggcccatgatgatctcgagcttggtgtcgcgtgtctcgttgggggttgcggctgtggtttcggtcatagacatcctccgatggggaagcgaatcgtgttttagctatcgtcattataggtattatcgcgattccatttgagccctaggggcttgttgaaatgaggcagtgattcgcataagatgaagcagatggcacccgttgccgcgggttggccaactcccaaacacgtttgtagcgtgagaagtggccgtcttcgcattacgcgagggcggctatttcattcgacctccaatgtggatgccgagctccacagccgcgattacaagcaataacaacgtcaggacatcgtcaatactcatagtccatctccttctcgggtagagggagctggcccatctgcttcaacttccattgtagctaaatacgaacgaatgttctatagatgttcctgtattagatagttagacaaacatctaaatattgagtatagtgtgcacgtcatgagagatgatgagaggaggtcttatgccgggagagggttttaaggcgcttgccgatccaacgcgacggcgcattttggagttgctgcgcgagggcaattgcacggcgggggagcttgccgagcatttcgatatcagtaagccgtcgctgagccatcacttggcgacgctcaaaaacgccgggttggtgaccgacgagcgccatggccaaaacatcgtatacagcttaaacaccaccgtcatgcaggatttaattggctggtttatgggctttacaaacacggaaggtgataaggatgaataacgaaaacaagggcattcaccccacgggggtatcgtcgcgcgtgtgggccatgcttgttgtggtctgcgctattaatgttgtagcgcacctcatggtgatgccgagcttgcctacgcagattcccacgcactggggcgcgaacggcgccgtcgacggttggggtcctagctggatggcctccgcgctcggcgtgctgcctctggcgcttctcgcaatgttctgcgtggtgccgcgcatcgaccccaaaggtgaggcatatcgaacctcgggcaagttctaccagggcttcgtaatcgccttcaccttgttcatgtgcgccataagctggctgggagagcttacggtctggggcgtggtgccggcggtcggttcggttaacgtgctgatttccggtgctgtcggtctgctgttcatcggcgtaggcaactacttgccgcgtgtgaagcggaactatacactcggtatcaagacgccctgggcgcttgccgatcccgagaactggcgccgtacgaagcgctttggcggtgcctgctttatggtgctgggtgttggcctgattgcgatgggcgtggcgggcagcgtgctttcgagtgaagtcgtcgccgcggtgattgcggttctggcgtttggttcggtcggagccgtctacgtctactcgtatctgctgtggcgcaaatcgcagcgagccgctcgttaaggttgcggaaaactagcgtacgcagttcatagtatgttccgggggacttttcccaggtagtattagggggtatgggcaaccatgccccttttttcgttaagtttcagagctggtttcctcatttcgtttccactaaagcgaatcaagaatagggaaacagcaggtagaaaggataaaacaggcaaatggcagagttcatctaccagatgtatcaggctcgcaaggcccatggcgacaaggtaatccttgacgacgtgaccctgagcttctaccccggtgccaagatcggcgtcgtgggccccaacggtatgggcaagtcgaccctgctcaagatcatggccggcatcgaggaggtctccaacggcgatgccaggcttacccccggctacaccgtgggcatcctgcagcaggagccgccgctcgacgacgacaagaccgtcatcgagaacgtgcgcatggcgtttggcgacatgatcgccaaggtcgatcgcttcaacaagatcggcgaggagatgtgcgacccggactgcgacatggatgccctcatggccgagatgggcaagctccaggacgagatcgacgccgccgacggctgggatatcgattccaagctcggccaggccatggacgccctgcagctgcccgattccgacatgccggtcaacgtactttccggcggcgagcgccgtcgcgtggccctgtgcaagctgctgctcgaggctcccgacctgctgttgctcgacgagcccacgaaccacctggacgccgagtcgatcctgtggctcgagcatttcctgcacaactaccagggtgcagtgctggccgtcacgcacgaccgctacttcttggataacgttgccgagtggatctgcgaggtcgaccgcggccacctctatccctacaagggcaactactccacgtatctggagaccaaggccgcccgtattgaggctcagggtaaccgcgacgccaagctcgccaagcgcatggaggccgagctcgagtgggtgcgcagctcgcccaaggcccgtcaggccaagaacaaggcccgtctggctcgctacgaggagatggaggccgaggcccgcgcaagccagaagctcgactggaccgacatccgcatccccgttggaccgcgtctgggcaacaaggtgcttgaggcccatcacctgcacaaggagttcgacggtcgcgtgctcatcgacgacctttcgttcaccctgccgcgcaacggcatcgtgggcgtcatcggccccaacggtgtcggtaagaccacgctgttcaagaccatcgtgggtctggagccgctgacttcgggcgagctcgaggtgggcgagaccgtcaagatctcctacgtcgaccagaaccgttccggcatcgaccccgataagaacctatgggaggtcgtctcggacggcctggaccacatgatggtcggcgagaccgaggttccgagccgcgcttatgtggcgagctttggctttaagggccaggaccagcagaagcgcgctggcgtactctccggtggcgagcgcaaccgtctgaacctggcgctcacgctcaagcagggcggcaacctgctgctcctcgacgagcccacgaacgatctcgacgtcgagacgctgtcctcgctcgaagcggcgctgctcgagttcccgggctgctcggtggtcattagccacgaccgcatgttcctggaccgcgtcgccacgcacattctggcgtgggagggcaccgacgagaatccgggcaactggtattggttcgagggcaacttcgaggcctatcaggccaaccgcatcgagcgcctgggcgaggacgcagcccagccgcatcgtatccaccgcaagctcacgcgtgactaggtttattgctggtttggttacgtaacatcaacaaataaaaacggctcaaatcctgatttggatttgagccgtttgtcgttactgctcgggttcttcgaccttgtcgatggcccaggtggctccgagaccgccggcggtgttgcggcggatgcgcacggtaacctcgcggcgatcgccggcctgcgtgtagcgcagggggaagcttgcgcggtttctcgcggcctcgatggtaccgcgctcgcgggcgatccagtagtactcgccgacgatgccgagcgtgtcggcgccgtaggggagataggtcgacagctggtgcagaagcgggccggggcagaagacctcggttgcgaaatcgacggggaagtcctcggggatggtcggtgctgcgggtgcgggggctggggccgctgcgggtgccgaagccggtgccggtgcgggaatttggccgcaagcagaggcgggcacggattcgatgaagggtgcgggctccggcgtcgcttccggcttgatcgtggaatctgcgggctcctcggtgacgggcgcgtctacagctgcggtttcaaccttaacctgcgttgcgttctcgttctcgacgctcgactttgcctcgatgggcgtggatgccatggtggtgatgccggctttggcgttctcggggtcatagacgaccgtgagcgagatggcgggctgcggcgtctcgggctccggcgtcgactcagtagcgccttgatcggcgggctcgtcgggctgatcgtcctcggcctcgtcgccaaagacatcgctgttttggaacgcagacgtctcgggttggttggcggcttcttcggctgtcgacttgggagcctcgttgagctcggcagtggcttcctgctctgacatgacttcgggatcggtcgtggcggcgatttcggtttcggcttctgccgttacctcaatagcggcttcgatccatgtctcgggctcgggctccggagcgacttcggccacggactcgggctcggcgcgcttaacgtgcttggggcgcacggccttgaggtccttctcaccgcgctttttctttttgtaggactgtttagcgcccttggctgccttgggcttgtcctcgcccttggcaagggcggcatcccaggcatcgttggcgatgacggtggcatacaggcgaccgcccttaaagacggtcagcttaatgcagtcgtcgagctcctcgagcagctcgcgcgtggactcgaagcccaggtcataagcggccatgtcaccagcggcgagtgcctcctcgacctgcgtcataaacgtttgcttgccgcacccaatcgcgtcgcgcagcaggcgatacagatagatgtggttgcccagcgaaagcgtgggcctaactattgtcttgctcatggcaaatctcctctttacacaccaaagcatcttaccatcgcgcggggcttgctacctcggcgcccaaggcaaacgggcgcgaccgttgccggttcgcgcccgttgtacaggttgcctatctggggatgcagcgcctagttgcccgatgtcgtgccttggcttgaactgtcagatgtcgtgcccgatgtggtgccactcgaattgctgttgttgctgtctgctgtgcccgttcccgacgtggtgtcgctcgtctggctgcccgtgttcggctgcgaaccgtcagccgtttggcttgagtcggtcgtgccggacggcgtgccactgttggccgtagaggaatcggtgccctgcgattggttttgggtgttcgaggacgaatcggtagaggtagaactgtcttgcgtgccgtccgcttgtgcctgctgatcttgcgactgggtgttgtcatttgcatcgctctcggtcgtgcgcgacgaaaggattggctcggggcgctcgcccagaccctcgccggcggtggtgataaggatggcgccggcgcaggcgatgaccgcgacgatggcgatggcgatcgagaagacgatgaccttcttttgcgtctggctgcgctctgccgccgccttggcgcgcaggctgtcgggagcgacgcgcgccgtggtcgcgcgccccgcaatctggcgcatctcctgcgtagtcgcggcgccgcctaggtgctcctcggcattaaactcagcgggctcgtaggcgccggcagggtagtcgacggcggcgtgcgtacctttgatggcttcggcgctggcagagataaagtggcggtagacctgcgatgacacaacggtgatgaccgagctcacggcggcaccaattactgaaccagcgataccgatcttggaggcaagcgcgacgcttgtggcggcagccgcggcgccggcgatgatctggggaatggaaatgtcgtcgaacaggccctttttgggcgcgatggccatggtctgtccgatggaatggttctcgtgcacgccgttgttgagcgatgccggcgtcatgacgcgcgtgcgcggcgcgtcggtgtacttggttgtcatacggggtcctcccggtgtaaatctgcttcgtttcatgtagccatcagggtacccaccagatgtgaatcgtacgtgacatttaacagataccatcaactcatcaaggggggcttgctgtctttggtgcaatagcttgatgctaaactggatttacgattgtgaggtggtttacgtgatgtacccgtatatgacattcgaagacggtaccgaggtcgttcattctgacctgataacagatggggatatcgaaaaggttatcgcgcattttgaacgaccgacggcagagggcttcgactccgctcgttgtgagttgccttcctgttcgtggactgactgggaagggcattttactcagagtgaaaaacgagctttcgaagagtgtttgagcaaatcatttagattagttcgagtttagttcgaatatagaagtcgaatgcgatgacctaaagcgtatgcatttttagtattagatgcgtatgaaatggaggatgtgaatggatgagctaatagactttaaaaaacgatttctcaagaatggcgagctggtttcaattccaaaaaaggaaagctataaaagaatcatgctgctatggaccgtctctttctttgaattaaatacaagttatacggagcttcaggttaatcgtgtgctgtcacagctctatcctgattatgccgtgttgaggcggtacttggttgattatggattcctattaagggatgagcgaggcctgaaatacgaggttaatcgtgatgttcacggtattgagagctagccgtccggttcgggtcctatatattgctagagggataagcgaaataggcaattggtgtgcgaatattgctttgccaatgctgatttacgaggtaactcacgatgtttctgcaactgctttgatggtctgctgtagatttgccccctctctgttttcagttgcgctcgcgcagctgcctcagaagatgggtatcgggacactgcaggccatgagattggcagacttaattcgcgcgggattattcgtttgctatatttttgttgatagtaaatggagtatgtttgctattacgtgcgcggtatcgctttgccgaacggttgaaatgccctgcttttactcgttgttaagagccaatacgaatagtatcaatcgcgacgtaattaataattcgtttgggtttctgcagaatttgatgatggttctggggccagttgccggcggttttgttgtcgctcaatttggggcggaggctgttcttgcattagacgcgctttcttttgccgcgtcgttctggttgctgcgagatgttccgtcggttatcgaggttaatgataaagaggggataagcaaaaatgaaaaaaacaggactgcatttagtgatcttagcgcgaagcacttggcaattggtttcctattaatcgatatttctagtggcgtggcattcggctctctgaattctcttttgccagctattgcgcaattgcaatttgactcgtcatcgatacaatacggattccttcagagtagtcttacaatcggactgttgttcggaaatacaatatatggtcgtttaattagtggttccgattgcgttaaatcatattgttttgtgacgtatcttgcgctcggtgcgtatctggcgtttggctatcgctatgcgtctgggatatcgtttattttcctttttatcgtcggtgccggaaacgccattcaagatgtgcttctcataacatcgctgcaggatttggcgagagacgaatctgaatcgataagcctgttttcaattagggagtctttgcaatcggttgctgttgttatttcaacactccttgtttcgctgttcacgagcatcgcgatgttctcaattctcgttacaggacttggtgtattttcaattatgatggtagttgtgtctcaattgaattatttgcgaaagatgtgacgttgatatgcctaaaacgcttttagtatttcccccatgatggagtccagtggggccgtatcttgccttgcctgttttgaagtcatatcttcaagaggttgaacaatataaagttgacatcgttgacttaaacgtggaattttacgatgacctcctatcttttagacatgtcgaagagtgctgtaaaaggtatcgggaatcaaaggattcgtttagttcgaatgttcaattaacaatcgagttgatacaaaagtcagcacttaatgttgacgaggcaaaagatattttcagatcgaagagatactttaatctaaaagaaagacaatatgctgaaaacatttttagaaatgcactctatatcataaatcacgtctcatatggagttaaatacacgttcaactccatagatctgccctatgattattattcgacaccagaaataatgaaatcgcttgcggataccttgcataatccgtttatttccttctatgaaactgcctttcttaagcgtattcagagggaaaaaatcgagtttattgggatttcggtgagcggctgtttccaattgatttctgcagttacgttagcgaaactgattaaagaagaatgtccatctgttaaacacgtctcattgggcggcaattacattactcgtttagcagatgactgcatgaaagaatggcatcccttttttgaatacattgattcgataatgatgtatgacggcgaagagccgcttgcacgtcttcttgaggctcttgactctggtgatgacaatctcgactgtgttccaaacctttgccatgctaaaggtggaaagatatataaaaaccatcggattgagcaaacatttatcaacgatacagttcccgatttcgatggcttcgccctttctaaatacttcatgcctgagttaatattgccggtttattcttctaggcagtgttttaatcattgcgccttctgcaccattcccggtgctaccggtggttgttaccgaaagatgcctatatcgagagtatttgaaataatgtgtcggttaaatgaaaaatacggcacgagagttttctcttttgtggatgaaacattcgaaggcaaaagaatggagcaactcgcggatgaaataaacgcatcgggaaaaacgtttttctggcatggagaaacgaggttctctccaaccctaagtacagacgttttcaacaagatataccaaagtggatgtaggcagattcagtttggcctcgagtcatacaaccaaagagttcttgatctaatgaagaagaacacgagagttgattggattgatcgcaatatccatgattgtctcaatgcgggtattcctgttcatctattctttatgattggctttccgaccgaaactaaagaagaggctctgaacaccttagcttatacagagaatgttttgaattattcaaaacaggtatgtggtgttccatattccacgagaggatttacgaattttggtctcgttatggggtcggatgtttggaatcatcccgataagtatggtgtctctgtaatgccgaagtcccaatatgaggatttgcgcctcgaagtggattatgtttcaggcactggtttaactttaaatgaagcaaaatccttatctgatgagcatcatattgatttttatatgcaagaagtcataaacggtagcgacacaattgacttgccccagcggcttcatatttcagaggtgacctggatcctagattctattcacgctgtcaggtataagggacatttgaccaaagtaaagcgacggctgactagtctaaatccagctgatcgaatctggctggattccaagacctctgtcgtgctcgttgagccatttgcctacttctataattctgaataccatcatgtctatgctgtttcccagttggtataccttaagttggcccgtttattggaggccgattgtagcatttctcttatccttgatcagggcgatctcgagctgacaagggcgatagaagaactgttgcattatggattgctgaatacaaatatcgatgccgattatgtaatgcacgataatggttttcaattggttaaaagttcgtttgtgaaagaagtcggacgctcaaaagaggggttaagagtactgctgagttgtgccacccatagaatgtgtgcggttaatgatttttcgttcgctttgctttcgttgtttgaaaagccgattactaagaacgaggtgcgcgacattttgaaaaaagagggactatcggcaagcgaggagcaattaaacaagttggttgataattgcatgaaagcagatatactacaattgattagatagaggaggtttctgcatggacgttattaacaaagatctcttggagcaactgaaagagtttcaggaagagggcgtcgtggtagaagtgttcgactttgaggactacatggataaattctgccattagtttcggaatttactcgcctcacttaaaggagaagtcgattatcgatttctccttttttaattaaagatatttttgaaatacatgctcttagcacaggttggcctctcagtaaactgggaggttgctttggctagttagagatatgtgaacgtccgttagactgaatctcagggtagaaggggcctccagtgtccagatcaacaaggcaatgctgcgtttcggctaataagaacgatggctttttgcgtgtggcggcggcgtcgccgcagattcgcgtggccgatgtcgagggcaatgccgaggttgcgttggcggctgttcgcgcggctgtcgagcgcggcgttcgtgctctggtgctgcccgagcttaacctgaccggttataccgcggccgatctgttccataaccgcacattactgcatgcctgcgagaccgcactggcacatattctcgatgaaacccgcgagctgccgattgtcttcaccgtcggtcttcccgttgcggttgccgagaatatctacaactgcgccgccgtgtgctgcgcgggcgagcttttgggtcttacggccaagaagtatctgcccaactatggcgagttctacgagcgccgctggtttgctccggcgcccgcagatcccgtatgggtcgagtttgccggtcagggtccggttccgctgggttcggggcttgtctaccgttgctgtgatgagggtgctgaagacctggtgctgggcgttgaggtctgcgaggacctgtgggtgccggcgcccccttcgaccgagatggcgcttgccggtgcaacggtgatcctcaacccgtcggcctcggacgagattatcggcaaggcagattaccgacgcagcctcatatccaaccagagcgcgcgcctgtactgtgcctatgcctatgcagatgcgagcgagggcgagtccacgaccgacatggtctttgcgggggagaacctcgtctacgaaaacggctccaagctcgccgcgaccaaactgcttacctgcgatatggccatcgccgatgttgacctcgaccgtctggttgccgagcgccgtcgctcgacgacgtggacgcgtaccgacgatgcgccggaggccacgaccgttgaattttcgtttgagggcgtgctggccgaagagcctgtcctgcgcgatgcgttcgacatcgaccgcgtcttcccccgcgcgccctttgtgccggccgaccatggcgatctggccgagcgctgcgagactattctcaatctgcagactgctggcctcaagacccgccttgcccacacaggtaccaaggctgcggttatcggcctttcgggtggcttggactccacgctggcactgcttgtgaccgtgcgtgccttcgatgcgctggggctgccgcgcacgggtatcacggccgtgtccatgcctggctttggcacgacgcatcgcaccaagtccaatgccgagtcgcttgcccgcgacctgggcgtgagcttccgcgaggtttcgatccacgcggccgtggagcagcactttaaggacattgagcacgatcagaccgtgcaggacgtgacctacgagaacagccaggcccgcgagcgcacgcagattttgatggacttggccaaccaggctggcggttttgtcatcggcacgggcgacctgtcggagctggcgctcggctgggctacctataacggcgaccacatgagcatgtacgccgtcaacgcgagcgtgcccaagacgctcgtgcgtcatctggtgcgctatgcggctgatgtctttggcgggagtattgccgaggtcttgctcgacatcctcgatacgccggtatctcccgagcttctgccgcccacgggcgacggcgagattgcgcagaagaccgaggatttggtgggcccgtacgagctgcacgactacttcctctactacctgctgcgttttggctttgagccgggcaagatctaccgcatggcgctcaagagcttcgagggcgtctacgacgccaagaccgtccacacgtggctacgtacgttctatcgtcgcttctttgcccagcagtttaagcgcagctgcctgcccgatggtcccaaggtgggctcggtgacgctcagcccgcgcggcgattggcgtatgccgagtgacgccagctcacgtttgtggcttgcgcagatcgacgcgctcaatccaattgactaaggttggctaaattgaaccaatacgggggttgcaagcgttacacttttgcaatctgatggcccgtatcgcgcggcgctcttgtcggagcgccgcgttttttatatcgaaaggtggcaccatgcaggcatcgcagcgtctcgaccgctttggcgcggaggtcttcgcctcgctcaacaacaagcttctcgcgctgaaggctcagggcaagaccatttacaacatgagcgtgggcacgcccgactttaagccgtacgaccatgtggtcgaggcgctcacgcaagcagcccaagatcccgagatgtggaagtatgccctgcgcgacctgcccgaactcaagcaagccgtgtgcgattactatgagcgtcgctttggcgtttcgggcattacgccgtccatggtgcagtcgtgcaacggcacgcaggagggcgtgggccatttgggcctggccctgctcgatccgggtgacaccattttggttcccgatccgtgctacccggtctttgaggcgggtgccaagatcgccgatgccaagctcgagtactatccgctggttgccgagcacaattacctgccctatgtggcgggcatcgatcccgaggtggccgaccgtgccaagtacatgatcgtgtcgctgcccgccaacccggtgggctcggtgggcacgcccgaggtctacgaggagatcatcgcttttgcccgcgagcacgacctgctgatcgttcacgacaacgcatactcggacatcgtgttcgacggcgagccgggcggcagcttcttgcagtatcccggcgcgctcgaggtaggcgttgagttcttctcgctctccaagtcgtttaacgtcaccggtgcgcgtatcggctttttggtcggccgagaggatgtggtctctgcctttgccaagctgcgcagccagatcgactttggcatgttcttcccgatccagaaggccgccatcgcgtgccttaatggacctcgcgatgaggtcgaggcgcagcgtctgaagtaccaggagcgtcgcgatgccctgtgcgacggtcttgagggcctgggctgggagcgtcccaacgcgcatggctccatgtttgtgtgggccaagcttcccggtggtcgcaccgattccatggcgttttgcgaggagcttatggagaaggccggcgttgtggtgacgccgggtgcgagttttggtccctcgggcgagggacacgtgcgcatggcgttggtcctgccgcccgaccagatcgctttggctgtcgaggccattcgcgaggcgggcctgtattagaaagctattttggctcgtcaatatatcgaaaccgatttcgtgcagttattttacgaatcctgcaaacaatttcggcaaacggtcgatttttggctgcgaataggagcataatcaaagtcccgattggatgtattgggattacgacaagccgctcgggtcgttcccgggcggcttgtttgtggagagagatgggagtttctaatggttaacgagaagaaggtcgctattgtcggctgcggtttcgtcggttcgtcttcggcgttcgcgctgatgcagagcggtctgttctccgagatggtcctcatcgacgtggacaagaaccgcgccgagggtgaggccctggatatcgcgcacggcatgacgtttgccgagccgatgaagatctacgccggcgattattccgatgtcgccgacgccgccatgatcgtcgtcaccgctggcgctgcccagaagcccggtgagacccgcctggacctggtcaacaagaacgtcagcatctttaagtccattattcccgagattaagaagtccggctttgacggcatcctgctgatcgtctctaacccggttgacgttctgacctatgccgccatcaagatgtccggcctgcccgagggccatgtcatcggctccggcaccgtgctcgacaccggtcgtctgcagcagatgctcggcgcccacgtcgaggtcgatccgcgcgatgtccaggcctacgtcatgggcgagcacggcgactccgagttcgtcgcctggtccagcgctcaggttgccggcgtgccgctgagcaccttctgcgagcttcacggccatctggagcatgaggctgccgagaagcgtatcgccgaggacgtcaagaactccgcttacaccatcatcgagaagaagcacgcaacctactatggcgttgccatggccgttaagcgtatctgcaccgctgttatgcgtgacgagcagaccgttctgcccgtttcctcgctcatggtgggcgagtatggcctgtccgatctggccatctccatgccgaccgtcgtcggtcgcgacggcgtcgtctgccgcgtccctgtgccgctgaacgagtccgagcagagcgagctcaccgcttctgccaaggccctcaaggacatcatcgacagcgtcgatttctcctgctaaatccggctcgtttgccagcaagctacaatgaaggcgtccgggccccacggcccgggcgcctttttggtgcaagggggtcaggtttgtttgcaccaaatggggcacgattggtgcaaacaaacctgaccccaatgcaccattgttgatgggagaggcatgtcggattcgcctaactttttgagttatgcccagacggcgttcgattcgtttgaggagcggccgttttgcgcggtggacagcctggtgtttgcatggctgtcgtatttgcgcttgccgggggatatgccggagcttgccggctggcagggactggacgtgcgtgagctactgcgcgccgagtgctaccgggacatgattggcgacctgtgggatccggaggagagccgcgccttgttggaggctgttgcggcaagtccgcgctaccgcggcgtgcgcgtgtgcggataccgtgccgtgagcgacgtggcaacgacggagcagtttgcggccatgacgttccgattcccggcaggattttcctatcttgccttccgggggaccgacagcacgatcgtgggctggaaagaggactttaacatggctttccggtgtcctgtgccggcccaggaatctgcggcgcgctatgtggacgaggcggtggccgcgattgatggtccgctcttgtgtggaggccattccaagggcggaaacttggcggtgtatggcgcggcgatgtgctctgacgctgctggcgaccggatcgaacgggccttctcccacgatggccccggctttgtcgaggagttcctgagcggtgacgccttcgcaggtctttccggccgcatcgacaagaccctgccccagtcttcgattttcggcatgatgttcgagacgcaggaagattacgccattgtcgagagcaccgaattcagtctgctgcagcacaatccctttagctgggtcgttgacgactacgactttgtgtattgcgagcgtctgtctgccggcgctcgatacgtcgatagctctattcgcgagatgctgcttgcagtggggcctgccgagcgcgagcgctttgtagatgcgttgttctccgtgtttgaagccacaggggccgaacggttcgcagatatcgcagggaatttgcgcgagagcctgccggtgatgctccaggctgctcagagcttcgacaaagatacgcgccgtttcatctcgcagaccgtcgtcgcaattcttaaatgcgccctgctgcccaagcgttccgagctcaacgttcctgctgccggcaagagcctggcagagcagctcgaggcgtggcagtccgagctcctgcgctaacgctggtgcaaaggggcatgttggtgcattggggcgggcacgcccgctatactgattcgtgctgaaatcgatctagaacggaatgccgtatatgaaaatcaatcacgcaatcctgcatatcctggactttgactcggccgtcagcgtcatgagccagcgcgagctcgatatcgagagtcgcaccgtgcgcaacttcgtgaccacgcatctgcgtcgcgcccgcacgtctgccgataacaagcgcgccacgtttgccgagaactccgcattcggcggtgaactcaagggctatttctttggcgagcgcgaattcgtggacctgtcgcagcagattgcggagttcatctcctcggagcttgccaaggccgaaaaggccgagtctaccgacgtgcttgtggcggactttgacgacgatgaggacgcccgctggtttgctgtcatgttacttgggtccaagcaggcctttatgcacgaggtgggccgcgaggagggcgaggtgcgcaacgacatcgcgcgccactatgctattctgccgaatccttcccaaaaggtgccgagctacgccatcgtgcgcgcgagcactatggagatcggctatgtggataagaagcgcaagattgccggcgaggatcgtatgctcattcccgacggcctgctccagtgcgacacgggcgtatcgggcaaggaggtcatcgacaccgtgacacgcgtggtcgaggaggttgccgaggaacacggcgccaacgcggctgtggcgctcgccaaggtcaaagccgctgtagccgagaaggtcgaagacgacgaggaactgccgccctgggatatcgtcgacgaggtctttgaggacgagccggtcatcaaagagagcgttcgtgcggcattgaccgaggaaaaggtgcccgagcgcgtgcccgtggagcgtaaacaggtcgagcgtgcggccgtgcgcaatcataagattcgaaccgatacgggtatcgagatcagcttcccggccgagatgggctcgaactccgagtatatcgagttcgtcaacgagcccaacggcctcatctccatcgagctcaagaacatcggaagcatcgagaaccgatagcgcaatagtttcttccaaagagaaatctggattatattttgaagtatactttgaaatataatccagattatttttttggaggtacaaatgtccccacttgttctggaaaagccggtgtttacaaaagatcaggtagtttctgccaccgaagcgagcaagtccttatctgtcgttcgcaagcgcgctaagcgcgcgccgcagtttatcgccgatcataacgatatcgataccgtgattatcgactacgccgcctatgaggaaatgtacggcgccctacagtaccttcgcgaacttgagcttgatcgtattgcggcagatcgaatcaaaaacggaccgcatgagtttattccgtttgaagataccctgactcctgaggagctcgcggagttcgaatcgatggactccgacgcgatttcggatgagggtcttttcgaatgagcgggcactttgtcgtcggctttttgaatcgagacgtcgagaaggaatatcaaaaactagatggttctcagcgaaggctcgtccgcattgcagtggcgaaattaaagacgcgcgccgatgaaatcggaacgccgcttcacggtgagcttgccggctgcaaaaagattaaatggagaaaggcgggactccgaatggtatttcgaattcgagaggacggaacggttgagattgccgagatcgttgcaataggtcgacgcgaccgttcagaggtctataagacggctgccgatcgtttgtcgaagcatccagccatggtcgaatacgacggaaccttgagataaagaaggccgaagccctggttggggcttcggcctttgttgtttttagcttggttgctgacattgcgccgcaggttgagcatgcgtcagcgaaaacgccccagagcgagcaaggtgacgtgaaagaggagggaagcgtactttggtacgcgaccgacgattgaacgtcagattgccgcctaggggcgtttgcagcgtcgagtcgttacggcgtttggtaaaacgccgtaactgttaaagctggcgcagaccttcctcgagaccggtcttgctgtcggtcttctcgtcgcgcatcttgatgacgcgggcgggaacgccggccacgacggcgccggcagggacatcctcgacgcatacggcgcctgcagccacgacggcgcccttgcccacgcgcacgccttccaggaccacggcgttggcgccaatcatgacatcgtcctcgatgatgacgggcgtggcgctcgcgggctcaacgacgcctgcaagcacggtgccggcgccgatgtggcagttcttgcccacggtggcacggccgcccagcacggcgcccatatcgatcatggaaccctcgccgataacggagccgatgttgatgatggcgcccatcatgatgacggcgcggtcgccgatctcgacgcggtcgcggatgatcgcgcccggctcgatgcgggcgttgatacccttaaggtcgagcatggggacggcggagttgcggcagtcattctccacgtcgtagtagtcgatggaatcggcgttggcgtcgaggatggccttgagctcatcccagtcgccaaagacggtcttgccgcgacggccgccgtagacgtgcgcatcgccccactggactttcatgccgggcttctcgcgcacatacagcttgacgggcgtcttcttgggcgcggtggcgatgtagttgataatctcctgtgcatccatctcggctgcgttgctcatatcttgtttctcctttacgcgggcttggttaatgattggctaggcgaacatgacctggtcgaaggtgtagaagccgggatcacggacgacgagcttctgagcggcggccagagcgccgttgacaaaaatctgacggcttgtggcgcggtgggtgagcgtgacctcctcgtcctgcccaaagaaactcacctcgtgcacgccggcgacggtgccgccgcgcagcgagtgcatgccgatctccttggggtcgcgcgcgccgcacatgccctcgcggccgtggacggggtgatagccggcctcgggctcggcctcgaccacggcgtcgagcagtagcttggcggtgccgctgggggcatcgaccttttggttgtggtgcgtctcgacgatctcgcagtcaaagccgggcagctcgcgcgtggcctgggccaccagatggcgcagagcggcgatgccgattgagtagttgcccgagtgcatgacgcgggcgttctggcccagctcgcgcaggcggtccatctgctcaggcgtgtagcccgtggtgccggaaacgagtgcggcgcccgtacgctcgacataggcaacgacggcatcaaaggtcgcgacgttcgagaagtcgatgatcacatcggcagccggagcgctctcgagctcggccaggtcaaagccgatctgggcgacgatgtcgaaaacgggttgaccggcggcaccaacgatgctttcggcggtggtgcggatgagcgagcccatgcggcccgttcccataatgacggtcttaatcaagcagaccagctcccttcagagcatcggtaagtgcggcgcgcgtgtcgtctgccatggggcacagcggcatgcgatagttggcctcgatcatacccatctgggcgagcgcttccttaacggggatggggttgacttcgctaaagagggcgttgatgagcggctggccggcaatctggatctcgcgggcgcgctccacgtcaccgtccaggtaggcacggcacatgtcgtgcacgagttgcggctgcacgtcggcccaaacgctgatggtgcccgaggcacccaggctcatgagcggcacggtgagcgcgtcctcgcccgaatacatgcggaagtcgttggacagcaggtgcgcgatcttggcggcataggcgacgttgcccgaggcctccttgatgcccatgatgttggggtgtgcggccaggcgctcgacattgcgctcgctgataccgcagccgcaacgaccggggatgttgtacaagatgcaggggatgtccaccgcatcggccacggtcttaaagtgctggtagatgccctcttcgttggacttgttgtagtagggggtgatgagcagcaggccgtcggcgcccaggccctggtaggtgagcgacttggtgagcatggtctgcgtggagttggagcccgacccggcgatgacggggatgcggcctgcgacctgcttgaccacggcggcaacgacggagttgtcctcgtcatcggtcatcgtggcgctctcgccggtggtgcccagggtgaggatggcgtcggtgccattctgcaggtggaaatcgaccaggcgctcaagcgcatcaaagtcgacgctgccgtccttcttaaacggggtgacgagggcgacgatcgagccctcgaggttgcggacgtccatattcttctccttcgcttctgcgatctggatgcgtttgttccattgggtggcgacggctaggcgctcgtcctgagcgcgacggcgggcgctttcggcgcgcgactaggccagcaacttgcggccgcacggcagcacgtcgagcgtggcaaagtagtcgcccgggcgctcggcacgacggataagatccgccgagccatcggggcgaagcaatacctctgcggagcgcaggcgtccgttgtagttgtagcccatggagtagccgtgcgcgccggtatcgtggatcacgagcaggttgcccatatcgatctgcggcagctcgcggtcgatggcgaacttgtcgttgttctcgcacaagttgcccgtgatgtcgtacttgttcgtgacaggggctgtggatttgtcggggccacccggctggcccatcaccgtaacgtgatggtaggcgccatacatggcagggcgaatcaggtcgacggcgcttgcgtccacgccgatatagtccttgtaaatctgcttttcgtggatggccttggtgaccaggcatccgtaggggcccatcataaagcggcccatctcggtgcagatcgccacatcgcccatgccggcgggaaccaggatctcgtcgtaggccgcgtgtacgccctcgccgatggcgtggatgtcgttagcctgctgcccgggcaggtaggggatacccacaccgccggacaggttgataaaggcgacatgcgcgcccgtctcgcgctccagacgcacggcaagttcaaagaggatgcgcgcgagcttggggtagtagtcgttggtgacggtgttgctggcaaggaaggcatggatgccaaaattctcggcgcccttggccttgagcatacggaaggcctcaaagagctgttcagtggtcatgccgtactttgaatcgcccgggttgtccataatgccgttggaaagctggaacagaccgcccggattaaagcggcagctgactgtcttggggatggggcccgcgacgcgctcgtagaactcgatgtggctgatgtcgtcaaagttgacgatggcgcccagcttatcggcgagctcaaagtccgctgccggcgtgtcgttggacgagaacatgatgtcatggccggtgatgcccagcgagcgggcgatcatgagctcggtatagctcgagcagtcgcaaccgcagccgtattcgttgagaatggagataagcgccgggttgggattggccttgacggcaaagtactccttaaatcccggattccacgcaaaggcgtcacgtacttcttgcatgttgcgacggatgcccgcctcgtcgtatagatgaaacggcgtggggaactgctcgacgatgtgttcgagcgtctccttgtccacaaacggccgctttgccgcatatgcctcgttgggggtcagtgccatgtcccgtaaacctcgctatccagacggcgccatcggcgcatcgaatccgcatagcgtggacccaatgtccggatagcgctcccgcattgctgcagacagtcctgcgggtgtttcccgcaggcccaccaggctgttcgtgcccgaaaaacccagttcggcgggtttcgcctccccgcggggtcaaagtctgccgactcgcccgcggatcttcgtgcccgcgcctctatcaagtggtaaagaccctaccacgttgcactttaccaaacaagagtattcgtatataacgtttaaaaaatgcagggatatgctagaaacaagggcgtcacaattctgcatcacaatattgtgtgaatggaaatgccccatgaaaggatcctttatgaccgagctccaagaacttcgtcgctatcgtcgcgacctgcatcgcattccggagctcgatttcgatcttcctcaaaccatagcctatatcgagggcgtgctcgcctcgcttgcctgtgaagtgacccatccctgccccagctgtgtttgcgctttcttcgacactggcacgggcgccgcgcatgccacggcgattcgcgccgatatggacgcgctgcccatcgcagaggcgacgggcgcggcctttgcctcgacgcatcccggaaagatgcacgcttgcggacacgatggacacatggccatggcgcttgcggcggcaacctttgtcgatcgcacgattcgtgagcagccgggtgccatcaaacgcaacgtgctctttgtgttccagcctgccgaggagacgaccggtggtgccaagacggtatgcgagagcggggtgtttgagcgctacggggcggaccgtatcttcgggttccacgtatggcccgacctgcctgcgaacgcgttggcgagttgttccggcccgctgctggcgcgttcgagcgagacgcacgtgcacattcacgggacaagcatccatatcgccaagacctacggcgttcccgtacacgaatcgcacgatgcggcgctggcggctgccaagttcttggttgccgagcgtgaattgatggacgagttgggtgccgacgagccctgcattggtaagttcggcctgctgcaggccggtaccgtttgcaacgcggtggcgggggaggcccatgttgccggcagtctgcgtgtgtttacggacgacatgttcgaccgtgcgcgtgagggcgtgcgccgtgtgctcgacgaggcgtgcgctgcaacgggctgcacgtacgatctcgactttgccgagggctatccgccggtcgacaacgcccccgagttgtttgcccgaatcgcgcccgctctgcccgagttacagctcgtggacgagccgctgctgattgccgaggacttcgccttctatcagcgtcatctgccgggtgtgttcttcctgctgggcacgggcgtgccggagggtcaagaaaacccgagcgattcggacggctgttccgcctatgccacaagcgccctgcatactgataccatgctctttgacgaggaaatcctgctcaaaggcctcgatgtttacaaacgactgcttttgcttgcttaagtgtcgaaggatacctgttctagaaaacacgaacagatgtacgctataatagagatgtaagtctatagaaacgtttgacgttattaacgtaaggcgatactatgattgcatcttatcgggtctgctttgagtggagacaggggatggcttggaatgtcgaaatcgtcgattaccacaaatgaagaggctgcgactgatttgctgtcgccggtgactcctggtgagcttctcaaagaggagtttcttgttcccatgggcatttctcaatatcgccttgcgaaggagaccgggattccggctcagcgtatcgggcagattgtcttgggaagacgccgtgtgacggctgacacggaccttcgtctttgccgttactttggtctgacggatggttattggcttcgcgcgcagatggcgtttgatctcgaggccgagaaaaggcggattaaacctgagctcgacaagattgttcctgtccagcaggccatcgcattgtagggcccaaagacgctgagaatggagtgacgatgaagcgacgtcggcaatctgttgtatatagtccgggtggttgcgggtgcggtttgttactgctcccggttgttgtgctgagcattggcatgatgtttgcacttgccggattggctgcggcggcgctcgtgttgctgattgtcgccattggcgcgacgatctggctctatcgttgtcgcgaacaacgccgcgccgacggcaaaaccaatgtgggatggattgtctttttggctatcgcatacccgctgagcgttagctaccttatgttctttgtcctgttgacgatcagcgcctttaccggggaatccgtcacagtgggttgatcctgcctgctgacggtcgcgtaaagagcgtttgctcggcgcttggacaactgcattgaccgtttaccgtagccttagctctgagctaatgaattcaagttcaatcctttctacgatgtgctgtgtgccggcacggtagccggatcgtaggaaggatgaataatgaaaaagctcgaaaatgaagtgctgctgagccgtcgcgccgcgcttggcgcattcgcgaccgttgtcctgggtgtttccggtctcctgactggctgtggcaatgacaaggcgacggtcaccgaggatgctggcgatagcgataagaaggaagagccgaaagacgatatgagaaagccattggggtcgcctcccccgcgttgcagtttctttccggacgccgccctctcaaggcggagatcaccagttcgaatctggtacgggctaccacttcttttctgctgaggcttatggcccgttcgtctagcggtttaggacgccgccctctcaaggcggagatcaccagttcgaatctggtacgggctaccacgcatttgatacccgggcttcccatggaaggccgggttttttattttcaaacaaccgtctgcaattcccgtttgaaccagagctttgcgttctgcctatggcccttacgggtacaataaccaagatattttgactgttagaaggagtctcatgacggagtcctctcagcatacgtctaagccccaggtcgaggttgaggcctcgggcggagatgacaataagagcgcacgccgcggcgccatctttatcggcgtcgtgctggtaggttatatcgtctatctggtggtaaccgggcagatggggcagttctgggccgctatgtcgagcgtccaggcgtcatggctcgttgtcgcgtgtctttgcatgttcatgtacctgttctttggcattgtggcctatgcgatcgccgtctggctcgatcccaattcgcccgtcggcatccgcgacctgatctcggtcgaggcgagtggcatcttctttggcaacctgacgcccatgatgatgggctcgactcccgcccagatctaccgcctgaccaaggcgggccaaaacgtgggcgaggccggcgccacgcaattcacgcgttttatcgtgtaccagtttggcctggtcgcctggggcgctatcctgctgctcgcccgtatgccgttttttgccgaacgctacggcgacatgacgctgctgtgcgtctttagctttggtggacactgctgcatcttgcttggcatcttcgccgtcgcgctcatgcctaagaccgtcacgcgcgtcgcccattgcatcatcaattggctcgagcgcattggtgtctcggccactaagatcgagggttggcgcacgtttgtcgatggcgagatctactccttctccgagaagttcaagctttcggccggacatttttcttccatgctgctcaccgtgtttatcaccatgctgcagctcgcgtttttctatctggttccgtatttcctgatgcttgcctttggccaccacgaggtcgactttttctcggtcatggccgcgagcgcctttgtccagctgttaagctctgcggttcccttgcccggtggaactggtggcgctgagggcggctttgcattgttcttgggtcatttcttcggttcggcttcgaccgccggctatctgctgtggcgtctcattacgtttattgcgcctaccattttggctgcgcccctgctgggacttaagagcgcccacaacgagagcatccatgcgcgctgggatcgcgtgatgcgcaagctcggccgcacgcctcagacgccctctgcgcccactaagccgcaccccacgaatgctgttaccgttgatcccaagaagcacgctcagaaggcttctgggaccgcaaagccggctcataaggcctatgtgcgtcagacaggagacggtattcgcgtatctccgtcggcactcaataagaagaagcaccctaagtcgcagtagggcagtcgtgcgttcttcatgatgcgaggcatatttgtgctgtatgggggataatcctcttacgtagattatctctcatctgttgatgaatgctcgcatatcgaagggacacgcccatggcaaccagcaaaccgcgtcttgatcgtcgcatcgttcgcagccgtaatgccatcctttcggctttcgagcgcctgctcatggaaaagccgctggcagacattacggtgagtgctattgcgcgcgaggccaatgtcgaccgcaagaccttttacgttcactttggtacggttgacggcctgctcgatgccattgccgtcgatgtggtggagatgattgtcgactcggtcgagaaaacgcttgcttcaatggacggcgacaccaacgagcgcgctcttggcgcggcggcgaccttctttaaaaccgttaacgaggcactgtgcaacaacttggtgcttaatcgtcaacttatcgagaacattccgctcgatgattttatggctcgtcttcgtgcgccgctcgagcacgagattgccgagcgcgatctgctgcctcaaggtctcaaggacgagatgttcgactattatctgtcgtttttgctgtcgggtattatcggtatctatcgcacgtgggcattgtctgatggctcggttcctatcgagcgcgtctcggaggttgccaacgacctcacgctcaacggcctttcgagtctggaatctcgcttggattaggcctagttgggctcgtcggcgtggaaattcctgttcacgaggttctccggcgccttggagacctcgccggcgtaggagctgtagcctgaggatccttaaaaaagtccagtttatccttcccactccaattgggaatcctccgatgcgccttcgcacgctcgcatgacctcgataccatgcgagcgtgcgaactcgacgagctctgcgttgcgggcgtttatggtgccgaaggcggcggggcacacgataaggcgcgcacagtggacgaggagctctttggcgtgggctatggttttatccccgataggctcgaaggcgcgctcggccacgcattccgccgccaggtcgcgcgcgagctcacagtcgatgtccccttcgtgcagaacgcccgcgtagaacgccttgccctgccggatgagctggcgaaacacagccgaccccgtacccgcgccggcgatgacgaacgtgtgcgcatcgccgtgcgggcgcccaatttccacgctgccgaagcgctcgttgaaggtgccatgttgaaggccgtagagctcgccaatcgtctcgcgcgtgaatatgtcctcgggtgcgccggcgcggaagacccgaccgtccttcacgcaaatcaccttgtcggcgcttttctgcgcgagctcgagttcgtggatggacatgatgacagccacattctgcgatttcgcaaggtggcgaagtattcgcagcaggtcgatctggtagcggatatcgagatacgatgtgggctcgtcgagcacgagcacacgcggatcctgcgcgatggcgcgtgcgagcatgacgcgctggcgttgcccgtcgcttatctgcatgaagtcgcgctcggcgagctcttccacatgtgcggttttcatggcctcgtcgacccgactatggtcgtcgggcaagagtgtgcccattcgcccggtgtagggatgccttcctgcctctacgatatcgcggcaggtgaggagctcggtccgggggcgatctgtcagcataacggcaaggttccttgcgaactccgccgtcttccatcgggaaatctcccgcccgtcgagctcgaccgcgccggcaagcggtgccagatggcgtgtgatggttttcaagatggtcgacttgcccgagccgttcggcccgatgagcgccacgacgtcgcccgcgcgaacctccagatcgacgccttcgactacgaccttcttgtcgtagcccgccgacaggtcgcttatgcggaaaagcggtgctccgtcagcctgcgtttcgaccggggtttcgaggttcgactccgctcggaggaggcgttccgcgcgcagtcccgcacgagccgaaagtgccttctggcgctttcgcgcgagctcaggactgtctaagcatggaatgccccctccgagcgttttgggccgcggcatgaattcccccatctacctcactcgtttcttcaacatgagcgcgataaccaccggcgcgccgaagatggcggtgacggcgctgatggaaagctcgacgggagagaacagcgtgcgcgcgatcaaatcgcagcccgcgcagaagatggcgcctcccaagaagcacgcaggaatcacgcggatgggcttcgacgacttcagcgccgacttcacgagatgcggaactgcgatgcctacgaacgacaccggaccagcgaaagcggtcacgcaggcggagagcatgctcgctagaaggacgagcaccacgcggaagcgtgcgacgttcacgccgacgcttttcgcgtaggcttctcccagctggaaggcggaaaggggcttcgatatcgcgaatacgcatgcgttcacggtgatcaccacgaccgcgatgaccgcgacgtcgtcccagctcgaacccgagaagctacccaaagaccagttgtgcaggttcacgatggactggtcgtcggcgaaggcgatgaggaagttcgtcgccgctgagcagatgtatcccaccatgacgcctgccacgatgagcatggccatggaacttatgcgccgtgcgatgaggagcacgaagctgatggtgataagcgagcccagaaacgctgcggccaccatggccggggaggacatggcctggttcgcgcccagaagtacaatcatcgtaagcgcgacgacgaactttgcgcccgaggagacgcccaagatgaacgggtcggcgatggggttgttgaaaaacgtctgcagcaggaacccggagagcgaaagtgccccgccgagaagcacggctgaaagcacgcgcgggaggcgaatctcccagatgacttggctttccatggaattggccgcgccgcccgaaaggatgccggggatgtggtctgcgggcacgagcacgctcccgatgcacaggttggccccgacgagcacgatgagggcaacagcgagcagcgccgtcacgacgcgacaccgcgcggcgcgccccgattcgtcgtatgccatggaaagccggcttctcatggcgctagccgagctttctcagataatggaagtcgctcgcgtcatcgccggtgaacgccccgtgcagctcgtcgataatgtcggcggtagaagtcatctgctggtacatgtcggcgcttgtgacccagacgttgccgttcttcacggctttgaactgcgacaatagcgcgtttttgcctacgaagtcgttcaaggtggcaaccgattcgtcgatggtgccgttgtagatgatgatgtcggcatccttcgccgtcgcgtagaagcgctccatttcgagcgttactgatgaacctgacgtcgacgccgtctgcgcgtcatcgagcgcgtagctgccgcctgcaagctcgatcatctgcgccacgtagtcgcccgcccgccgcgtgacggcggccccgttcgagttaatgtagaaatacgccacggttttacctgacgacgcgagccccgacgtttgctcgacgcgggtcttctgctcgttgaacaggtgcgcggcctcgtcttccttgtcgaacaggacgccgaaaagcttaatccactcgacgcgcccgagtgcttcgggctcgctcgacgactgttcggtgagcacgacgagcccgagcttctgcagcttttccttcacatcgggcgtgtggttgatcatggtgttctcgatggcgagcgtgcagcccgaggccgatattcgctcgtagtcgggctcgctgtacttgccgccgtaggcgatcgccccactttcgagtgcgcttttgaagcccgcgaccgagcaatcgtcggccttcgtgcccgacatgatgatattgtcgttcgcatcgagcgcgtcgaccaggcacatcgtcgccgacgacacgaggtacaccttgtcggcggggcgccttatgaccgcgatgtcggagctcaacccatcaggtaccttcgcatcttgcggcaccacgaggaagcgctccccgttcgaaatgcagataagccgcaggccgccttcgaactcgtcgacagtgaagtgttcggcgtattcaagctgaagcgtccccgtcggcttccagccgcagcccaaatcggcgttgtggaagtcggccgcggcgcttgaagccgttcccgcaggggagccgccgcttgcttcgtcgcccgatttctccttcatggtggatgagtcgaagtggatcgtgtagtcgatggtgtgcggcgtcgacatggcgacggtctcggccgacacggcgatgtcctcgtcgagcgtgacgggtatctcgaacgtggagttgccgccgtcgtttatgggcgcgtagtccacgccgtcgacggtcatcttgtcgtagttcgaactcgaccaggtgatggtcgcggtgtaggtgtcgccatccttcacaattgtggttggtgaggcgatgcttgcgcgccctgacccgccggaaagcgagacgctcacagtgtattcctgagagcccgtcgtggcaccggtcgcgttcgggctcgcactgcaccccgcgaagggaagcgcgagcagggcgacgagaacgcaggcgatcgcgcgcgccgcgatgctgcggcgctttctgttttcccccttgggaagaatcgaccgcatggcgttacttcagtgcgtcggcgcgcagatcgacgccggcggattcgaacacgagcgtgcggtcgtaccactgctcttttctaatactccacgcggcgcaggcggtgtcctcgtcgagcgcttcaacgggcacgtcgtaggtgtacttgccttccgcgttttccacataggggatgaagtcggcctcgctcgcggcggcagcctcgtcactcgtgcccatgaagagcttgccgtagcccgtgccggaaagtgtcatcacgcagtgcatggagccgttttccacgatgagctgggcgtccacaatcctgaacatgttcgagctggaatctacggtgatcggataggtgccgtcggccaccttgtcggcggtgatgggggcagcgcttgcgccctcgggcgcatcggccgcctgttcggtcttttcctgggaatcggcatcgcttgcctttgcgctgtcgattgaatttccgccgcagccggcgagcgagaacgcgaaaagcgccgccgacagggcgaaggcgagggttttcttcaacatggagggggttcctttcaatcgcttcgaccgcccgcgccgtgcggtgggcgggcgggatgcgaatgcaacgggcatgcgccgtcggtcggggaaggcgcatgcccgttgcacggggacgcgaccggcgcccccgtgcgcggcgagtttacagcttggcgatggcgtcgtccacgtgcgagacgtagatgtcgtcgaccgcggcgttctgtcccagaccctggagcaggcacgtcacttcgaagccagcggccacgaactttgcagcccagctgtcggggtcggtctcgtctgccatgtcgttgttcgcgtggtcgcccgcgaccaccatgaacggcgcgagcacggccttcttgtaccctgcggcgctcgcggcggcgataacatcctcacaggtcggctcagcctcgacggtgccgacgaagaactgcgtcaagccctcgttcttaaacacttcctgcatcttggcatagtcggcgttggaatcggcttcggtgccgtggcccatgaggcacagcgccgtcttgccgtcgtcgaaggacgccatgttctccttaatggctgcggccaccttcttgtagtcgtcgtcggaggtgagcagcgggtcgccgagcgagatcttgtcgaacttgtcggcgtacttgtcgagctcgtctttcacgtcggcgtattccaggccagccatgagatgcgtcggctgcacgacaatttccttcacgccgtcttccacgcagcggtcgagcgcctcggtcatgttgtcgatcgtgatgccgtcgcgcttcttcagcttgtcgatgatgatctgcgcggtgaaggcgcggcggatgtcgtagtcctgccagtacttctcgcggatagcgtcttcgatggcgccgatggtgatgtggcgcgagtcgttgtagctcgtgccgaagctcgtgacgaggatgaccggcttcacggccttctccttttcgctcgatttctcggaactcgcggaggtgctggagcagcccgcgagcgcgactccggcgagcgcgaaggctccggttgctgcggcgcccatgaagccgcggcgtgacatctggtcggacatggtttttcctttcctcggtttgccggtcccccggcgacagttgcttgtcggcacaagcgaaagaaaagcgcgcccctcggggttcacaaggagctaacgccacggcgatgccgtgaggaaaaggcgaagcagtctggcttggggcgcgagacggttcgcctgcgcgtcctacacagtaatgtcccttgcccaggattcccacctggttccctccgcaagccagcgcgggctgtgcgggcgccgcgccggtcatttccttttatccgattgtcatatgctcgttgccgaaacttttactatgatagagggcacttgtgaacgtgtcaaagtcagggcgggcggcattgcgcctcctgcctgcgtatttgcgccgattgccgccgcaggcgccgtgttttgtccgctgcgcgaatggcggcgtaaacggttgcgatgagaaacgggaagggaaggctcggatgattcatatcgttggcgcaggctcgggcgccgccgaccttatcacgctgcgcggggcgcgccttctgcgcgcggccgacgtggtcgtttgggcggggagccttgtgaaccccgagctgctcgccgagtgcaaggaatcctgcgtcgtctacgacagcgcgcacatgaccttggaggaagtgctcgtcgtgatgtgcgcggcggatgcacggggcgaggaagtggtgcgcctgcacacgggcgacccgtgcctgtacggcgccatccaggagcagatggacgcgctcgacgcgcgcggcgtggactacgaggtggtgcccggcgtgtcgagcttttgcggtgccgcggcggcgcttcgccaggaatacacgctgccgggaatcagccagtcggtcgtgatcacgcggctttccggacgcacccccatgcccgcgggcgagggcatgcgcaccatggcggaaagcggctcgactatggtcatcttcctgagctcgggtatgctcgccgagctttccgccgagcttttggccgcgggccgcagctccaatgatccggcggcgctcgtgtacaaggcgacctggcctgaggagcgcgtggtgcgatgcacagtgggcacgctcgccgatgcgggcgcgcgagagggcatcgaccgcacggcgctcgtggtggtgggccgcgtgctcggagctcgcggcggacttgcgcacgacggcgcgcaagcggagtcctacgagcgcagcaagctttatgacccttcgtttgccacggggtatcggaaggcgagcagctagcgtggccttcgagcactacatatataccgggacgacccgcctgcgctgcggctacaccacggggagctgcgccgcgctcgcggcgaaggcggcctgcgagatgctcttgtcgcgaaagcccgtcggccgcgtgtcgatcgtcacccccggcgggctgcccgtcgaggtggacgtggtcgacgcatgcatcggcgaggggtgcgcccagtgcgccgtgcgaaaggacgcaggcgacgatgccgatgtgaccgannnnnnnnntcttctaagctgccgccatcgacggaaacgtttccgtcgatggcggcgtgggcgtggggcgcgtgatgttgcccgggctcgagcagccggtgggggcggccgccatcaacgcgacgccgcgcgcgatgatcacttcggcggtgcgcgaggtgtgcgccgcgcacggcttttctggaaatattgctgtgacgatttcggtacccgagggtgttgcccttgccgaaaagaccttcaacccgcacctggggataaaggacggcatctccatcctgggcacgacgggcatcgtcgagccgcgcagcctcgctgctttgcgcgacagcatcgagctcgagattcggcagcatgcggctatggggcggcgcggagtcgtgctcacgcccggcaactacggcgggcagttcatctcggggcatttccacctaaacggtgcgccggtggtctttatctccaactttgtgggcgatgcgattgattgctgcgttcgcgagggatttactaatgtccttcttgtgggacacatcggcaagttggtgaaggtcgcgggcggcatcatggacacccattcgcgtaccgccgactgccgcgcggagattctggccgcccacgcggccttggccggcgcgggcgcgaagaccgtgcgtgagatcctgtcgtcggtcacgaccacggcggcgctcgaggtaatcgaggccgccggcgtgggggacgctgcgcgcgcctcgctcgctgcggcaatcgaggacaggttgcgccgccgcgcggcgggcgcatgcgacatcgccgcggtcgtgttcgacgccgagcgccgcgagcttttccgcacgtcgggcgccgatgcagttatcgggaaattgggggcgacgtatgagtaaaggcgttctgtacggggtgcgccgtgcaatcggctggccggggacgaaggtggtcatgaaggcgcgccgctcgcttgcggacacgaagcgcttcctttgcgaggagggtgccttcgacggtgccgagcttgtagaggactgtgggcttccgggcgagcgcgtgtaccgctcgctcgacgatgtgcccgatcggggcagctacttctcgacgatggtggtgcgctagatgagggtttcctgcatagcgttcactgagagggggtatgcgttggcggtgcgcaccgcacacgcgctttccgattgcgcacagacaggtgaagacgaccctggctgggacgtttccgtttcgcgcgggttcggcgaggggaaggccgacctgcgcgcatggacggcgctcgcgtgggaagcgtcggacgcgcttctgttcgtgggcgcggcgggcatcgccgtgcgggcgatcgcgccgcatgtcgcttcgaaggcaaccgattccgcggttgtggtgattgacgaggcggggcgctttgccgtcccgcttttgtcggggcatttgggcggtgcgaacgagcttgcgcaaactgtggcccgcgcggtaggggccatccccgtcatcaccacggcgaccgacgtccgcggcgtgtgggcggtggatacgtgggcgcgctgtgcggggctcgccgtttcgaatcccgaggccatcaagcgagtgtcggcgcggctgctttcgggcgggcgcgtggcactctattccgacatgccgatttcgggacagccgcctgagggggtagacattgcgtccgaccgcgctcgggccgatatcatcgtgtcgccgttcgctggcgcgaatgcaggcgcgttcgttcgcgcggcggagacaacggacgaggtcgtgcccgccggtgagacggggatgccggcgggcatgcgggtgcaggcgcctgcgcccgagccgcttcgccttgtcgtgccctgtatcgttgcgggcatagggtgccgtcgcggtgcgtgcgccgaagcgatcggggaggcgtttcttctcgcgtgcgggcaggcgggcatctcgcctttggccgtgcgcgaggcggcgacgatcgacgtgaaggcgcacgaggagggtctgctcgccttctgccgcgcgcgcaatatcccgcttgcgacgtattccgcagaggagttgtcgcaggtcgaaggcagcgtttcgccatctgatttcgtgcgcgtcgacaatgtgtgcgagcgcgcggcgctcgcgggcgggggcaaacttatcttcccgaagctcgctcacggcggcgtgaccgtcgcgttttccaaagtatctatcgaactttcgtttaaggagcggtgatgggaaagctcttcgtggtggggatcggcccgggcggccccgacggcatgacgattgcggctcggcgcgcgctcgaggcggccgacatcgttgttgggtacacgaaatacgtggagctcgcgcttgccgccgtgcccgacgcggcgcatctcgcgacgccgatgatgcacgaggtcgaacggtgccgtctggcgctttcgcgcgcgcagagcggagaagccgtggcgctcgtgtgcagcggtgacgcgggcgtttacggcatggcgagccccgtgctggagcttgcggaggactaccccgatgtagacgtggaagttatctccggggccaccgcggctcagagcgggtcggcggtgctcggcgccccgcttgcccacgacttcgcggtcgtgtcgctctccgacctgctcacgccgtgggaggtcatcgagcgcaggctcgccgccgtggcgagcgccgacttctgcatctgtttgtacaacccgcgcagcagaaagcgcgccgacaggctctcgcgcgcggcgaagattatgctcgaatggaaggcccccgacacgctctgcggctgggtacgcaacatcgggcgcgaggggcagcagtcgggcatgtgcaggctctccgagctgggggagctcgacgccgacatgttcaccaccgtgttcgtcggcaacgcggacacgaagcgcgtaggcggccgtatggtcacgccgcgcgggtatcgggagattccatgcgaaaggtaacgataatcggggcggggcccggaaaccccgacttgctctcgcgcgcggcgctcgacgcgatcgacatcgccgatgtggtcatcggcgctcatcgcgcgcttgccggcatcgacgtgccgcccgacgtggtgagatgcgagctcgtgaagacggcggacatcgtcgccgcgctcaccgatgcggcgtcgtggcagcgcgccgtggtcgtgatgacgggcgatgtggggctgttcagtggcgcgcgccgcctggtggaggcgctctccggcgacgcgcaggtggacgtgcgcgtcattcccggcataagctcagcgtcgtatctcgccgcgcgcctcgcgcgtccatggcaggattggcgcttcgcgagcgctcacggcgtggcgtgcgacatcgtggccgaggccgagcgcgcaggtgaactcttcctcgtcacgtcgggcggggaagacccctcgcggctttcgggtgagcttgtgcatgcgggcttcggggacgcgcgcgtgacggtggccgagcgcctgtcgtaccccgaggagcgcatcacctgcgcgaccgcaagtgaaattgcaggtcagacgttcgacgacttgaacgtgatgcttatcgagttcgcaggcggcgccggctcgcccgcgggctctagcgtagcctctgaggcgcctgccggtgcgtctgcgcccacggcggcttcttccgcggcggactctgcgggcgcatcccgcgccgcgagctcccgctggccgtacgcttcctcgggcattcccgacgagctcttcatccgcggcgacgttcccatgaccaagcaggaggtgcgcgccgtcgcgctcgcgaagctgcgccttaccgcgaccgacaccgtgtgggacgtcggcgccggcacggggagcgtgtcgatcgaggcggcgctcgtcgcgcgagtggggtcggtatgggcggtcgagcgcaacgcggccggcgtgcggctcatccgagagaacgcggatgcattcggctgcggcaacgtgcatgcggtccccggtgtcgcccccgaagcgctcgcgacactgcccgtccccgacgccgtgttcgtcggcgggagcgcgggtgagcttccctccatcgtggaggcggcgctcgagaaaaactcgcaggttcgcctgtgtgtgccatgcgtcaccgttgagacgctcaccgaggcgtgcgcgctcctctcgggttcgcgctttaaggggttcgaggcgtgccaggtgtcggccgcccgcgccgaggctgtaggctcgcaccatcttatgaaggcgcaaaaccccgtgttcctcgtcagcgcgcgtggtgcaggtggggaaggcggcgcccggtgagcacgaccatcccgcgcttcatggtcgctgcgccctcgagcgggagcggcaagacggtcgttacgtgcgcgctcctgcgcgcgctcgcacgccgcggccttgcatgcgcggccttcaaatgcggccccgactacattgacccgctctttcatcgtcgcgtcgtgggtgcgcgctcgggcaacttagacggcttcttcaccgacgccccgacgctgcgcgccctgctcgcacgcggcgccgcgagtgcggatgtcgcggtgctcgagggggtcatgggcttctacgacggcatggcgcccggcgtggccgacgcgagcagctaccaggttgcgcgcgacacggaaacgccggtcgttttagtggtgaacgggcgcggggcgtctttatcgctcgccgccgtaatccgcggcatcgccgagttcctgccttgtgcgaacgtgcgcggcgtcgtgttgaacaagacgagcgccgctgcctgcgcctacgcggcgcctgcgatcgagaagcacacgggcgtcgcggttttggggaatatccccgccgacgaggcgttctcgctcgaaagccggcatctggggcttgtgaccgccgacgaggtcgagcagctctccgcgcgcatcgacaagatggccgagctggtggaaaagaccgtcgacgtcgaccgcttgctcgaaacagcggcgacggcacccgatatccgcgaggaaccttaccggttggagccgatcgcgggagcgcggcccatcgtcgccgtcgcccgtgacgaggcgttctcgttctactacgaggagaacctgcgcgcgctcgaggacctgggttgcgagctggcctttttcagccccttgtgtgatagtgagttgccccgggggacaagcgccctctatctgggaggcggctacccggagctccatgcgcggcagctctccgagaacgcgcctatgcgcgaggcggtgcggcgcgcggtggaatccggcatgccgacggtcgccgaatgcggtgggtttctgtacctgcagcgtgaaatcgccgatagcgaggggcggcgctggcctgttgcgggcgcccttgaaggcgcaagcgagaacgggggaaggctgtcccatttcgggtacgtggagctcacttcccaacgcgacgggctctacgggccgcgcggcacacgcatccgcgcgcacgagttccactactggcagtccacctgcccgggcggcgacttctgggcgcagaagccccggcgcgacaagggctggccgtgcatgacgaccaccccgtccctggttgcgggcttcccgcatgtgtactatcctgcgaaccccgacgttgcgcgcacgttcgcgtctgccgcagcgtcgttcgcagagaggagacggcatggctgaagcaaccgaaaccgcgttggcctgcatccgcgaggaagtcgagcgcgcgttctcgtcggcgccgggcgccgtgctcgaagccgcgctctcccggatcgcgcccgcagacgagtgcgcccgcgccgccgcgtacgccgagtgggactccatcgcgcatcccttgcggggattgggcgactttgaagacgccgtcgcgtgtatcgccgcggctcaggggagcgccgaggtggccgagtttccccgtgcactcgcggtattcttctccgacaacggggtcgttgccgaaggcgtgtcgcaaagcgggcaagacgtgacgcgagccgtcgcgcgcaacatgtgcgagggggccacgagtgcctgccgcatggcggcgttcgcgggtgccgaggtcgtgcccgtcgacgtgggtatggcccggggcatagaagacgcgcgcatggtgcgcgcgaacgtgcggcgggggagcgacaacatcgcgcacggcgccgctatgtctcgcgatggggccgtgcgcgcaatcgaggtcggaatcgccgtcgcgtgcgggcttgcccgcgccgacgtgcgccttctcgtcgcgggcgagatgggcatcggcaacacgaccacctcggcggcggtggccgcagtgctcctccgggcggacgcgcggagcctcgtcgggcgcggcgcggggctctcggacgcctcactcgcgcgcaagcgcgacgtggtcgagcgcgctatcgacgcgaactcgcccgatcccgccgacccgatcgacgtgctctcgaaggtgggcggcttcgacatcgcggcgatgtgcggcttctacctgggggccgcggcctcgaaggctccggcgctcctcgacggggtagtatcctgcacggcggccctgtgcgcggcgcgcctgtgctccaacgccttgggctacctcgtgggcacccacgcatcaagtgaacccgcaagccaggagctccttcgcgagctcggcataaaggcacccctcgacgcaggcatgcacttgggcgagggcgcgggcgccatggcgtatctgccccttctggattcggcgctgcgcgtgtaccgggatgggaagacgttcacggcgaccggcatggctgcttacgagcatttcgaggcctggaaatgacggtgacgctcgttatcggcgccgccgcgagcggcaagagcgcctacgccgagtccctgtgcctcgggcacgacgggccccgcgtgtacctggcaacgatggagcccttcggggaagagggcgcccgccgcatcgcgcgccatcgggcgctgcgcgagggcaaggggttttccaccctcgagcgcacgcgtgacgtgggcgccgcagtgcccgggcttccgcgcggctgcacgcttcttttggaggacgtgggcaacctggttgcgaacgagctcttcccggaaggcggcttgcccccacgtgaccccgatgctgcggcgcgcgaggtgctcggaggcatcgaacggctcgctcaggccgctgtgcatacggtggtggtcaccgtcgacgtgttcgccgatgggatgcgctacgatgaggggaccgaggcgtggaggcgcgcgctcgcgcgcgtgaacgagggcgtgacggcgatggccgaccgcgcagtcgaagtggtatgcgggattcccgtgtggatgaaaggcgaaggacctacaaggtgaagatagcagaggcaatcggcgcggcgttcggaacgttctcgcgcatccccgtcccgaaatcggcctggaccgatttcgggtcaacccatgcgcttgccgcgtttcccctggtgggccttgcggaaggcttcctcatgacggcgtgggggtacgtggctaacctgcttgtcgtgcccgcgaccatcgtcgcggccgtgctcgtggcgctgcctgtggcggtgacgggtggcatccacctagacgggctctgcgacacctccgatgcgcttgcaagttgggccccgcgcgagcgaaagctcgagatcatgcacgacccgcgggcgggcgccttcggggtcatcggtgttgtcgtgtaccttattctgcagttttccctgttcaccgcgctgccgcttacggcgggggcgttcctcgcgcttctgtgctcgctcgtgttctcccgcgcgctttcggggctcgccgttgaatgctggcctgccgcgcgggcggacggcatggccgcgggactctcgccttcgaagaagcgcgcggcgatcgtcgtgccgctttgcgctttcgctgcggcttcggctgcagggatggtcgcgtgcgctcgggccgtcggcgcccttatggcggtggcggggcttttggcgctcgcgtggtatcgccatgttgccctgtcccgcttcggcggggtgacgggggatttggccggatggtttctgcaatgggccgagctcgcgatgcttgccatgctggtggcggggggcatgctcctatgatgctcgtggtaggtggcgcgcattcggggaagaggaccttcgtgcgcgaaaagctcgggttcgcggcggacgatttcgtcgacgcggcgcagcttgcggagggcgtcgtgcccgcggtttttgccggccgtgtcgcgtaccgtgctgaggaactcgtacgcacgctcgacgctgaccgggcgctcgagcggctgattggcttcgacgcagtgattctgaccttggtcggctcgggggtcgtccctatgcgtgcggaagacgcccaatggcgcgagcgcgcggggcgcctgggatgcgcgctcgctgcgcgcgccgacgtcgtcgtgcgcatgacgtgcgggattccccaggtcatcaaaggaaaccttgccgatgcgcctcgagggacgctgggcgcgggcgcgcctttggaagtcatcttcgtgcgccatggtgccacggcgggcacggaagaccatcgctacagcggggcgggcaccgacgagcccctgtcgagcgcgggcgagcgcgctttgcgcgacctcgcgtgcgatcgtgacgtgttccgtgttatcacgagcggcatggcccgctccgaccagacggcacgcattctcttcccgaacgcggagcttatggcgtgccccggtctgcgcgagatagatttcggcgacttcgaggggcgaagcgccgccgaacttaaagaggatgcgcgttaccgcgcctgggtagactcctggtgtgagacgcgctgcccgcatggcgagggcaagagcgatttcacccgccgcgtcgtcgcggcgtttcgggaggcgtgcgaatcggagcgcgcccaggggagtgggcgcgccgtcttcgtcgttcacgcgggtaccgtgaaagcgctgctctccgagctagctgtcccgaaaatgggatacttcgacgtgcataccgagccgggtggtgcatgggccgccacctgggatgggcgctgccttcgcgacgttcggcccgcttcggggggcgatgcccggtgatgacgattcttgccgtcgccgccgggttagcggccgaccttgccttcggcgacccgcgctggcttccccatcccgtcgtcgccatggggcgcgcgatcacgtgggccgaaggccgcctgcggggcgcattcccgcaaacgtccgcgggcacgcgcgccgcagggcttgtgctcgccgtggcgcttccgcttgcgtgtgggcttttgacctggggaatcctgcatctttgcggcatggttcactccggcttgcgcttcgtggccgaggcatgggcaagctatcagattctcgcggcatgcgagcttcgccgccagagcctggccgtggcccgcgcgttctcgaagggcggccttgtcgcggctcgcgaagccgtcgggctcatcgtgggacgcgacacgtctgttctcgacgagcagggcgttgcgcgcgccgccgtggaaacggtggcggagaacgcgagcgacggcgtcatcgcgccgcttttctaccttatgatcgggggtgcgcccttgggcatggcgtacaaggcggtgaacacgctcgacagcatggtgggctacaaaaatgagcgctacatcgacttcggctgcgcctcggcgcgcctcgacgatgcggtgaactggattccctcgcgcttatcggccctgctcatgatcgccgtgtgcccgatcgtcgggctcgacgcgcgcggggcggcgcgcatctggcgccgcgacaggcgtcgccatgcgagccccaactcggcgcagaccgagtcagcgtgcgcgggcgcgctcgggctgcgcctggcgggacccgcggtgtatttcggcaagctcgttgagaaaccgacgataggcgacgcgtcccgcgaaatcgagtggggcgacatcgcacgggcgacaaggctcatgctcgccgcgtccgtatgcgcgctcgtcgtcttcggcgccgcgcgcgcggcggtcgtgctcgccgtgggggcgatggcatgagggaagaccacgccgcgccccaggctgccgggggaatcctgcgcgcccgtacgcatgggggcagctcgcaatcgctcggcatcgcttgcgaggggggcgcctccgacctcattgacttctcggtgaacgtgaatccggcaggcccctcgccgcgcgccgtcgccgcagcttgcaaggcgctttctcgaatcgacgcctaccccgatagggaaagcctcgcactcgttcgcgccctagggcgcgcccagggcattcccgaagatactatcgtctgcggcgcgggcgcgtctgacatcatctggcggctcgccgcggcggtgcgcccgaaacgcatcgtcgtgtgcgcgccgacgttctctgaatatgcggaggcggcatcgtactacggtgcatgcgtgcaggagttcccgctctccgaggcggatgacttcgacgtgcccgcctccttcgcccgcgcgatcgaggggccgggagacgtggcgtacctctgcaatccgaacaacccgacggggcgcctcgtcgacccccgcgtgatcgatgccgcggcttgccgctgcgagcaggtgggcgcgctgctcgtcgtggacgagtgcttcctcggatttgcgcccgacgcccgcgaaaggagcgtggccgcacgcgccgcgtgttcgcaccatgtggccgtgctctccgcgttcaccaagctctacggaatggcagggttgcggttggggtatctgatcagcggaaacgcccaactcatcgaggggattcgtcgggcggggcaggcgtggcccgtctcctcggtcgccgaggccgcgggcatcgccgccctggaagacgtcgaatacgtctcgcgcacgcgcgatgtattggcgggcgagcgagcgtggctttcccacgagctctcctcgctcgggctttccgtcgtgccgtcggatgcgaacttccttttagtccgcacgccggcgaaagacatccccgagcgcctgtataaacaggggcttttggtccgcacgtgcgactcgttttcgatactgtcccgtttctggtgccgcgtcgccgtgcgcacgcacaaggagaatgcccggcttgcgatggcgttcagccgcgcgcttcgggcggaaggcgcatcgggcgaaggcgaacccgacgaacggggcggcgcttcttgcagcggcgctatggcgggcgcggatggccgaggctcggcgaaggaggtcgatacccgtgggtagggcgaagcccatcatgatccagggcaccatgtcgaacgcggggaagagcctgcttgcggcggggctgtgccgtgtgctttcgcaggacggcctgcgcgtggctcccttcaagagccagaacatggcgctcaacagcggtgtcacggccgacgggctcgagatggggcgcgctcagatcatgcaggccgaggcgtgcggcatcgcgcccgacgtgcgcatgaaccccatcctgctcaagcccgaaagcgatcaccgaagccagctcatcgtggccggcaaggcgcagggagccttcgctgcgagggactacttcgcgcgaaagaaggcgctcatgccgcagattttggaggcgttcgattcgctcgcggaggaaaacgacgtcatcgtcatcgagggcgccggcagtcccgtcgaaatcaaccttgccgaaaacgacatcgtcaacatggggctcgcgcgcgccgtgtcctcccccgtgctgctcgcgggcgacatcgacccaggcggggtgtttgcccagctctacggcacggtcgcgctccttgcgcccgaggaccgcgcgcttttgcgggggcttatggtgaacaagttccgcggcgatgtggaaatcctgcgtccgggtttggctccgctcgagaaaatgtgcggggttcccgtcgtgggggtcgtgccgtatcttacgctcgacctggacgacgaggactcgctcgcgccgcgcctaactgcccgcgaggcgcgcggcgtcatcgacgtcgccgtcgtgcgccttccgcatctgtcgaacttcaccgacttcgacccgctttcgcgcgtgcccggcatgggcgtgcgctacgtttcctcgacgaccgatctgggccgacccgacctggtggtgcttcccggctcgaagtccacggtcgacgacgcgcgctggcttgcggctagcggcatcggagcctgtgtacgcgcgctttcgggcgcgggcacgccggtgctcggcatatgcggaggctaccagcttttgggagacgagctttcggacccgcacggcagggaaggcgctggcaccgcgcgcgggctcgggctcatccctgcaagtacggtgttcaaggaggaaaagcgcctcgcccagtcggagctgcgcatcacgggcgcccaaggcgcgttctcggtgtggaacggcatgacggcgcgtgggtacgagattcacgacggcgaaacgaccgtctcctgcgcccctgcgggcacgattggcggcaaaccagaaggcgcggcctgcggaaacgtgttcggaacctatctccacggcctgttcgacgaaccgggggtggcgctcgccctcgcgcgctcgctcgcgcgcatgcgcggcctgcccgagagcgtcgtgggtgctgcgggcgcggcgtccgcggccgatcaccgtgcgcgcgagttcgaccgcctggccgacgtcgtgcgcggagcgctcgacatggagtatgtctaccgcattatcgaggagggcgtatgattcacgtgtatcatggcgacggcaaaggcaagaccacggcggcgatgggcctcgcccttcgcatgctcgccgcaggccgccgcgtcgtcgtcgtgcagttcctgaaagacggcgaaagcggggaggcgcgcctgctcgccgagcatttcggcgtgcccgtgttcgcggggaaggtgtcggacaagtttacctggtcgatgtcgtcggaagaacttgccgctacgtgcgagctgcacgatgggaacctcgcttccgcgcttgccgagctcgagggcgcgcaggaggggctgctcgtgctcgacgaggcgctcgatgcgctttcgaaggggcttgtcgacgaggcgctcgtggaccgcgcgctcgatatgtccgcgcgcggcgtcgaagtagcgctcaccgggcgcgcgccttcccgcaagatcgtggagaaggccgactacataaccgagatgcggtgcgagaaacacccctacgagcaggggatatgtgcaagggaaggagtggagtactagatggattccaaggagatggcgcccggcgacatcgagcggcgcagcttcgagatcatcaccgaagagctcggcggccgcacgttcccgccgctcgaagaacccgtcgtgaagcgcgtcatccacaccactgccgacttctcgtacgccgattccctcgttttcactcatgacgccgcgcactgtgcgctcgacgcactgcgcgcaggggccacggtgctcaccgatacgaacatggcgctcgcaggcataagcaagcctgcgctcgcgaagctcggctgcaaggccgtgtgctacatggccgaccctgatgtcgccgtggctgcgcgcgccgcgggcacgactcgcgccgttgcgagcatggacaaagcttgcggcatcgagggtccgctcatcgtggccgtcggcaacgctcccacagcacttctgcgcctcgccgagctcatggacgaggggaagatcgcgcccgcgctcgtcgttggggtgccggtcgggtttgtgaacgtggtcgaggcgaaagaggagctactcgcgcgacgcgcgccggccatcgtcgcgaggggtcgcaagggtggttcgaccgtggcggccgccattatgaacgcgctgctctaccagatcacgcgcccaggcggcccgaagtgacggcgcccgcatctgcgccggcgctgcgcatcttcgccggcaccaccgagggccgccttctgtgcgaatgggcgagcggggcgggcatccccgcccgtgcctacgcggcaaccgagtacggaggcgagcttttgggcgagcttccgggcatcgaggtgcatgcgagcaggctcgacgaggccgacatggagcgcgagctttccggcgcgcgcatcgtcgtcgacgccacgcaccccttcgctacgctcgccagcggcaacatccgggccgcttcgctcgccgtgggtgcacgatgcctgcgccttgcgcgcccggtcgaggcgctgcccaaaggcgtcgtctcggtcgagtcgatcgcctgcgcggcgcgctttctctccgagaacccgggtcgcgcgcttctcacgacggggagcaaggagcttgctccctacacgcgcgtcgccgatttcgcggagcgcttcttcgtgcgtgtgctcccgctgcccggtgctataacgaagtgcatcgacgcggggttttcgccgtcgcacgtcatcggcatgcaggggcccttcacccgcgagctcaacgtggcgatgcttcggcaggtgggcgcccagtggcttgtgaccaaggactcgggaaccgtaggcggcacggccgagaagatcgcctccgcgcacgacgtgggagcgcgctgtatcgtggtcgcccgtcccgccgagggaggcggggccctttcgcttcgggaagtgaaagacgcgctcttacgggagttcgcgcgctaggtgctcgccgcgcatgcgtgccctcccgcctgcgaggaggagcgccccgagcaagctcgaaccgtacaagaccgtcatccgccaatagctcgaggacgacgcccggaactggcgcaagcagcccttcaataagttgcggtgaaatagtgtctgtatttgctgctagatagcatatttagtccctaattcaccgcaacttgttggtggtggcttactggtagcgtaggcactccaccgggtcgagcttcgccgcgcggcgagcggggtagaagccaaagatcacgccgatgccgacggagacggcgaaggccagcatcaccgtggcgattgaaaaactcggtgtgatttgcccgctggcaccgagctcgccaagaatcccggatccggaggcaaacatcgcgaggccccatgccagcagatagccaatcaggacacctagcagtccgccggtgacgcacagcgccgaggattcggccaaaaactgcgcggtgatatcgcgacgacttgcgcccagagcacggcggatgccgatctcacggatgcgttcagatacgttggtgagcatcatattcataatgccgataccgccgacaagcagcgagatgctggcgacagcacccatgatgagcgagaatgcgcccataaaggagttgagtgcatcgatagcgcttttcatggaggttgccgatacactgtcgtactcgtcctcctcctcgatgcccttcatcgcgcgcaccttggactcgatggttttgcagagctcatccatgtccgtgccctcggcggcaagtgccgtcacgctggggaatgaaggattctcgtcgccaaacagtccggagatagtttcgcgtggcatatacagcgtgagcgagcccatggagtcgctgccgccatcaatcacgcctacaatctgcacctcgccgttggacaccttgatggttttccccagcgcatcctgttcgttgccgtaaagctgatcggcgccgttgcggctgatgagcgccacgcgcgagcctgattgggactcggcctgggaataggtgcgccccgcaacgagcttgctggcccccacggcgtcgagcatgtcgctatcgacaccctgtgccatgacggtatagcttttatcgccggtcttatactcggtatacgcgctgtcgacaatgccgatctgctctatctgcggcaccagtttttgaagcttctcgatgtccgactcggtgagttcttgcgacgaatagatttgcaccatgcgtgccgcattgaggcccagactgttgaccaggctgttttggatgccgccgatgagcgaagtcatggcgataaccgaggcgatgccgatgacaatgcccagaatggtgagcaggctgcgccccttgttggcctcgagcgagtgaagggcttcctggatgagatcgcgggcgctcatgccaccactcctttcggcgggttggcggaggcggaaatcatgggcaggctatctacggcgctgcgcagggtccgcggtgcatgtggaatatacgcgccgtcgtgaatgcgaccgtcgcggatggtcacggcacggtcggcctcggcggcgatgccggggtcgtgtgtgataagcacgatggttttgccgcgtttctggagcttatggaaggtctccatcacaagcgctccggtagcggagtccaggtttcccgtaggctcgtcggccagaatgatgggcgggtcattgacgagggcgcgcgcgattgcgacgcgctgcatctggccgcccgagagctcggatatgcggtggtcccagtggtcgacgggcagcgtgacagcctgcagcgcatgcacggcgcgcatttcgcgctggctacggggcacattggtgtaggccagcggcagcatcacgttttcgataaccgacaggcgcggcagcaggttgaagctctgaaagacaaagccaatgctcaggccgcggacttcggtgagctcgtcatcgtcaagctcggccacgttgagcccttgcaggtagtagtcgcccgccgtcggcttatccaggcagcctaggatgttcatgagcgttgatttgcccgaggccgaggggccagtgatagcgacgaattcgccgggatttaccgccaggctcacgttgtgcaggatgtgggcgcaacccgcctcgctctcaaagatgcggtgcacgttgcggatgtcgataacgggacgcattacatgtcctcatcggcagacatactgcccgaatccgcgctgtagccgccgtcagccgttgcgtccgctccggtgtccatgacgagcgtgtcgccatcgcgcagcttggtaaccggtacgttggggttgatctcgttgccctggtcgtcgcgcttgacctgtgtcttgccgactacggcttcgttgtcgttttgcgtcacgacggtcaccttgacgcggcgcgtttccttgccttcgtcatcggttgccacgttgacgtaatagtgttcgccgtcttcggtcatgagcgccatcgtcggcaccatcaccacgtcgtcgagctgctcggtcaccaccgatacctcggccgtcatgcccggcttcaggcgcgcgtcgggcgcctcgatgaggatgtcgacgttaaaggtcacgctgccgccgccgttggcggcgtcggagtttgccaccgacgcgatagccgtgacggtgccctggctcacgatatcgggaaaagcgggatacgtgacgttggcgctctgcccaacggcgatcttggcgatgtccttttcgcccacctgcacggtcaccttcatcttggataggtcggcgatctgcatgcactgcttgccgccgctcgtatcgctttcgcccatgatcatgccgcctgttaccgtggcgcccaccttggcgttgagctccacgatgctacccgagctcggggccgtgaccgtgcgactggcggccttggcgttcgcctggtctaggtttgcctgggccgaagcgaggctgcgctgcgcggccgatacggcgttcgtgtccactgatgcagcggagacgccagccgctgcggaagctccatcgacgtccgtcgttggggtggcctgcgcgacagcggcggctttctgcgcgttggtgaggtcttcctgggcggctgcaactgcacgctgcgcctcggcaacgttgcgatcgagctcgtcgtttttaatggtcataagcacgtcgccctcgctgacggattggcctgcctgcacgttgatcgaatcgaccgtgccgtcgacagaaggggagaccactgaggatgaaatgggtttgagctggcctttcgcctcgaccgttgtgctaaacgtgccctcggtcaccatgtcggtcacagccccgctagcgccctgtggctgcgcattgataaccaaggttgcgacaatggcaatgagtgcgatggcacctacgacgccggcggcaataccgtgtcgaatcagctttttgtgtcgacgttcggcgcgttttgccttgagcttggcatatgcctcttcatcggaaatctcggccgtatcgttcgtgcgttcgctctgcttgtcggcatgtacgtttgtaatcagaggaatcgtttcggtggcaccttcgggcgtgcactcggtatcatctgggcccggggtgatcgtggggacattcggcatagcgtctcctttatagaaaaacctcgataattataagcgcccaccggttggggcgggcgcataggacggtttctttcggaactgttagattggtcgcagcagttccacgttgtaggaatgcgcgcgttgcactacgagtggacaaccacgcacaggccgactttgatgcagtcgtgaagtgccttggcgtcggccaggcgcaggttgatgcagccgtggctgccgcaccacttgtacgactcggcgttatcgaagctcttgtcgttttgccaggtggcatcgtggaagccgatcatgttgccctcaaacggcatccagtagctcaccgggctctcgtatttgggcttaccggtttcggggtccttggctccaatcagggtgctgccgccgtcgttgctgttgatctgccacacgccctcgggggttgcgtcttcgcccggtttgccggaaataaagttggcctcccaaacgatattaccgttctcgtcatagtagcgcgcgtgctgctcggacaggtcgacgtcgatatacgccttccagtcgggctctccctttgcggtaaaggtgtcggccttctgggagtacttgatctcgatttcgccggtctgtttgttgttaatggcgtcctcgacctgcttggcgagcgagctgctgtcgatggaccaaccaaagtcaccgccttcgacggcgcactgcttgccatcggcgcacgtccaccagcgagtggtattaaagccgttggcgagctcggctgcccagctgctgatctgcgtcgtatcgagtgtggggttggcgggatcggcaaagctgatccactgcaatacggagctgccatcaaccttgccggcatcctcgccgttgagcttgagggtcacgttgacgcctaggaagttgttggcggcatcgcatgcggcctgaatctgatcatcggtcagcgttccattgagcggctcataggcatcgttgccgagcttggaaagatctacggtctcggccagcgaggcaagttcgagctcggcatacttaatgacgtgctcgcggttgagtttttcgttggagcgcgccttctcgacggtaaacttgcccgcttgctcgtcataggagctattggcctcgaacgtgcccgaacgcccctcgttaaactcgtcgatggcggcgcccagatccttctcaaatttcttatggtcaaaggtgccggagatcatggacaggtcgacgtcttgatcaagatcgacttcgttggaggtagcggttgttttggtcttgccgcttaaggattccacaaggcggaccggccatataaaggcctcgttgtggccgataatctcttttgcggcagcttcgccgtcgacgatgggctcatcggagtcgggctgataggtccagctaaagtcatcgcctgtcacggtgagcttatagtgcttccatgccgagttgaccttggttgcggcagacgaagcgttggagaacgagacgtcgacgccggcgatggtggtgttggggtaggctacctgcgaaaacgctacgacgcccacgatatagacaatgacgataagacccaagacgacaaagagcgtcgtctttttgcccgacttattgttctcggcgggtttgcgcgcggggccgcgatcgcctcgagcgtgcgtggggggttgcttgggcgcattgccgtttgcctggcgctgctgacgttgttgacgctgctgtcgctgttggttcgggcgttgggaagcgtttgccgcaccacgctgctgaccgtggctcggcgcgataggacgcggcgactgaacgccgccggtgtgcctgctcggctgctgcggatcgggaatcagttgagttcgatcgttttgcgacatcgtatgcatatccttcgattttcgccttgcggttcatcgtgtttttactgggcttgcattatagcgattgccctgctgtttgtggtacggaaacggtggcattcaaaagaggtgggacatttgtcccacctttgagtcgttctttgccgctatccgcacacaccgcattttgcacaggccgaaagtgcggccggagcctgcgcgatgccgccctttgccgtctcgcgcagcgtggccggcaacgcgtggcccactgagagcatgacatgtgccatctggtcaaacggcaccaggctcttaatgcctgcgagggcgagttgtgccgagctaaaggccgctgccacgccgatggcgttgcggttttggcagggcacctccacgaggccaccgacggggtcacaaacgaggcccagcaggttactcagcgcgatggaactggcgtcaagcgcctgctcgggcgtgccgccgagcatctgcaccagcgcggcggctgccatggcggcggcgcttccgacctcggcttggcagccgccctcggcgccggcaacgcaggcgcttgtggtgaggttgaggccgatggcggctgcgcagtagagcgcgtccatgacttgctcgtcgtcgagctgaaggtgatcggcgagcgccagcacgcagccgggcacgacacccgcggatcctgccgtcggagctgcgacgatcacgcccatggtggcggagcgctcgagcacggccatggcgcgggccacggcttcggtctggacggggcccatcaggctttcactcaaatcgttgcagcgggttgcttcgacgagcttggcctcgccgccgataagcccgccgagcgagcgctgcggattggcgatgggggccgttgtctcctcgcgtatgacgtcgagcacgcggcgcatggcggcgacggcgtgggcctcgccggtcagacgtgcctcgcgaacggccatgacggcaccgatgctgagtcccagttcctcgcacgcatcgagcagctgctcgccgtcgtcgaagatctcctttgccgagacgccgggggagagcgacgaggcagaaccggggagctcgataaaggtcgcgtaatcgacattgtcgagcttgcgcagcatggggacgacggtgtcgtcgggcgcgccgtcggtctcaaagacggagtaggcctggccgcccagcttagaagatcggaagagcgtcgtgtaggcgagtaggttggtgagcgcggcgagtacaccggggacgtccttgtgcgccacgaagagcgtggaatacatgcccgagatgtcgacgccgacgccgttaatgcggctgatgcgcatcttgccaccgcccaggctctcgccgcgaacctgggcggtggcgcccgtgtcgtcgaccatttcgatgtcgacggtgttggggtggatggaggcgtcgtcgcctttgatgtcaaagtgatattcgaggccctgctcgcgcgcgaggtcgaaggcctgcttgatgttctcgtcatcggtgtcgaggcccaggatgcccgcgacgagcgcacgatcggtgccgtggccgcggtaggtgtgggcgaaggagttccacaggccaaaggtgaccttggtgatgcggccttccagcaggctggcggcaacttgggcgcagcgcagggcgccggcggtgtgcgatgagctggggccgaccatgacggggcccaagatctcgaatgccgaggtcgtagctagtgtttgcggcttgcctgccatgggtgctccttatctatcccgtcgtcccgaggggcggggcatactctgtcccgccgttccgagggctttagtatttggtcgcctgctcggacagtcctgctcgcacggaggccacattaagtggcctccggctcgtgcggaactcgcgatcgaccaaatactaaagccctcggaacttaggatacatggttggagtcgctctgctgcaaaatttatcggcctgtgatttattccatgtcccaggtaggctcatcttcaccacctttaaataaaaaagaagtaccgtttgggaccggtacttcttttgaaagtgcatatgttgttatgaccttagcggttcccaattacaggccgcaggctgctttgagttcttcgactcggtcggttttctcccaggtgaagtcggcgtcttctcggccaaagtgaccgtaggctgccgtcttttcgtagatggggcggcgcaggtctaggtcgcggatgattgcgcccgggcgcaggtcgaaggtcttctctacggcctcgacgatcttgtcctcggcaacatgtgcggtaccgaaggtgtcgaccatgattgagaggggcttggaaacgccgatggcgtaggcaagctcgacttcgcagcggtcggccagaccggcggcgaccacgttcttggcgacccagcgcgcggcatacgcggcggagcggtcgaccttggtgcagtccttgccgctaaaggcaccgccgccgtgacggccatagccgccgtaggtgtcgacgatgatcttgcggccggtgaggcccgtgtcgcccatggggccgcccacgacaaagcgaccggtggggttcacatagatgtcggcattatcccacggcatgttctcggcggccatgaccggggtgatgacgtgctcgatgaggtcggccttgatcttacccatgtcctcgatctcggcggcgtgctgcgtggagatgacaatggtcgtgacctcgacgggctttccgtcctcgtagcgcacggtgacctgggtcttgccgtcggggcgcagataggcgagggtaccgtcgtgacgcaccgtggccaggcgctcggccaggcggcttgccaggtagtgtggcatgggcatgagggtcttggtctcgttggaggcataaccgaacatcatgccctggtcgccggcaccgatcaggtcgatcgggtcggtggtagcgccggtctgggtctcgaaggactcgtcgacgccctgggcgatatcgggcgactgctcgtggatgaggctcataacgccgcaggtatcgcagtcaaaaccgaacttggcacggttgtagccaatgcggcggataacgccgcgagcgatttcctgcacgtcgacgtaggcctgggtgcgaatctcgccggcgacgatgacggtgccggtggtcacgagggtctcgcaggcgcagcggacgttctccacgttggcaggcacgccgttgggcgcaatatagccctgctcctggagctctatttctttggcgaggattgcgtcgagtacggcgtcgctgatctggtcggcgatcttatcgggatggccttcggtcaccgactccgacgtaaacacaaacgatccgtgttggggcgggatggaacgaagctcttctgacatgattgtcctttcgaataacgtgtcccggcgaccgttaccattccgccgggctctgtatgcaagggcacatcatagcgcgtaaatccaacattcacaccctttccgcaccgagccattggttagctaatttgggacggggcttttttagctacccaatccggagtcttcggagcctaagaccaatctcgatatagggtagctaaaaaagccccgtcccaaaattagctacccaatgactgggtcggtgccctttgtgcggaggttgctttgatgctttatactggtgcagttagacatccatcctgcaatcgaggagatatccatggcatcagacgttcgcgtccgctttgcaccctcaccgacgggcaagctgcacatcggcggcgcccgcaccgctatctataactgggctttcgcccgctcaaacggcggcacgttcatcctgcgcatcgacgacaccgaccccacccgctccaccgacgagaacacgcagatcattctgcgcgccatgcgttggctgggcctggactgggacgagggtcccgaggtgggcggcgactatggcccctacgcccagaccgagcgcctggacctgtataagcaggccgcccagaagctttgggacgagggcaaggcctatccctgcttctgcaccaaggagcagctcgacgccgaccgtaaggccgcgcaagagcgcaaggaccccttccagggctatcagcgtcgttgccgcgatcttgatcccgaggaggcccgtcgccgcatcgaggccggcgagtcctacgtcttgcgcatcaaggtgcccgaggaccgcggtgacgtcgtcatccacgacgccgtccacggcgaggtgaccttcgatgccaaggagctcgacgactttgtcatcttccgctccgacggcacgcccacgtacaacttcgcgaccgtcgtcgacgacgccatgatgaagatcacccacgtcatccgcggcgacgatcacctgtccaacaccccgcgccaggtcatggtctacgaggccctcggcgcgcccgtgcccacgttcgcccacatctccatgattctgggtgccgacggcaaaaagctctccaagcgccacggcgccacctcggtggaggagtatcgcgacgccggttacctgtccgatgccttcgtcaactacctggcgctgctcggctggtcgctcgacggcgagaccacgattatcccgcgcgacgtcctggccagcaagttctcgctcgaccgcatttccaagaacccggcgaccttcgaccctaagaagctcgactgggtcaatgccgagtacatcaacggcatgtctgacgcccagtttgccgacgagatcatggtccccgagctgcacgaggcgggtctcatcgagggtaacgtcgagtacggcgaggactggatcgacgcgcttgccgccatcgttaagccgcgcaccaagatgccggccgacgccgtgaccgttgccgctcccatctttgccacggccgagacgctcgagtatgacgagaagtctgtcaacaagggcctggccaaggagggcatgggtgccattctggatgccgccaaggccgcgcttgagggtgttaccgagtggacggccgaggccatcgatgccgcgcttgagccgctgcccgagcagatggacctcaagaagcgcgtggtgttccaggccgtgcgcgtcgccgtctgcggcaacatggtgagccctccgctgggcgagaccatggcgctcgtcggccgcgacgactgcctggcgcgcatcgaccgcgcccgcacgatggcgctgtaatcgctgcgcaaacgtatgtatccgagccccgctcaccgcgagtggggctcttgtttctgtagacgtatgggataggaggtgctggcgccatggccgagcaactgtcgctgtttggttcgcccgaaccggagcaagctcccatgaagcatgcccgcacggccgagcaggccaaacctgagcctgcgccagagcccattgccgcctacgcgagcgtggtcctggacattcccacccgtgcgctgtccgagccttttgcctacggcattccgcagtcccttgccaatgaggcccagatcggctccaccgtcctagttcattttggaaaccgtgcggccgctggctatatcgtcgacattgcgtctgggctgggcgagctgcaaggagacaccgtccttgatccagtgcgcatcaagcccgtcgaggccatcctcagcaaaccgctctttggcgccgaggccgcccgcattgcgcgttggatgagccgcgagtatgtcgcgacgctttccgaatgcctgcgtctgtttttgcctccgggcggcagcccgcgtgtcgtgaagggcgatgacggggcgtggacggttgagcgcccagccgtcaagcctattcaaaaccgctgggtcatgctcacgcctgagggtttcgactatacgccgcccaagaccgccgttcgtcagcgtcagctcatcgaggcgctccagtgcggcccggtcacgacgcgcgacctcaaccttctctataacagcatgtcggcgaccatcaaggcgctcgaaaaacgcggcgtcgtcgtggtgaaggagcgtcgtgcgtggcgtggctgcagcgagcagaccacgctgtcctcggcaagcggcaaggcgccggtctcccttaccaacggccagaagcaggcactcgcgcagattgagcgcgcccgtctggacgctcatggcgacgtggtgctggtcgacggcgtcaccggctccggcaaaaccgaggtgtacctctccgccatcgagcgcgtgctggcggccggccgttcggcttgcgtgctggtgcccgagatctcgctgacggcccagaccgtcggccgcttccgttcgcgctttggcgagacggtcgccgtgttccattcgcgcctttcggccggcgagcgcctggaccagtgggatatggtcgccagcggtgcggcccgcgtggtcgtcggcgcccgctcggcgctcttnnnnnnnnnnnnnnnnnnnnnnnnatcatcatcgacgaggagcacgagactagctataagcagggctccagtccgcgctaccacgtgcgcgaggtggcagccgagatggcgcggcgctaccgctgcccgctcgtgttgggctccgccacgccatctgccgagtccctcgaccgctgccgccgtggcacgtataacggtgtcacctggacgcgcgtcgagatgcccgagcgcccgggacacgccgtgttgcccacggttcgcattgccgatctgcgtcgcgagttctcgcacggtagccgctccatgttctcaaaaccgcttacagaaggccttgagcgtgtggtcgagcgccgcgagaaggccgtgctgctgcataaccgccgtggctttgcgccgttcctgatgtgccgcgagtgcggctgcgtccccacctgcaaccactgctccaccgcgcttacgtatcacgagcgcacacacacgctgcagtgtcacacatgcggttcgtcttggcgcgtgcagccctatccggcggccacgagccgttgccccaaatgtggcagtcgctacctggcaaaaatgggcctgggcactcagcagatcgaggacgcactgcaccagatgctgcccgacgacgtcgccatcattcgcatggatgccgattccacgcgcggcaaggacgcgcacaaaaagctgctcgagcagttcgatgccgccgattgcgcggtgctgctgggcacccagatgattgcaaagggccttgactttcccgaggtcacgctggtgggcgtggtcaatgccgactttgcgctaaagctgcccgattttagagcgggggagcgcgcctacgatctgctggagcaggttgcaggccgtgccggccgcggcgatcgccccggcgaggttatcatccagacctacctgcccgaggatccggtcattcgcgccgtcgctgagcacgatcgttcgatctttaccgactacgacctggatcagcgccgcgacgcgctgtacccgccgtttgttcgcctggtcaacatcttggtgtggtcggcgaaccgagacgacgcgcagaactacatcggacgtatcgcaaagcttcttaagcgccgctggcatgccgccgcgcccgactttttgcgggcggggagtaccgtgccgcaggtgctgggcccggcttcgtgtgtaatcgagagagccaaggaccgttaccgcttccatctgcttgtgaagtcgcccgtggggtaccatgtctctgatgatatcgacgcctgcctcaaagaggtgggctccgtgcgcggcgtgagcgtgagcgttgacgtcgacgcctatgatttgatgtaacaacccgaaaggatggccatggaagccaacggaatcgtactgtcgcctgaccctcgtctgcgccaggagtgcgccgtcatcgaggagatcaccccggcgatcgaggcacttgccgagaagatgaagaagatgatgttcgagaacggcggctgcggcctggctgccccgcagatcggcgagctcattcagctggtcaccatcgactgcgactacagcgacaagagcgactacgatccgtacgtgctcattaatcccgtgatcgtggagcagagcgaccatctggtgccgtttagcgagggctgcctttccattcctggtattagctgcgagatcgagcgtcccgaccatgtcgtcgtcgaggcgtacgacctggatgccaacctgattcgctacgaggcctcgggcgacctgttctgcgtgtgcctgcagcacgagatcgatcatctgcacggcaataccatgtttgagcgactcaagcccatgcagaggatcaaggccgtcaaggagtaccaggacgccctggcccgcggcgctcgaccgggcgagactgaataggttaattgtccgtccctgggatgggcccacacatatcatcccgtgctcaaacattctcgctttgctgcgaaactgcgcgcgggacgatatgtgtgggcccatcccagggactacgttgacgctgcttgtctcgcccgggtgccgtcgggccagggaggggcgtcttcgctgataggtgctttattgggagggctgcttttatgcggctctttctttgtttttgggtatatttgttcttgttgaattgttattgcggatgggcttggtaattggctttccgctgttatttgtagccgtctcggctttggttgaggggagacgtcctttatgcgtattgtgtttatgggtacgcctgattttgctgtgccttcgctgacttcgcttgttgaggctgggaatgagattgcgcttgccattactcgtcctgatgctgttcgtgggcgtggtaagaagcttgagccgtctcctgttaaggccaaggcgctcgagcttggcctgccggttgttgaggctaatcgtatgacgcctgaggtagttgatactctccaggctgcgcgggctgatattttctgtgtggccgcgtacggttgcattttgcctgatgaagtgctgcatatggcgccgcttggtattgtgaatgttcatgcgtccttgttgcctcgttggcgtggggctgctcccattcagcgtgccattcttgctggtgatgaggttgctggcgtttccattatgcgcattgggcatggcgtggatactggtgcttattgtgctcaggcttccacgtcggttgccggcaagcatgccgaggcactgacgatggagcttggcgagctgggcggtaagctgctggccgatacgctgccctcgcttgccgatgatacagcggtgtggaccgagcaggatgagtcgctcgtcacgcatgctgccaagatttccaagcaggagatgcgtctggatccgcagatggcggcgctcgattgcgtgcgtcacgtgttggcttcgtccgacactgcacccgctcgctgcgtgattgccggtaagtcggttcgcgtgctcgatgctgcgctggcggatgtgtcgcttggcgagggcgctgttgccgttaagagcaagcgtgtctacctgggactttccgatggtgcggtcgagctgcttgaggttaagcccgatggcaagcgcgctatggctgcttctgcctgggctgccggcctgcagggcgccgatctgacgtggggtgctttgtcatgagcaagctttcccccgcgcgtaagctcgcgctcgatgtgctgatggaggccgaccgtcgcggtatatacgcacgcgacgtgttgtcttcccgtgcttccgccaaggccattgaccagcgcgattccgcttttgccgcgcgtttggcgctcggtgttgccgccacgcagggaattttggatgagctgctcgatcagtttctcgataagcccaaaaaggtcgcgccgcgcgttcgcatggcgcttcgaatctcggccttcgagatgctctacctgcataccccaggtcgcgttgccgtgagtcagggtgttgagctggttcgtagcggcgctaagtcggccgccggtctggcgaacgccgtgctgtataaggtcgcggacaacgttgaggactttgccgccgccgcgggtgccgatgagtccgagcgccgtttggttcgcctgtctcgtctgatgggtatgccgcgctggctgtgtgctcgcattatggcctcgtttgatacgcccgagggcgcgctcaactttgccggaaatctggcgcccgcgccgctcgctttgcacgagaatgcctttgcaactaagcctgatccgtacctatcgcagcttgtggcgccggtattcccgggctgccatgcgccggtcgatgcgcaggccaccgttgcgtcgggtgtgtttgaacgcgcggcggccgtggcctcggaccttaacgcccagcttatcgctactgccgcgacacgtcccggtcgctgcctggagattggcgccggtcgcggcaccaagacctatgtgatgatgtgccaggccaagcgtgccggctacgagcgtcagcataccgcgctcgatttgcacgatcgcaagtgcgatcagaatctcgcgcgcctgcacaaggcgggtatctcgggtgttcgtacggtgtcgggcgatgcctgcgagctcaatgaggtgctcacgacctttgatgccatgctcggcgagcctgccctgttcgacacggtgtttatcgatgcgccgtgctctggcaccggcactatgcgccgtcatcctgagattccgtggcgtctgaccgagaacgacgttacgactgagctgccccgcctgcagctgacgatgctcaaggaagcagccgcgcgcgtggctgccggcggcgagcttatctatgccacctgctcggtcttcgacgaggagaacacgcaggtcgtggacgctttccttgcttctcccgagggtgccggctttaccgtggcacccctctccgaagcccagattctgcagttacccgagttcgaacaagccaagaagctcgtctccgtacgccaaaacgaccgtggacttttccaaagcgtccccgtaaacgccgactcctacgacggtcacttctgcgctcgtctggtccacaagtaactactaagttgcggtgaaatagggattgaatagcggcttctgcccgccaaacagtccttatttcaccgcaactcataaggaagatttttctggaactgggattaataaatcgggtatgaaagtaagcggttgggtttggtaagtttctggatgcatgaaccgctcgcagatttaatattgaggggttaaaatgaacgaacttaatagtgacaagattgacaatcctgaagataatactcaggaaaatgaagaggttgagaattcttcgattaaaaagcgggtaattattggtgccggtattgttgctttgctcattgctggttgtgtcggtggttatgctggttacaattacaaacaagcatgtagtgaacataatcagcaggttgaagttttgtattcaaaggctagcgatagtgttgctgcctttaaggttgatcctgggctactaacttttgagcaacgtcttgataccattaaaaatgctcaaaataataaagagattttgaataaagaaatctctaatgacagttttaagtatgcggatggcacttcccctgattggacgaagttgctcaataaatacgattccattattaaaggctgccgtaaggctcaaaataatgagtggaatacttctgtaactgaccatgttaattttgatgtaaattctactgaagatactgactctctccaacagcatattaatagcctcaatggtcttcttaatgatatttctaataaagataatcagaagcttatttttgaagatgccaaaaaggattctaatctgttcattgatcaaatcaatgaacagattagtcgttatcaaactcgtattgatgatgtaaataaggcaaaagcagaggctgaggcgaagactcaagaggaagtggcgcagactcagcagcaggcttctcagcaaaataattattccaacaattcttatagcggtaataattattctggtggaagcggctattcgggaggctcctctaacggcggcggtaaagtagtcattaaaactctggatgtttatgacgaaaatggcaattatgtggggtctactcattggtatagcgatggtacctgtgacgatccctattctgctggtatgggcggattttaaaatatactaatttttaaaaataattatcgacccatagcgcaaagaagcggccccgcgatcggagttgatcgcggggccgcttgtcactagtggttatgcgggcagttggcgcaacagccactggtggcgctggtgctggagccaccactgcgctggtcggtgttgtagaaaccgctgccgtcgaacttaatgccgctggccgagaacgtcttggatgccggggcaccgcagctggggcatacgacctcgggcgtctcggtcatgggatgctcaacctcaaacacgttgccgcagctcgtgcacttgtaatcgtagcgcgccataatacttccttttcagcacaaagcgggcagatcactctgcccgcaaaaattcaaacagctgtaactgtaccctatatccggggttttatcacgcttcgccccagaatctatgggtgctgcgcaggagctccgcagttttctcctcagccgcagcaatgtcggcctcctgcgcctgccaggtccagttgcccgtggccacgcccggcacgttcatacgtgcatcgtcgcccagccccagcacgtcctgcagcggcatcatcacgagcggagcatcgcttgccagggcatcgcccatgagctcgcttgccaatgcaatgccgctcgggtcgtcgccgcccgcaaaggaatgcgtgcaccatccggcaagcgttgaggtgtcgtgcgtcgaggtgtacaggatcttgccaggcgtgggatgaattccgcagcgaacgtcgtagttgctaaactccagcacgtccatgccggggaaaccgcaggtcgaagccatggcgcgaacgccaggcgtcagatagcctagatcctcggcgataaagttgagcggacccagctcgtcgtaggcggtctggaacaggtctttgcctggtcccgcaagccagcggccgtcggcacaggcctcgccggcggggatgctaaagtagctgtggaaacccaggaagtggtccaggcgcacacggtcgtagagcgcgaacgcacgacgcaggcgatccatccaccagcgatagccgttcttcttcatgtgatcccagcggaaggtggggtttccccacacctggccctcgggcgcaaagttgtcgggcggcgcgcccgaaatttcaatcgccttgccggtgtcggatagccagaagttttcgggctcgctccacgcgtcggccgaatcgtccgagacatacatcgggatatcgccgatgacctcgatgcccttcttgtgtgcatagttcataagctcgcaccaggcaaggtcaaagcgatactgcatgtacgcctgcagctcggcctcgtcgtggaagcgcttgtcatcgatcagatgctcgttgtagcgcgcgacattcgccggccaatcgtggcgcgacagcccctcaaagtacttctttaccgccatgtagacgcagtacttctcgagccaatcggcattgcgatgtttaaacgccgtgtacagcgggtcggcatcctcgccgccgcgggccttccaggtgacgaagtcggcagccagctcctcgtggctctcgggcagcaggtcgatattgcctgcaaaggccgaagggccggcataaggggagcggaaaaagtccgtaggattgacgggcaggacctgccagtagcgcatgcccatggcggctaggtgatcgataaagcgacgcgtgggcgcaccgattgtgccaggcttgccgtcatcggtcggcaccgaggtgatgtggcacacgacgcccgcgccgtgatcgagcggctcctgcaggcgcttctcggcatggtgatagatgatcgaagagcccagcgggtacaggtcgagcgtaaccgtgccgttgtggatctcgcactcgtggccgctaatcacgtcgctcgcacattcgccgagcgctgggatcgtcacgcagtgcgaattgcgcaggctgcggttgatgataaccgtcgcggcctcgccgtctttgcccgtgcgggtgtaggccaagacgtcgtcgttgagcgcaaaggccttgatttcgccatcgaccataaaaggcagcgcgcgacgcacggcagacgcgttcttaacgatagccagcgtatcgaagtcgtgcaggtcttccttcaaaggcagggtgcggcggttgcccggatcggtgaggccctccaggccgtactcatcgccataatagatcgaaggcacgcccgggaaggtcatctgcatgagcgtcgccaaccaaaagcggctcttggccaagcccatggaattctcgtccaggcgccacttgctgcgctcgctctcgggtagctgcgactcgtcggggccgccgccgagcaccgagataatgcgcgggcggtcgtggctcgaaagcagattgagtgcgcaggccagtgcctcgcgcgggtagttctcgcgcagggtttcgatatcctcggctgcctggtaggcgttcttgtagcccatcaaaaagccgatgaccatgtcgcggaaggggtaatccatagcagagtccagctcggagccctgcaggtagcggcgcagatggccgtagctgatcttgttggaggcatcctcccagacctcgccgagcagcagcgcatcgggtttctcggcgagcacggcctttttaatctcggccaggaagtcgtcggaaagctcgtcggccacgtccagacgccagccatgggcgccggcgcgcagccatttgcggatcacgccgtccttgcccaggagccgctcgcgtaccagctcggagctctcattgatggcgggcatgttgcccacgccccaccagcagtcatacgaaccgtcctcatggaagtaaaacgcatcgcgccacggcgagtcctcgctctgccatgcaccgacgccggggtagttgccgtagcggttaaagtagatcgagtcgtcgcccgtatggttgaagacgccgtccaggataatggaaatgccgagcttctcagccgcctcgcacagctccgtaaagtcctgctcggtgcccagaatcgggtcaatcttggtgtagtcggccgtatcgtagcggtggttgctcgcggcctcaaagatggggttgaggtagatggccgtaaagcctagctcggcaatgcgaggtaggtcattttggatacccttgagcgaaccgccgtaaaagtcccaggtcttgatggagccatcttcggcacgctcgtacacgggcggctcgttccagtcctcgaccatgcggcgctggattccgttgcgtggtttttcgacctcggccagcgtgcgctcgcgccagttttcgtcgcgggcatagcggtcggggaagatctggtagaccataccgcgctcgtaccaggtgggacggttttcgcgctgcttatagacggtaatctggaaagatggaacctcggcgtagtcgtaggttacgccctcgccaccggtgcgaccctgcggtgcacccaaacggacctcgggctggccctcgatattgcagataaagctgtaccagataagacagggctcggtgcactcaagctctgcagtaaatatgccgtcgccctcgtgcgccatgggatacagagactcaccgatttcatcgacccaggtacgcagggtaagggttgcctggttggggtcggcatcctccaaaatcaccgatagcgaaacggaagttccagtggtcacagcgccaaacggagtacgaaactgcggtagacggctgttgtgaatcaatctcataatacggtccagttcaatagaatcacggcctgagggccatgggctttacgcacaggatgtaagtatatctgttgtacacaggctgtataaacaacatccgtttaccatcggcgaacggttgtcctagaaaatcgttttaccacccaaattatcgcgatattcaaaaacgtctataccgatactatttgtagttaaacaaaagtacctcggtttactacgatgaattggatgatctcaaccacggtcattatgatgatattaaaaccgcaggtagaagcgttgccaatttcatagaatactctccgtggtcggccggagccattttgtcgtagtaaaccggccctttatttaatagagaagttcaacgcaatagagggcgcctggttggggcgccctctattgcgttgatgattaagttttaatcgtccggattagcggcgcttgcgggcagtcgtagccttgcggacggaggtcttcttggtaggagccttttcctcggccggagcggcgggggagaccggggcctccttggcggactcggtctttgccttagccttgggagcggccttaacctcggcagtcttcggggtcggctcggcctttactgcgggcttttcctcgaccttggcctccgccttgggagcagcagccttggtcgtggtcttcttggccgtcgtcgtggcgcgcttgcgcgcggtggtcttggcggccggctttgcctcgatagctgcctcggccttgggctcggcacccgcctcctcgaccttgacggctggttttgcagcaaccttcggggtcatctttgcggtagccttcgtcgtagtagccttggtcgtcgtcgacttcgtagtcgtggcctttttggcggttgcggtcttgggcgcggtcgtcttcttggaaggggtcttagccggagcctttgccacaggcttagcctcggcggcctcgtcctttacctcgtgagcggcctcggcctcggctgccttcttggcggctgcggtggtacgcttgcgtgtggtagttgccttggcagcggtggtcttgctcgcagcggccttcgtggtcgtggccttcttagccgtcgtcttgcgggccgtcgtcttcttggcggcaggcttcgccgcaggcttaacctcggcctcggcagcgggcttctcctcggccttggactccttggcagcagcgggctccttaacgggcgccgcaggctcggcctcagcagcaaccggctcctcgacagcctcagcagcctccacagccgccgggcgctcaatctccgggtgcataaagaagtacagatcaagatacttatcggccgagcgcgtccagctaaagtcctggctcatggcctgcgtgaccagctgattccatgcctcgcggttatcccagaacaggcgagccgcgcggaacaccgcgtcgcccatctcatcgccgttaaagttgctaaacgagaagcccgtgccctcgccggtaaactcgttatacggctgcacggtgtccttcaggccaccggtttcgcgcacgatgggcagggtgccgtagcgcatggcgatgatctgcgacaggccgcagggctcaaacttcgaaggcatcaggaacatgtcggcggcggcatacatgcgctgcgacagcgccgggtcaaactcgatgcgcgcggccatggtgccggggtacttgtcctggaagtagcgcagtccgtcctcgtagtcgcggtcgccggtgcccagcacggccacctgaacgccgccggccaggatgcggtcgagcgcgtacatgaccaggtccatgcccttttgacgcgtcaggcgcgtgaccatcaccatgagcgggcggtcgtctcgaacctcgagccccagctcttcctgcagcttggccttgcacacggccttgccggaacggtcgtcaaccgtgtagttggcggcaatacgcttgtcggtcgcggggtcaaagcccgccacgtcaatgccgttcaaaatgccctgcagcgcataggagcgctcgcgcagcacaccgtccaggccctcgccaaactcgggcgtctggatctcgcccgcgtaggtggggctcaccgtggtgatggcatcggcatagtgcagcgcgcccagcatgtagttgatgctgcaggcgtcgcagcgcaactgcgtagctgccgccggaatatgcgccacacccaggatgtcctccatcacggtgtcgctaaactggccctggaacgccacgttgtggatcgagaacacggtcttgacgcgctcgtacagcggcagaccctggtagaactcgcgcaagaatacgggcgccaatgccgtctgccagtcgttgcagtgcaggatgtcgcactcaaagccctcgggcaggtgctgcaggctctcggtaatggccttggagaaaaacgcgaagcgctcgccgtcgtcaaagaagccgtacggatagtcgcgcgcaaagtagcgctcgttgtcgatgaacatataggtgacgccgtcgtgctcgagcttctcgagcccgcagtactcgttgcgccagcccaggctcacgtaaaagtcggagaagtgctccatctgcgccttgtactcgtccttgatggtggcgtacttgggcaccatcacgatgacctcggcgccggcgcgcacaagcgccgcaggcagcgagcccgccacgtcacccaggccaccggtcttcacaaacggtgcgcactcggccgaggcaaacacgatctgcatctttttgctggaatcagccatattgtctcccatgttgcaattcgagaatagccgcctggcgctaaccgggcggctattctacatgttacgagcgatgttgcggtgccaacgttaacgtacgatggtggtgtcggaagttaacggagccttgcccagcaccaggatgttctcgggcgtgccgcgaagctcggtgttggtgggaaccacgttgttcttgtccagaatggcattctcgacgcgggcgccgctcttgatgatgcagctctggttgatgatcgagttggtcaccgatgcgccctcctcaaccacaacgccgcgcgacaggatcgaattgcgcgcggtgcccttgatgatgcagccggccgagatgatcgagttgcaggcgtggctgccggtcgcatagcgcgaaggcggcacgtcgtgagccttggtcaggatcgggcgctcgggatcaaagagctggtcggcgacggtctggtcgagcaggtccatgctgcggcgatacagtgacttctcgctaaatacgcccacgacctcgcccttgtactcgtagctgcacacgtcgatgttgccaaagtcgccctggagtgcctcgagcaggtccagatagtcggcggcctggtagtggtcgatgatctcgagcagcgtctcgcgattgacgatgcagcagtccatagaggcgttgtcgccgtacacgacgccggcgctcacgcccgtcaggcggccgttctcgttaatctcgagcttggtctcgtcatcgacgttgcgcgtggccttgcagtacaccacggtcatctgggcaccggagttctcgtgcgcctcgatgatggtgttgaggtccatgttaaagatgatgttggtgcccatcatcacaacatagggcttgtccgagcgctggaacagcgtcttgttggagatgatgtcgcgcagcaagaagcgcatgccgcccttggtggtgccatacgcgttgccgggcaccatgaacaggccgcccttcttgcggtccaggccccagtccttgcccgagcccacgtggtcgatcagggagcggtagttacccggcatgacgacgccgacggtcttgatgccggcattcatcatgttggacagcgggaagtcgatcaggcggtagcggcccaaaaacggtacggacgcaatggggcggtccttgagcagcacgctgccgtaggtcgaagagtagttagcggtgatataaccgatggccttgcgattgatcatcggatcattcccccttcccgataacgacgtcatttccaacgacggccgtatccttggtggtatcgacagagccgagcttcacgccctcttcgaccgtggagttctcgcccagaatagcgcggcatatgtgcgcaccgctcttaacgtgcgcacccggcagcagcacggagtcctcgaccacggcgcgctcctcgatgatgacatcggtcgaaaggattgagtggcgagcggtgccgtaaatcttgcagccgttggagaccaggcagtcatccaggcggccgtccgggccaatgtagtgcggcggacgcgtggtgatgttggacatgatggggaagtgcttgtcgaacagatcgaactcagggttgttgcccagcaggtccatcgaggtctcgtggaagctggcgatggtgccgacgtccttccaaaagccgtggaactcgtagctgtacaggcgcttgccctcgccgagcagcttggggatgatgtccttgccaaagtcgtggctcgagcgctggtccagagcgtcctcctcgagtgcttcgatcagcacgtcggccgagaagatgtagatgcccatggacgcgaggttcgaatcgggcttatcgggcttctcggtgaacttggtgatgcggccgtcctcggggtcggtggtcaggatgccaaagcggctggcctcctcccacggcacgggcataacgctcaccgtgaggtcggcgttgttctcgatgtgcgtcttgagcatcttgcggtagtccatgcgatacaggtgatcgcccgaaagaatcaggacgtacttggggtcgttggccttgatgtagtcgaggttctgcgtaatggcatcggccgtgcccgcataccaggcaccaccggtctgcgtctcgtacggcggcaggatcgacacgccgccgtcgcggctgtccagatcccacgcctcgccggagcccacgtaggcatgcagcaggtaggggcgatactgcgtcagaacgcccactgtgtcgatgcccgagttggagcagttggagagcgaaaagtcgataatgcggaacttgccaccaaagctaaccgccggcttggcgatcttttgggtgagtgcccccaatcggctgccctgtcctcctgcgaggagcatcgcgatgcattctttcttactcatcgatttctccttctgtcatcgatgttcctaaacccattagcgacgggcgcggcgcaacgtcacgcccgtcgagtaatgccgtgctggcataggggagctcgcgcgcctttacgcgtgccagatctcgtcgcggtactcgcgaatggtgcggtcgctcgagaaccagccactcgaggcggtgttgagcagggccttgcggttccaggtctcctggtcgccgtagctgccggtgagcttctcccacgcatccacgtagctgcggaagtctgccatgactaggtcggggtcgttgttgttcatgagctcgttgtagatgctctcgaagttgcccgaaagacccgcaaaggtgttgtccttgagctcgtccatcacgcggcccagacgctcgcgatcgttgttgagcgtatcccaggcaaagtagctgttcgatgcccagagctgctcgacctcgggagcggtcaggccaaagatagcctcgttctcgcggccggccaggtcggcgatctcgatgttggcgccgtcgagggtgcccagcgtaatggcgccgttcatcatgagcttcatgttggacgtgcccgaggcctccttgccggccgtggagatctgctccgaaatctcggcggcggggtagatgagctgggcgttgctcacgcggaagttggggataaagcagaccttcatgacctcgttgacgcgcgggtcgttgttgatgacgtcggccacggagttaatgaggcggatggtctctttggcgaaggtgtagctcgaggcagccttgccgctaaagatgaaggtcgtcggcgtcacgtggaagttgggatccgcgatgcgacggttgtagatgtccatcaccttcatgatgttcatgagctggcgcttgtaggcgtggaagcgcttcacctgaacatcgaagacggtgttggggtcgatgaccagaccggtctcggccttaacgtaggcggccaggcgctccttgttggcacgcttggaggcaccaacggccttcaggaactcggtgtcgtccttaaactccttgagtttctccagctcaaaggcgtccttcagccagccatcgccaatggcctcggtcacgagcttggcgtaggtggggttggcctcggcaaagaagcgacggtgcgagatgccgttggtcttgttgttgaacttttcgggcgtcagggcatagaagtccttgagcacgatgttcttgatgatgtcggagtgaatcttggccacgccgttgacgctgtggctgcagatcacggacaggttggccatgcgaatctcgccgtcccatagaatggcggtctggcgcaaacgctcctgccagccctcctgggtggtgtcgaacgactcgtgccaacgacggctgatctcatcgatgatctgatacacgcgggggaggagcttggagaacgtgccgatgggccacttctccaaggcctcgggcaggatggtgtggttggtgtagctcacgacctgcgtcacgatgttccaggcgtcgtcccactcgagcttcttctcgtcgatgaggatgcgcatgagctcggggccgcacatggcggggtgcgtgtcgttggtgtggatggccacaaactgcggcagcaggtcccagttctcgccgtgctccttctcaaaggtgtcgagcaggctgtagatgccggccgagacaaacaggtactcctgcttcaggcgcagcagacggccgtgctcgccggcgtcgttggggtagaggatggcgctgatggcctcggcctcggcgcgctcggcgtcggccagggcatagtcgccgcggttgaaggcctcaaggtcaaagtgctcctcaaccggctcggcggcccagacgcgcagcttgttgacggtctcgccggcatagcccacaacggggatgtcatagggaacggccaggatatcctgcgtgtccaccgtgcggtagaacgtgcggccgttctcctcaaagccctcaacatggccaccaaacttgatggtcacggccttgtcctgacggcggacctcccagggatagccgtgggtgagccattcgtcggtggcctcgacctggctgccgttgacgatttcctgcttaaacaggccgtagcggtagcgcatgccgttgccgtagccggcaatgccctcggctgccatggaatccaggaagcatgcggccagacggcccaggccaccgttgcccagagccggatcgggctcctggttctcgatgacggacaggtcgaagcccatgtcgtcgagcgcctcggcgaccatgtcgcgcacgccaaagttgagcaggtagttgtcaagcaggcggccgatcaaaaactcgatcgagaagtagtacacgcgcttcttgccctcggcggtgacgcgggcgtcgctcttggtggcaacggtgcgtgccttctcggccacgagcttggccagggcgttaaagcggtccagatcgctggcagcctcgacgctcttgccgctgatgctcatgacggcatcgcgatagagctcggtaaactcctgcttgttgtcgaagatcttattcatacgttcctttcccccggggatgtttctcccggaacggttatgacttgtatcctacgcccccgcggggcgggtaattacagctgtaacgcttttgttacgcatccttggcagatggcttaacagcagctgccttggccttgggagcagcctttttagtggatgcctttttggccgtgctggacttggccgaagccttggcagcagacttggcagccttcgtcttagccggagccttcttagcagccgcggtcttgggctttaccgaggacgtccgcttgcgcgtcgccttcttgggctctttaaccacgggcggcttatagctgctgggaccgcggcgcttaagcaccacgcctgccaggccgggcaccttaatttcgatggagtccatctgcccgttccagggatagggctcgctcgagcaggtgtagggctcctcgccggcgtagccgctgccgccaaactcgggacggtcggaatcgaagatgacctcccaatcgccctcgcgcggcacgcccacgcggaagctctcatagctcgccgggtcaaagttgatcaggatcaccaggtcgtcatcgacgtcctcgccctgacggacaaagctcacgatggactgcttggagttgtccgcgtcgatccaggtaaagccatcgtcggtgtagccgcgctcgtacagggcgggctcggcggtatacaggtggttaagcgccttgataaacgcctgatgatgacggtgggtctcgtactcctcggtcaagaaccactgaatggactcgtagtagcgccattcaataaactggccgatctcgttgcccataaagttgagcttggcaccggggtgcgtcatctggtagaaggccagcgtgcgcaggccggcaaactggcgccaccagtcgcccggcatgcggccgatgagcgagcacttgccatgcacgacttcgtcgtggctcagcgggcagatgaagttctcggtaaaggcgtacatgatggagaacgtgagcaggccgtggttgccggggcgccacggaaaatcggtctgcatgtagtgcagggtgtcgttcatccagcccatgtcccacttgtagtggaagcccaggccgccgtcctgcggcggataggtcacgagcggccatgcggtggattcctcggccatcatcatcacgtcggggtagtgcgcctctacggcacagttgacctgacggataaacgcgctggcgtccaggtcctcctcggtaccgtacttgttgaacttcttttggctgggatcgtcaatgccaaagttgaggtacagcatactggacacgccgtccatgcgaatgccgtccacgtggaagttctcaagccagtacagcacgttggagaccaggaaggagcggacctcgccgcgggcgaagtcaaacttgtgcgtgccccagttggggtgaatctcgtgctcaaacagcatgtggccgttaaaggtggcaaggccgtgggagtcggcgcaaaaaccgccgggtacccagtccatgatcacgccgatgcctgcctcgtggcatgcatcgataaagtgcatgagctgctgcgggttgccgtagcgcgacgttgcggcgtaatagccggacgtctggtagccccaggagccatcgaagggatgctccataagcggcatgacctcgatatgcgtatagcccatgtcgcgtacgtagtccacgagctccaccgacaggtcgtcgtaggtatagaactcgccgcgctgcgcggggaagggatccatgggtccggggtagttgccgtactcgtcgggctcgccctgcggcgcgtcgccgtggcgcttccacgagccaatatgcacctcgtagatgttaaggggctgcgacatgtggttatggctggcgcggcgcttgagccatgcggcgtcgttccaattgtagccatcgagggtccacagcacgctcgcggtacccggagggcactcggccttaaaggcgtacggatcggccttgtagagcttttcgccctcgttggtctcgatgagatacttatagagctggccctgctcggcgccaggaataaaaccttcccaaatagcactcgtatgcatgggcgccagtgggttggcttcctcgtcccagtcgttaaattcaccaatgacatggacgctctttacgtcgggagcccaaacgcaaaaacgccagccgcgcgtacggttctgcgtgtcggggtgcgcgcccatcttttcccagctgcgctcccacgtaccgatgccaaacagatagacatcgtccttggtgagctccggcgcgtgcggggcggctttacggatagcaggctttttggttgctggctttagctttgtatcgctcacgtttgatcccatcatgacgcggcagcgtgttgccttggtgactagatgcgaaaggtccaaggctgcacgaatcgaagggacggcgatagttctatgattcgttccacctcgcgtgctcggtggaactttcggcagaaactacgataacacctgtgcgttagttttatggacgaaagcggatttgcgggggcgtttaatcggtaagcgacatgtttataccactggcagaattgacgtggtaaaactcttgacagttttaccaatttgggtttcaaaattgtttggctgacgtttggtaaaacgtttttagcaggatgtttaccatttgatatcgaaaggttcgtttatgtcccataccgccgctcccaaggttgcttttattttcgattgcgacggcacgctggttaatagcacccccgtttgggcctatgcacagcccgagttattgcaccgccacggtgtcgacgtgaccgtggatgactttgcccaatttgagcacctgtcgctggaggacgagtgccaggcctaccacgacacgtggggcattggcgcgaatggcgaggagctgtatcgcgagctgggcgagattttgattgatgggtactccaaggtgccgccgcgcgagggtctcctggcatttttggagcaggcgaaggcggcgggcattgccatgtgcgtggctacgtccacgccggccgagctggtgcagtccgcgctcgctggtgccgggctcgacgcttacatggaatttgttaccacgacgggcgaggcaggacgctccaaacagttccccgacgtatacgagctggcgctgcgccgcctggaagagcgccatgggcacaagtttgagcgcgcatgggtgtttgaggacgccgtttttggccttaagagctctggggtcgccggctttaagcgcgtgggcatctatgacccgcacggccgcatgaagcgcgacgaggtgcgttccaactgcgatatctttatcgacagctatgaagagctggaccttgaccgtgtgctttcgtttgagggataggcgagggctgtggcttgcaaagtattagtggtctgcggctcgcccgtggtggcaagcgcgggtctgttgcgtaggctagcaggggagtgcgaccacgttgtcgccgtggaccgcggactcgacgcgctgctgggcgccggcctgggctgcgacgtgtatgtgggggatgccgacacggtgagtgatgcgggtcgtgcgttggtcgatgccgccaccgactttgaagttgagcgccacgacccctataaggactataccgacctagcgttggctttggagtccgtgcgccgccgctggcctggtgccgaattagttgcgacttgcgccaccggcggccgcccggatatggcgctttccgtactggggctgcttgcaggctatgaggatgcccccatctggatcgccgaggacaaggtggtcgcccgcatccttcacgcaggtgagacgtggaccatcgagggtgccgaaggcaagacgttctccatcatcgccattgcccccggaacggtggtaagcgaacacggcctagaatgggagcttgaccacagccccctgggcctgctagccgacatgggcattagcaacgtcgtcaggggtacagcaaagatccaagtccacaccggtaccgccatcgcttacctctacaagtaaggtctatcgcatcagggttttaaccgccgccccaggaaaacccgtaagacggaaaatcaatccaaaattcccacttgcatccccgaagatcttcccctatagtactacctcgtcacgggggcgtagctcagctgggagagcgcttgactggcagtcaagaggtcaggggttcgatccccctcgtctccaccattgtgaatgcaaaggccttcggaattccgaaggccttttttaatgccaaaacaccatgcgccacaaaccccaactacgccaacaaaaagttgcacaaattttttcccgtgtctgtacatagtttgttagccaaacgcgattatcagtgtagatcgccgttccatttgggcatcaggaacgcgcctaatcaccgtcagtacctcaataacctgcatcaatgtgaacaacatcccaaaacaacccccttgaacacgttaaatgaacgataagttgtcctccacaagccaaatcagtttcactaacagcttgtgctaggatacctaacgttacatgagttcaactgtgctcgcggctccagcaagttgcaaagcgcagggtcgatcagcatccggccgtaacggcggtgccagaaacaccacgagctccaataaagaagtcatgcgacgttattaatttgcattgctttaattctaagatgcattaatagcttgtatgccaaagtgaagcagtctttcagctgtttgcgtgcggtccagtttcgaattcgcttgactggatcgcacgcagccagctgaggtcgttggtgtatttgcgatacatgccaacaacctcagcgctgcttttgtatataccgttcacggtggggcagagccacgtgcttgtctgactgggctcagggtttgaatatggagcgccttcgcgcacaagcgcactggcgaagccataccaaaaccccgtgagccacacgtaagacagcaagggggtggtgctcgtgtggtatgtgattcaggtcattaacggtcgcgaagacgtaatgcgcgagcgcatcgagcgtatggtgccggctggtgccatgcaagagctcttttatccccaatatcaaacggagatcaaagtacacggcgaatgggtcaatacgaccaagccgctctttcccggttatcttatctgcgacacggcagatccccgtaccgtgcaacagtacctgctgcgcatggatgactttgcccgggtgctttcccaggacggtcagtttgtgccgttggcaaaagaagagacccagctcattggcagttttaccaataggggagaccgcgtggtgcccatgagcgaggccttaaaagagggcgaccaggtcgtagtgacggctggtccgctgttgggccacgagggcctcatcaaaaccattaatagacgtaaatgcactgcttatctggagctcaacctgtgcggccgacgcgtaaccacccgcgttggcctcgcggtgctttcaaacgaacagcgcgtcatgcgcaatcacagaaaagcgatcgcctagctgcaagctcgcaagcggacgaccgaaagcaaaaaagtatcgggggaggggctcttggagcctacgataatgaccatggagcagggtgcacgggagacgtgcgccgctgccatggcgaattccgtccctgccgcagcgggtgctgcgggggattaccttacaaacgaagaggccaccgagatgctgcgcggtgcgaactccggcgtgaagcccgagcttgggcgcagactctaccgcgttgttaagcgtacggtggacattgtcgccgccggcggagccttggtattgctctttatacccggggtaattctgagcatggtcatttgcattaagagcccgggcgccagccccctttattcgcagtggcgcgtgggccgcgtgcgcaaagacggcacattctacctgtttaagatctataagttccgcagcatggtgcccaacgcagaccaaatgctcaaggacttgcaggctcaaaacgaggccaccggccccatgtttaaaatgaagcacgacccgcgcattattcccggcgtgggcaacttcattcgcaagcacagtatcgacgagctgccccagcttatcaacgtgttcttgggccaaatgaacctcattggcccgcgccccggcctgccgcgcgaggttgccttgtacagcgagcatgacatgaagcgccttgccgtaaagcccggctgcggcgggccctggcaggtaatgggccgcagctatctgggcttcaacgaaatggttgagctggatcttcgctacatagagaatcgcagtctgctccaggacctgcggttgatattcggaacgctgaaggcgatgctctctggggaaggtgcagcttaatgtcggaaacacaacacatcttcattgtaggctctaagggcattccgggcaattacggtggctacgagacctttgtcgaccggttgaccgaggcgcacgagggcgaccctcgcatcaggtaccatgtggcttgcaaggccagcgaggatggcgagttcgagtatcacggcgcccgctgcttcaacgtgaaggttcccgacgtgggacccgcccaggcaatcttgtacgacgttgcggcgctcggccgcgtctgccgctacgtcgaggacaaccacgtcaagcacccgattgtttacgtcttggcgtgccgcatcgggcccttctgcgcccacttccagaagcgtatccacgctttgggtggaagactttacgtgaacccagacgggcacgagtggaagcgcgccaagtggagcgcccccgtgcgccgctactggaaggtctccgagtccatgatggtccgcaattgcgatctgctggtctgcgactctaagaacatcgagaggtacatccacgaggagtacgattcgccgacctatagaccggccactaagtttatcgcttacggtgcggatacacataggagcccgcttgcggacgacgccccgaattttactggctggtgtgccgagcacgggctttcgcccaagggctactacctcgtggttggccgctttgtgccggagaacaactacgagacaatgatccgcgagttcatgtctagcagcaccgagcgcgacttcgccttgattaccaacgtcaacgacaagttcctcgccgagcttgaggagcggacgcactacagccgcgactcccgcattaagttcgtgggcacggtctacgaccgtgacctcctcgcgaagatccgtgagcaggcctacggctatttccacggccacgaggtgggcggcacgaacccgagcctgctcgaggctctgggttccaccgacctgaatctgctacttggggttggcttcaaccatgaggtggccgagggcgcggccctgtactggaccaaggagcctggcaatcttgccgcgctgattgcgcgtgcggatgccatggacgcggtcgagatttccgaactgggtcgccgcgccaaggcacgtgtcgccattgcctacagctggcagcacatcgcctacgagtacgagcgcctgttcctcgaggggccgctggcggtcaagggcgagggggaggagtagatggacctcgtcatcttccccttccagggagcaaaaaagtgggccagcgagggatggcgaacgcgcgatgcccaccttgtggagcatttccagaaggacccacgcattggtaagatgcttgtcgtggaacggccggtttccctggcggagatagtggtcaagaggcaggactggagagccccaggtacgcgagcaattgccgaggagtcctctcgagccctctcgcagcttggcgacaagacctattgcttggattctaagcttcccgacttccttagggttgctcgcgagaaaaaggcgtggtggttctctgcactggagaatccaaagacgattgaggccatcaagtgggcaatggccaagctcggtatcgaaaagcccgtgttgctgcttcagaatcccatgtctgtcgctgtcgttccgcaccttggccactcgctactggcgtttgatgccatagacaactggcttcaccacccgcagatgaagtcgaaccatgagcaagtggtgaagagctacgagttcattcgtgagtgtgcgaacgttatcacgaccgtctccaaagcccttgcggacgatttctctgacgcacacaccaagtcggtgaactggattcccaatggcgtggatccggacttcttcgctccggctcgacatgcctacgaaggcggtccaattactgttggctacatgggaaaaatccaggatcgtgtggactttgatcttgtgcgtcggtgtctcgagacttattctgatatcagttttaaattcatcgggccggcttactcccaacaagatgttattgacgggctgaagaggagctatgccaacatcagttttaccggtgacgtgcggtatgagaacctgcccgaggctctgcaggaggtcgatttcgcgctcatcccccacaaggttgatgagtttacggcaagcatgaacccgctcaagctctatgagtatcttgcggcagggaagcctgtagtgtctacgagcgttgcgggcgtatccgacatttctgattttgtgaaggttgctggctcgccggatacctttgtaaagtttgttggcgaggttgctgctgcggtgagagttggctgcgtcaatcctgccaaggtagcggcatcgattccgtcagagtgcacgtgggagcatcgtgccggacagattgtcgattgtctcgaggctgcagttgggggtgcggcgaatgtctaacctcgggtttgtgattctgcacttcaagacggcggatgatacgcgggcctgcgtcgagtctattcgacagcatgttccaggtgcccatgttgtcgtggtggacaacggctctggtaacggatctggcaaattgcttgcgtcagagtacaaggctgatgaggatgtacgggtaattcttgaagagcggaacctggggtttgcccgcggtaacaacgtgggcatcaaggttgcgcgttccattccgggtgtgcgttttgtagtcgtgctcaacaacgacacaaagctcttgcaggatgacttcgagaagctcgtcaacgacgaatacgctcaaagccaatttgccgtattgggaccccagattgagacctgggacggcaaggtggattccagtccggcgccggggcttatcacaagtcgtcagcaagctctcaagcttatttacaagagaatgattaagtacgcgctgtgcttggcacaccttgagggacttgtaaaggaagctggtactggcaagatggtcgatgtgttctatgactataactgccggtatgaagacgtgaagcttcatggggcttgtctcattttttcggataagtacttcgagaggtatgagggtttctgcgataagacgttcctgtactttgaggaggacatcctctattggcgtgcgaagcagacgggtctcaagatggtctataaccccaacctgcgcatttggcacgcagaggattcttcgacaaacagcacggttaagaacaagcgcgagaagaacctgttcgtgttcaagaatgagatcaagtcgttgcgggttcttaaagatattttgaatgatacgagcatggaatgaaaatactctttgttactcataacaataatgaaaagagtggggcaaaccgttcgattataagtctaattgagcggttcaataaagattacgaagttgtagttcttgtaaacaagactgaggggaatctgcctgatgtcctggagaagctgggcatacaggtagtaagaatgcgttactggtggtcatgtgtgccaacgaggtcatcggtggcgcgcaatgtcgcagttatttcccgtggctatctgaggcttctgcaaaatgaagtcgcagttcgaaagcttgtcaaactaattaaagacgagaatataggggttgtctatacaaatacgagtacgattaccttttcatcaagggctgcgcaaaaggccaatgttgcacatgtctggcacttaagagaatttggggacaaagactttaattttaggaggctgttgccgcgaagtagttttgttaacaggcttaattatggtaagttgatagcagtttcgaattcgataagtgattactacaagggaattagttcgagctgtgatatagagactgtctataatggacttgacattagcttatttaaaaataagtttataccaagggtagataatagtctcaacctactaattgtcggacagctctctaagaacaaaggacaagatcaggcaatcaaagccgtcaaattatttaatgaaaaatactctccgaactacaaagctagcctatttatagctggtagaggagaccagtactttctgcaatcagaaatgaaaaaagcaggaagtccatattatattcactatcttgggcaggttgaaaacctggcagaagttagagctaatatgcatgcagcacttgtctgctcctcatcagaagcttttggaagggtcacacttgagtcgatgctaagcggcctgccggttattggtgctgatactgctggcacgggagagcttatcattaatggcatgaatggtctgctttataagaataaagacgaaaatgatctggctctaaagatacacatgctgctcgatgatagtttacgaaaaagattgtcagatgctgccttcttatatgcgagtaacttttcaatttcgcatacttatgatgatatatcaacaattataattaatctggataaataaaatggagctgctctttatcagcttggtctgcttgactagcataattttgacgacttattttaatagaactattttgacacctttaggagtattcgcaatactgtggatgattatctccctcttctcctacatacatctctacggtctctatgaaacagagacgcggtcatacctcttgatcgccttaggtttgtttggattctcgttgggatgcggcattgctcgtccaattacagtaaagcgcaatgccaacactcatagctaccatatcaggacagagattgttgaaatactcatatgcttatcaatccttttttatgcctacctcttatacaggatatacattgaccttggcagcattgatctctactcaatccaaagatataacaggactatggatatcgagtctttaatatcttcatcttcgataagattatttggatcatttattgcgggaccggtatctagcttagccccaatcgttgttatagctctattttttaccgaaggaattaaaagcagatcaattgtagagaccgctctgcttttaactattaaaatgctcgcgactggcagtcgctcaacacttctgttcctttttatgtacggtattatcgcctacaatatcaacaaaaatgtagaaaaagtttataaagtaaagaggataaaaaaaggaattagcctaaagctattggcggttcttgttttaggaattgtattgttcgtcgcaatgacgctttctcgcaatatgcaagtttggagaagtctctatcttgatttagccattcctccaatcatgtttcagaaatggtccgacagcgttactggctattcatttgggcaagcatccttaggtggtttcttttttattattctctatcccgttcagctgctactaaggctacctttaatgccgcttggctttcaagaggtatatgacctggtaaattctacagtttctgattggattattgtcggttcaggagttcccgctaatgcatatgtaagtctgttttggtatttctacgccgatctcggtgtcttcggtgtatttctaggctcgcttttattcggcatgtggtgcaactggtgttacctttcttatttaaataataaaggatctttcgagctctctctttgcctactcatgtttagcactatcgtcttttcctttgttcgtttgcagtttaccctgccgaattatgctttgatgattgtcctgttggtttttgttttttacggacgaggatcaaagcaaggaaatactagttcctcaagacaattaacgactaggtgattccttatgccttcagtgaaaaagaactttatttataatatagcttatcaagttctattgctccttcttcccttaatcaccgccccctatttatcacgtgtagttggtccttctggtttgggaacatattcatttacctattctgtttcttattactttgttttgtttgcgatgcttggcattaataactatggcaatcgcttaatcgctaggcttagatcagacaaaactaagatgagcaagtctttctgggaagtctggacgcttcaggcgttactaggtttaattgctgtattcttttatttgttgtactcgttaagctcttcgtttgggtccattgcattttcttggatattctacgtcatctcttctatttttgatattaactggttcttttttggccttgaagagtttaaggtaacagtcggtcgtaatttcttaattaaattattcacatttgttttaatgtttatagtggttcgcggtgagcatgccgtctttgcttattgcatgctaattagtgggtccactctcgtatctgtattaattctttggccctttctgagagcgcgaataatatgggttcgtcccacaattcgtggggtgacaacacatatagttccaaaccttgttttatttgtcccggtcgtcgcggtctccctttacacggtcctcgacaaggtgatgctcggccacatgagcacgctcgagcagaccgggttcttcgagaactccctcaaggtctcccagatgcccttcacgctcgtgaccgctctcggcacggtgatgctccccaggatgtctaaccttatcgcgtccggcagggagggggaggggaggcgttacctgggcgtgtcgatgtggctcgcgctcggcctttccctggcgttctccttcggcatcgccggggtggctccggtccttgcgccggtctacttcgggccgggctaccaggcgtgcgtgccggttctctgcgtactcgtgctcaacatgcccttcatggcctgggccaacgtcctgaggacacagtacctcatccccaagggcatggacagagcctacgtgctctcggtcgtcgtcggggcggcggtcaacgtggccgcgaatgttgccctcatccccaggctcggcgcgctcggggcggcgtggggcaccacgctcgccgaggtcgccgtctgcgtcgtccaggtggttgaggtgagggggatgctcccccagcggcgctggctcggggagaacctgcccttcgtcgccgtcggcgccgcgatgttcgtcgcggtgcgctggctcggctctctcatgggcttgcgtgtcgcgacgctcgcggcccaggttctcgtcggcgggatgcttttcgccctgctctcctgggcgtggcttgcggccagcggtaaccgctactggctcgacttcgtcttgcccatgctcaaagggaccgtttcgaggttccgccgcaaggcgtgagcactcactggcaccacaattttgtttttcacttgataaccgtataggaaggaaccagcaatgaaggtagcagtcgcaggcaccggatacgtcggtctctcgatggcggtgctgctctcgcagcacaacgaggtcagggcgctcgacatcgtgccggggaaggtggagaagataaactcctggcgctcgcccatcagggaccgcgagatcgagcgcttcatgcgcgaggcggaggcgggggagagggagctgtccctccgcgccacgctcgacccggccgaggcctacgcgggggcggactacgtcgtggtggccacgcccacgaactacgaccccaacaagaacttcttcgacaccagctccgttgaggcggccgtcgacgcagttcgttcggtgaacccgaacgcctggattgtcattaagtccacggttcccgtcggctataccgcgcagctgcgcgaggagcgtggcgactcgcgaatcttcttctctcccgagttcctgcgcgagggcgaggcgctctacgacaacctgcacccgagccgaatcgttgtcggctgcgacaaggacgatgtcgcagcggtcgaggccgccaagggcttcgcggcgctgcttgccgagggcgccgctcccgaggagcgctcccgcgagaacgccgacggcacgcggggcatccccgagctcgtgctcggctccaccgaggcggaggccgtgaagctattcgccaatacctatcttgcgctgcgcgtctcctacttcaacgagctcgacacctactgcgagctccgcggcctcgccaccgccgacgtcatcgagggcgtgtgcctcgagcctcgcatcggcgagggctacaacaacccatcgttcggctacggcggctactgcctgccaaaggacaccaagcagctgctcgcgaactacagggacgtgccgcaggacctcatcggcgccatcgtggcctccaaccgcacgcgcaaggaccacgtggccgacgaggtgctccagcgcgtcaaccagctcgtgtactccggcaccgcggcgcccacggtgggcgtctatcgactcacgatgaagagcggctcggacaacttccgtgcgagctccatccagggcatcatgaagcgcgtgaaggccaagggcgtgcccgtggtggtctacgagcccacgctggacgctggggacttcttcggcagcgaggtcacgcacgacctggaggacttcaagtcgcgttgcgacgtcatcgtcgccaaccgctggagcgacgagctcgcggacgtctcggccaaggtctacacgagggaccttttcaggagggactagatagtccccgcctgggattcctgccgggcttttacatgaactatttagaggcttcaggagtaaaagccacggtgaagatggactacggcttcaggagcacggacaatctcatagcgctgctgatgttgagatgctcggacgcgaaaccgcagctgccgtggaatcagtcgacgtcgataagaaaagcggcttagtgagtcagcttcctaaccacacaaactaccgaagcctcagtcgtttagcaaaataggatatctaagtcttatttatcgcacgatttaaacgcatttcgattgtagaggacagattatatgaaaggcatcatcctcgccggaggttccggcacgcgcctgtacccgctcacgctcgtcaccagcaagcagctgctgccggtctacgacaagcccatgatctactacccgcttagcactctcatgctggcgggcatcagggacatcctggtcatctccacgccgaccgacctgcccaacttcgagcgcctgctcggggacggctcgcgctacggcgtgaacctctcctacgccgagcagccgagccctgacggcctcgcgcaggccttcaccatcggcgaggagttcatcgccggcgagccgtgcgccctggtgctgggcgacaacatcttctacggcaacggcctgtcccgccacctgacgcgcgccgtccagaacgccgagtcgggccgcgccacggtcttcggctaccacgtggacgaccccgagcgcttcggcgtcgtggagttcgacggggagggccgtgccgtctccatcgaggagaagcccgccgagcccaagagctcctacgccgtcaccggcctgtacttctacccgggcgacgtggccgccaaggcccataaggtgaggccctccgcgcgcggcgagctcgagatcaccacgctcaaccagatgtacctggaggaggggacgctgtccgtggtgaccctcggccgcggctacgcgtggctggacaccggaaccatggagagcctgcacgaggccgcggagttcgtccgcgccgtggagcactcccaggacctgcccgtgtccgtgcccgaggagatcgcctgggagaacggctggatcacgaccgccgagctggaggaggccgcgaaggcctacggcaagtcggtctacgggcagcacctgaagaaggtcgccgccggcgagatcgtcaacagcccgcgcgagtactagcgcaagcttgttttcttttaggggtcaccgtttatctggtggcccctttcgttatgattacgttgaccataaagacaatatgattgggagtggatgtgttaagcgtctactttggcgatatgccagaagcgatttacaacacagcgacatatttcaaaaactcttaccggtcttcttggattacggatccctatgcagtctcgataattaaagatgtcgatcgatcggttgttgtctccgaaaacgtcatcgaaagccctgtgcttggatccatctccccactccagctttctggtggcgtgaaaacgctggtgcttatgagatttgatcgtaagcatatttttaacgcttctacctgtggtgacaactgtgccaagtggattctcgacatggcgaaagaccgcaagctcgttgtgaatctctatcatgtgatggactttggtcgcgaggattttaaaattaaagtcgtgaatagcggccgaatcgttcacaacatggccgatttgattcacgagtcgattccgtatctgtaggtgctgcttatgaacggttcgcatctcgttaagatttcccgccgcaggggaaccaagtacacatttaccattaaacggaacattactattgtgcgtggggatagtggcacgggtaagacgacactgtttgacatggtcgcagactacatgcgaacgggcgagcagtcgggtgtttccttgcaatgcgattgtccctgtgtcgccctgaccgattatgattggcgaaaccagctttcgtccgttcatgactcgattgtatttgtcgatgagggcttaaaagagatccattctgatgagtttgcccatcatgtgctgtattcctcgaattatttcgtgctgatctcaagggctgatttcccctatcttccgtatagcgtggatgagatttacaagattaagacgagcggaaaataccattctttcatccctgtttatcaagatcgcgggaatcatcgttatgctatttcccggtcggcgccaaaacaggacttttctatccttctatgcgaggacagtaagtctggtttccagttctttgaacggcatttcgctgacagtgagcttacctgtacttcggccatgacgaacagcgcgattttgcgctggttggatcagcatctcgacgatcgcgtgtttgttgttgcggacggagcggcatttgggtgctatgcggaccgcgtccttaagctgcaagacattcaccgcgatactgttacggtttgtcttcccgagtcgttcgaatggcttctgctgagctccggcgtaatttcagggctagatgttaagacggttttggaaaccccagaagcctttgtaaacagtgagaagtttaaaagctgggaggatttcttctataagtacttacgtgaaataactggggattcggtttttcactacgacaaagactgcattccggaggcgttttgtacggggggtaattctgcgaaggttatggctcttatcgcatgccgaaatgtccgatagttttgttgaatagtgtcgcgtcgtcacttcctgcggcatactaaagaagctgtacatgcttcagattggattttcatgtctgagatttttgaacccaagaacatcatcgtcacgggcggctgcggcttcatcggcagcaacttcgtgcactacgtggtcaacaaccaccccggggtgcacgtgaccgtcctggacaagctgacctacgccggcaaccccgagaacatcgcgggcctgccctccgaccgcgtggagctcgtcgtgggcgacatctgcgacgccgagctgctggacaggatcgtcccgggccacgacgccatcgtgcactacgccgccgagagccacaacgacaactctatcgcggaccccgagccgttcctgcgcacaaacgtcgagggaaccttccgcctgctggaggccgtccgcaaatacggcatccgctaccaccacgtctccaccgacgaggtctacggcgacctggcgctcgacgacccggcgaagttcaccgaggagacgccctataggccctcgagcccctacagctccaccaaggcgtcctccgatatgctcgtgcgcgcctggacccgcacctacggcctgcgcgccacgatctccaactgctccaacaactacggcccctaccagcacgtggagaagttcatccccaggcagatcacgaacatcatcgacggcgtgcgccccaagctctacgggaagggcgagaacgtccgcgactggatccacaccgaggaccactcctcggccgtctgggacatcctcaccaagggccgcacgggggagacctacctcatcggcgccgacggcgagaagaacaacatcacggtcctgcgcatgatcctcgaggccatgggccgcgaccccgaggacttcgactgggtcgccgaccgccccggccacgaccgccgctacgccatcgacagcacgaagctccagcgggagctcggctggaggccggcgcacaccgacttcgccgggggactgaggcagaccatcgactggtacgtcgccaacgagtcctggtggcgcccggccaaggaggccaccgaggcccgctaccgcgcgcaggggcagtaagaccgcatcccggcgaagcgcaccgcggggcgcccgcgcggggccgcagggcatggggatgatcctgcgtccccgcgcgggcacccccggttatccaacctcttcgataggagctttttccacatggcagatatcgcattcgagaaggacctctccgtcgccgagaccggcatcgagggcctcaaggtggattggctacactgatgtggacagttccgggaggggcgcaggagacgggagggcggtatccgcggatatgagactgagccgaaggcgtcgacgacatgccgggggcggaccgggacgggttcaacggcaggccccgccgaccgattgcaagcggtcggcggggccattgtggctcttgacagcggattgggtcatatgagcgaaagcccgccagggcgagcaaggtgccctgaaacgaggcggcattgaccttttggtcatgccgccgaagttgaaaggcagattgccgccctggcgggcttgcagcgtcaagtggttacggcgtttggtaaaacgccgtaactaaaacccgtggcgctccaggaagcggaaggctaggcggatccagggacggaccgccacctgcttgtcctcgttgtcgaccgcggtgttggcgttgccgagcgaaaggccgtgaccaccctggtcgaagacgtgcatctcgcatgcaacgccctcctcggccatgcgctgcgcaaacgggtagacctgcgcgatcggcgccgtcttgtcgtcggacacgccccacacaaaggtcggcggcatctgacgcgaaacatgcgtggtggggcagatatcggccaaatgctcgtcagttgcctcgccacccgtcaccatcgacaggtagtcgttgagcaaatcgcgccccgtcttgccgcccgtcttgggcacgcgcaagtcaatgcgcggatcgcgcgtctgcatgtcgcgcacataggcaaagtcgagcagcggatagcccagcaccacggcatcgggacgaatgtcgtccggacgtgccccggcaagtgccgcgaaggggccggtcttccactgcgttgccagcgaggcacagatcatgccgcccgccgagaatcccacgacgcacacgcgcttaggatcgacatgccactcgtcggcgttggcgcgcaccgtggcgaccatcttggcaagatctgcctgggggtgcggaaagctcacgtcacccgtagagctcgtgacatagttgagcacaaaggcctggtaaccgtgatccaaaaatgcaaacgccaccgggtcctgctcgtgcggagcgatatgtgtaaacccgcctccgccgcagatgatcaccgcggggcggcggccattcggtttatcgggcagcggctcggcacccaaatacgtaaacgtcgccggataatcctcggtcggctcctcgccccacagcgcatggttctcgacaatcatatgtgctcccttcgcgcaaattatgcgcccttgtttttcgccttcaagcgtaccccacttgaacccgtggcgcagaaacactccggcaataagtttcccttcaactgatatatcacataatcccagttcagaggtatcgttgagcagcgtagaatagggggcgttgaccaagccgcgaaacacatatgaaacgtttccggcaaaccaaacgcgcgatatgcgcctatttaagttggaggcaactatgggtctgctcgattcgcttaagtccaccttcacctcgaccggcgaggcgtccgttccgcccgcagcaagcttcgccacccgcgaaggcgtcatctatgcccccgtcaacggcgtgctcgtcaacctgaacgaggttcccgacgagacgatcgcctcgggcatgcttggccagggctatggcatcgagcccattaccggcaccatctatgcgcccgccaacggccgcatcggcgccaccaccgtcaccaaccactccatcggcatgattaccgaggacggcctgcgcgtgttcatccatgttggcctgggcaccgtggaaatgaacggcaagggttttgcccgctttgtcgagatgggcgatgtggtcaaggcaggccagccgctcatcagcttcgaccgcgaggccattaaggccgctggtcacgaggacatcgtgaccgtcatcgtctccgagctcgatcgtcttaagagcatcgaccatgtcggcgagtctggaacgcttatcggcggcaacccgctcgtcaagcttggcgacccgctgctggttgccaagaccaagtagccaggccccgcgccacacagccaaaaggcacctcgtcaagcgcccgcgaccatttggccgcgggcgcttttcgtttgaaaaaccatcccgccaatgctttatctgtatagcccaaatgagccgagctgctagaatatcgaactgtatggataactatcattcaaccgttatgggaggatacgtgaaccgcaccaaaatcgcgcagctctatgccgatgccgagtcgctcggcggccagaccgtcaccgtcgccggctgggtcaagtccgtccgcgacatgaagaactttggctttgttacgctcaacgacggcagctgcttccgcgacctgcaggtcgtcatgaaccgcgaggcactcgacaactacgacgagatcgcccatcaaaacgtctcggccgcactcatttgcaccggcaccgccaaactgacccccgatgcaccccagcctttcgagctttctgccacttccatcgaggtcgagggcacgagcgccccggattacccgctgcagaagaagcgcgcaaccgtcgagttcctgcgcacccagcagcacctgcgcccgcgcaccaacctgttccgcgccgtgttccgcatccgctctgtcgcggctgccgccatccaccgcttcttccaggagcagggttttgtctacgtcaacacccccatcatcaccacgagtgactgcgagggcgccggcgagatgttccgcgtgaccacactcgaccccaaaaatccgcccctcaccgagtccggcgaggtcgactggagccaggacttctttggcaagcatgcgagcctcaccgtgtccggccagctcaatgccgagaactttgccatggcctttggcgacgtgtacacctttggccccactttccgtgccgagaactccaacaccacgcgccacgccgccgagttttggatgatcgaacctgagatggcctttgccgaccttaacgactacatggataacgccgaggccatgctcaagtatgtcctcaaggacgtcatggcaacctgccccgacgagctcaatatgctcaacaagtttgtggacaagggtctgctcgagcgcctggaccatgtcgccaactccgactttgcccgcgttacctacaccgaggccgtcgagatcctggagcaggcagtcgctgctggccaccagtttgattaccccgtcagctggggcatcgacttgcagaccgagcacgagcgcttcctgaccgaggagcactttaagcgcccgaccttcgtgaccgactacccggccgagatcaaggcgttctacatgcgcatgaacgaggacggcaagaccgtcgccgccgccgactgcctggttcccggtatcggcgagattatcggcggctcccagcgcgaggagcgcctggatctgctcgaggcccgcatcaaggacctgggcatgaatcccgagcagtacaagtactaccttgacctgcgccgctacggttcctgcaagcacgccggctacggtctgggcttcgagcgcttggtcatgtatctgaccggcgtgggcaacatccgcgacgtcctgccgcacccgcgcaccgtgggcaacgccgacttctaatcgtcggacgctagctcgcgtcgccacacgccaacgctcatcgcataagcgtctctcgacatcggtcgagagacgctttttttcaacagcatccgtcaagcttttggcaagtttttggtcagttgagcagggctgttgaaaactcgacccaccgtttgccgacgactaccgaccgcccagagcgccctgcgcccctgggaaagccccacgtcctaggctccataccgtcgccacccaaaacggaaaggacgtgggcacgatgaccgaagccgctgttgaaacctacgacaccacgacgaggggcgccgcctcgatggcagcctatcgcgccgttcgtatcctgcagctcttgagcgaaaacaccggcgaagacaaggccatgctttccgatgagctgatccggcgcctcgcccatcccgacgaccccgcccgcatgcccatctcggcggcgcggcgcagcatctacaccgccatctccgcgcttcgccatgccggatatgagattgaatacaagcgcggcgtggggtatcggctcttgacccgtccactcaccgacgaggagatcatccggctccacggtatggtcatgcgcaaccgctccacgcctatcgccatccgcaagagcatggcgcagcacttagttgccatggcgagtgccgacgttcgcggctatctcgatacacccgaacctgctccaagcgcaggcagcaaggctaccaaggcaacacgcacgcccatcaagcgcatcgacacgtgcgagctcgtcgagcaggccatcgaccacggaaccacggtgagttttgatatttcgagcgtcacgacgcgtggcgaaaccgaagcagcacggatgacactccgtccctttgccatcaggcagcgcgatggcatctcgtatctgctgggaacggtctacgacgcccgaggcgccgatgacacgttgcgtaccgtagagattggccgaatgagaaacgtcaccacacgtctcctcgacggcaagaagctcttcgccgccctagacgaggacgacgcctcctccgccgcataagaccctccgccgcccattcgactacccgtaccgcccatccgattctgtattaaaaaacccgccaggctgttgtaaaaatggacatcagcgctactatagttccacttgcactttgtcccagtgcagtgtttccagccatttttatactgggggtaatgatatgaaggacatcaccatcagccgcaggagccttctggtctccgccggcctgctcgcgctcgccccgctcgccggatgcggcggcaactctggctccggctctgctgccgccggttccgactacaccatcggcgttctgcagctcaccgagcactccgcactcgatgccgccaacgacggctttgtcaaggccatcaaggagagcggccttaaggtcaagatcgaccagaagaacgcccagaacgaccagtccacgtgtaagtccattgccgacaagtttgtgggcgacaacgtcaacctgatttatgccatcgccacgcccgccgcgcaggctgccgccggcgccacggccgatatccccatcgtgggctgcgccatcaccgactacgccgcctccggcctggtccaggacaacgacaagcccggcaccaacgtcacgggcgcttccgacctcaccccggtcgccgagcagctcgagatgatgcagaaggtcctgcccgacgttaaaaaggtcggcctgctctactgcaccgccgagtccaactccgacgtccagatcaaggccgccaagaaggagctcgacaagctgggcctcgagtacactgacttcaccgtctcgagctccaacgagattcagtccgtcgtcgagtctgccgtgggcaaggtcgacgcgctgtactcccccaccgacaacaccatcgccgcgggcgcctcgcaggtgggccagatctgcaaggagaacaagctccccttcgtgactggcgaggagggcatgtgcatggccggcggcctgttcaccctctccatcaactatgaggacctgggctacgccgcgggcgagatggccgttaagatcctgaaaggcgaggccaagcccgaagacatgccgatcaaacacctctcgagcaaggacctggtcgtcgtcaagaatgacgagatggccgaggccctgggcatcgacctttccgctctggacgcgtaatgctatacgcggcatgcgtctagagcccgtgctcgcgctttagccgcgttattcaatatctgagccacaggggcgggcgctgtagaccggcgtccgccctgcttgtttcaggtaaaacaaaacgtctgtccgtaactcgtctatgcattgttaccgctattatggtgaatcacgtgtccaccctatcctaggaggtatgaagcatgctcattgcattgcagggcgccgtttcgcagggcgtcctctggggcattatggtgcttggcgtgtttatcacgttccgcctgctcgacattcccgatatgacctgcgacggcagctttgccctcggcggctgcgtctgcgctgtgctcatcgtcaataacaacgtcgacccgctgttcgccgtgctggccggtatgtgcgccggcgccatcgcgggcgccgtcacgggcattctgaccaccgtctttgagattcccgcgatcctcgccggaatcctcacccagatcagcctgtggtccatcaacctgcgcatcatgggcaagtccaatacgcccattcttgccaagggcaccgtgttctccgccgtcagcaatatgaccggtctgccgcagtccaccgttaccatcatcttgggcatcctgctcgccgtggctatcgttgccatcctgtattggttctttggcaccgagatcggctcggcgctgcgagccaccggcaacaacgagtacatgatccgcgctctgggcgtcaacaccaactccaccaagatgatcgccctcgtgctctccaacgccctcatcggcctttcgggcgctctcatctgccagagccaaaagtatgccgacattggtatgggcaccggtgccatcgttatcggtcttgccgccattgttatcggcgaggtgctcggccgtctgctgcccggcggcctcacgcagtttagcgtccgtcttgcctccgccgtctttggctccgtggtgtacttccttatccgcgccatcgtgctgcagttgggcatggacgccaacgacatgaagctgctctccgccgtgattgtcgctgtggccctgtgcgtgcccgtggtttgggagcgctataagctccgcagctcctacacgaagggagatgaggcagatgcttaagctctcgcatgtcaagaagacctttaacaagggcaccgtcaccgagaagcgcgcgctcaccggcgtcgacctcaccttgaatgacggcgactttgtaaccgtgatcggcggcaacggcgccggcaagtccacgctgctcaacatgatcgccggcgtgtacccgctcgattcgggcgttattgagctcgacggcaccgacatctcgcgcctgagcgagtcgcagcgcgccaagtacctgggccgcgtgtttcaggaccccatgcgcggtaccgctgccgacatgcagattgccgagaacttggccctcgccaggcgtcgcggccagcgtcgcggcctttcgtggggcgtcaccaaggccgagaaagatgagtacgttgagttgctcaagcgcctggaccttggtctggacacgcgtctcaacgccaaggtcggcctgctctcgggtggccagcgccaggcactcaccctgctgatggccacgctcaccaggccgcgcctgctgctgctcgacgagcacaccgcggccctcgaccccaagacggcctctaaggtgcttaacctgaccgaggagatcgtcgacgagaaccacctgaccacgctcatggtcacgcataacatgaatgacgccatccgtctgggcaaccgtctgatcatgatgcacgaaggccacgtgatctacgacgtggcgggcgatgagaagaagtcgctcaccgtagccgacctgctgcagaagttcgaggaggtctcgggcggcgagctcgccaacgaccgcatgctgctgagctaaaacctgccaaaaagggacaagtttattttggtaggttttatctgcacaaacgtcaaaaccgccgcaaaggggcaaacgtccttgcggcggttttcgcatattatgtcgataatccgatattcaaccagacattctggctaaggactaaggaaactgccatgaaaagactcccccgccttgcgttagccgccgcgttgtttgccggcgcgctcgcaggcaccccaagcctcgctttcgccgggaacctgcccgccgctattgacggctctgtgaccgtcatgcacaccaacgatatccacggcagctacaagtacagctacaacgcaagcaagggcaccggcaccgtcggcttcgacggactggcggtcctttatagcgcccagggcaacgcccccgatcttttgctcgatgcgggcgacaccttccacgggcagtccttcgccaccatgagcgagggcaagagcatcgccgagctcatggacaccttctatgtagacggctacgacgcgaccacgccgggcaaccacgactggagctacggcgcggacaagctccgcaccatgaccggctacagcaccaccggcacgcccttcgccatgctctgcgcgaacgcgaagtctacgagcggcgtatggagctcgagcatcacgaagacgctcgatcgcacctgggaggatagcgaggatcactccacattcgactacaaaatcaaggtcggcgtcgtgggtgccatggatgagtcgctgggatcctcgctgcgcgcggacctggtcgcgggcacgtcgttctcgagtgccacgaacgccatcaataccgagccaaaccagctgcgcaaggcgggctgcaacgttgtcgtctgtatcgcgcatacgctcaacgccaagacctttgccacacggctccgtggcatcgatgcccttatcgcaggccacgagcacatcaaccttaacgagaaggtgacgggagccgacggcaagacaatccacgttgtcgaggcaggcagcgcctttgccgaggtggggctgctttccattccgtacaagtacgacaccaatggcaccgagacgaccgacgatgacacggtcacggtccctgcagacggcagcgacgagaagctctacaccgccaagaacgtcaacgaccttttggcagaccccgacaagggctccgactaccaaagctgccttgaagccgtccgcaacaagatcaagccgctcgacgaggcctttgaaaacgaatcgaacaaggtgctcggcacatccaccaccaactatttctacggcgaggacgccgcaggcacgcatggttgggaaatggtgcgcaccaccgatttccgtcccagcaaggagggcgacaccaccaaggcccagaccatcggccgcgtgatttgcagctcctatcttgacctgacgggcgcggacctcgctatcgaaaacgctggcggcatccgcggcggcatcgcggcgggcaacgtgaccgccggcaacgtcatcgccatctcgccctacggcaacaccgtggagacctggaccatgaccggcgcggacttcctcgcagcgctcgagcactcgctacaaatcagcgacgattgcaacgacagctacgagcttcagcaggcttatgtggcggccggtcacaccgagcaggaggcgcaagacaagtacaagtggcgcgatgactctggcagcgttctcccctttggcggcatcaacgtgacgattgattggacgcagcccgaaggcaagcgcattgtgagtgccacactcaccaaagacggcagcacgctcgaccccgccaagacctataccgtcgccaccaacaactacatcattaccaacacgaccgactttcccacctttgcacacgccaccaagtacaccgagtggggcacgtgcgaggcggcgctgagggcgctgattgggcagaacggctgggagagcaagatggccgggctcgccggcaccatcagcttcggctccgtagccgtggaccccacgcccacaccggccctgacgcctaagccctcgcctaagacggacacgacgaccacgaaggtcagcaccaagaagacgagcggtaagctcgccgcaacgggagaccgcacgctggcagtagttggcgcgtgccttatcggcggcatcatcgtcatcatcctcggcattatctggaagcgtcgacgctaagctacaccgccgggccttgcagccccgccgcgtaaaccttatatcgagcacagaagcccgtctgaatttgatcggacgggcttcctggtgggtatcatggttggacgatcattaggaggttttccctacatggaattgtttgagccgattcttcatttctttgagcaacggtgggtccacaacatcatctgggccgtcatcttggcgataggcaccgccgtcgccgccgaggtcgtatccaagaccctgaaccatctgcttaaccgtgacgataacccgcttccggcatcaagtatcttcatcaacatcgcgcgcgctgtcatctggatgattggcggcagctttatcctcgacaactgctttggcattaacgcaaacgcgctcgtcgccgctcttggcgtcggcggcatcgccatctcgctcggctttcaggacacgctgtcaaaccttatcggcggcatgcaagtgacctttatgggcatcatcaaacccggcgacaatatcgaggtcggcggcgtatccggcgtggtccaagacatcacttggcgtcatacaacgattgaggatgcctgtggacagaccatcatcgtccccaactccaacatctccaagaacacgctcgtgcatttgatgccctttgggcgcgtggctgtgcccgttgccgtaaaggacacgtccaagtgggcctcgctcgacgcgctggcagacgagctgaccagcgccaccaaggccgccgtgcttcccatctcgggctttgacaaggagccgtatgtgctctttagcgagatcggcgactttggcatcaagggcaagatcatctttatcgtcagcgacgacagcaccactttcaccgctgccgacgcctgcatccgcgccatcgcccccatcattgcctaaaccaccacaaaggggacaggcacctttgttgtggttttcattcgtggtaccatggtttatatagttgtttaaacgactaagggagcaacatcatggaagaggcctaccgtcaagcacgcaagcgcggcgagcaaggacgtcgacgcgccattagtcaaagcgagtatccgtacctcacggacctcgatagcttggttgcccagctccccttaggccagcgagagaatgtcggcctgagagacattccgctcgaaatggtcgtcggtacggttaccaagggccgtcagtccgccttttcatgcaactttatgcccctgctgccgtttggcaccgagttcgcccgcaagtggtccaacctctacgacatccaggtaaccgagggttatcgcgaccccatcatcgtcaccgagttcatgcatcggttctatgtccaggaaggcaacaaacgcgtcagtgtcctcaaattcctggacgctccgacggtttcggccaaggtcacccgtctctaccccggcacatgggattccgtcgaaagccgcctgtacggcgagttctgcgcgttttggcgcgtctgccccctatacgagatcgagttctcgcgtgagggaagctacgagacgctcgccaagatgctcggtcagaaccttatcgaaaaatggccgcagaaaaaggtcgactacctgcgccacaccttcctgctctttaagcgcgcctaccttcgcgcaggcggcgaccacctggacattacgcccgccgacgccatgctcgtctacctcaatgtgtacaaccaggaccgcctgctggatacgccgacggatatcgtcgtaaaccgcctgtgcaagatctggcgcgagctggttattgccggcaaaaatgacgaggacaaggtcgatcttgtcgaagcaccgagcgtcgacgaggaggagacgcccgccaagtccacctctggcgtgctcaacttctttatgggcaagaccgtctactcgacggccaaccccctgcgcatcgcctttatccatgagttcccctgtgcgacgtcgagctgggacagcctgcacgaccaagggcgtcagtatctcgatgagcactttggcggtatcgtgcgcaccgaggcgttcgaggactgtcacgatccggatgtgttctacgccgccgtggaaacggctgtcaaacatggagcaaacgtcatcttctcgacctcgcaccgcctgatggaatacacgctcagggctgccgttgagtatccccgggttcggttcctcaactgctctatcggccttccccatcaaagcgtccgttcgtactttggcaagatgtacgaggccaagtttctgctgggcgcccttgcggccagcatggcggacaaccaccgcatcggttaccacgcgtcggtcttcgcctcgggcgcactcagcgagatcaacgcctttgcgattggcgcctcgctgctcgacccgcgcgcgcaggtcatcctcacctggggcgatgttcccgccggcggtcttgccgaagccatgtgccgcgaaggcttaagcgtcatgaccggcgctgacatgtcaaagtcgctcgaagacccaacggcctacgggcttcaccgcttggtcgacggcaaagtcaccggcatcgccatgcccgtatggaactggggccgttactacgagctcatcgttcgcagccttcttcacggcacgtgggacgagaccagcgacgacaaccaagtgcgcgctgtcaactactggtatggcatgagctccggcgttatcgacattcgttacgctccgggcctaccctaccaaacgcgcaaactcgtgcagttgctccgcaacggcattgttgtgggatccatcaacccctttggcggcgagctccacagccagaacggcgtggtacagatcgaaggcttccctccgctgccgagcacgcagattgtcgagatgaattggctggcggacaacgtggtaggcaccattccgcagctcgacgatgagccgaaagtccctgccctatgaaaatccttgccatagccgataccgaagaacgatgcctttgggagtgctttcgcaaggaacgctttgagggagtcgacctgattttgtccgccggcgatctggacccggactatcttgagtttttggttacggtcatcaacaaaccgctcatctacgtgcgcggcaatcacgatgaccgctacgcacgtcatgcaccgggtggatgtatctgcgtagaggacagcgtgtacacgtaccgagggattcgcattgcgggccttggcgggtccatgcgttatcgcgacggcgccaacatgtacaccgaacgcgagatgtccaagcgcatgcgtaagctgtcgcgtaaggttaggatggtcggcgggtgcgacattctgcttacccatgcacccgccgccggtatgggtgatctggacgatctgccgcatcgaggattcgagtgttttaacacagcactcgaatcctggaatcccgactacatggtgcacgggcatgtgcaccaaagctacggttgcgattttcagcgcgagcgtcagcatgtgtgtggaacgacgatcatcaacgcttgcggctatacgcagtttgagctcgaccagacgcactaccccatccgcggctggcaagcagcttggctcaactcacaaaccatgcgccgcgagctcaaacgccacgaagccatcgagtcttcaacagccagaacaccctggtaaccaccataaaggggacactgtcccctttatggtgcttttgacgcgataacaagaaacccggtcctgcacaaggcagaaccgggtttctttagcaatgcttgctgtactcaggcagtaactagcagttactcagccaggaagtcacgctggacagcgggatcgaccttgacgccagggcccatggtggaagacacggagatggacttgacgtacttgcccttagcagaagagggcttgacgcgcagaatctcggtgtacagggcagcgtagttctcgacgagctgctgctcagagaaggacttcttgcccaggggcacgtggcagatgccgtagcggtcggcgcggtactcaacgcggccagccttgagctcggagaccatcttggcgacgtccatggtcacggtgccgagcttggggttcggcatgaggccacggggaccaaggatcttaccgatgcggccaaccttggccatcatgttcggcgtagcgatagcggcgtcgaagttgatctcgcccttctgaatctgggcgacgagctcgtcggaaccgatgatgtcggcgccggcagcctcagcctcacgggccttctcgccctcggcgaagacggcaacacgaacggtcttgccggtgccgtggggcagggagatggaaccacggatgttctggtcagccttacgagtatcgatgcccagacggaagtgagcctcgacggtctcgtcgaacttggcggtgtcgagctccttgatgagcttggcagcctgaaggggggtgtagagcgtggcgcggtcgatcttctcggcagcggcgttatagctcttaccatgcttagccatgtgcattacctcctgtggttaaacgggcgtgagccctcccacatcgtatcgtgtgccctattgcacacatttaacgggcgccccggtcggagcacccgccgttaccataagaaatcgctactcagcgatggtgacgcccatggaacgggcggtaccggcgatgatcttcttggcggcgtcaatgtcgttggcattgaggtccggcatcttgatctcggcgatcttggtgagctgctcctgggagagctgaccaaccttgtcagcctggggcttagcggaaccagacttgaggttcagctccttcttgataaggtgagccgccggcggggtcttggtgatgaaggagaaggacttgtcctcgtagacagagatctcaacggggatgatgtcacccttcttgtcctgcgtctcggcgttaaaggcctggcagaactgcatgatgttcacgccagcagcgcccagggcggggccgacgggaggagcagggtttgctgcaccagcaggaatctggagcttaatgacgttggcaaccttcttctcagccatggtcattcctttcgaatcacgagtgtgaagtacttgctatatcgtaagcacgcacgtgttagaagcactcctgagatgagcagtcacagaagaagcacgctcgcgcgaacggacgaaaacttaagcgatgacagcgacctggttaaagtcgagctcgaccggcgtctcgcggccaaagatcatcagcgtgaccttgagcttgccagcctcggtgttaacctcggagaccttgccatcaaagtcggtaagcgggccatcggtgacgcggacggacgtaccgacctcaatatcaaccgaggtgcgcttgggcgaatcgcccttaccgggacgacgagtcatcttgttgtactcgtcgcgggaaagcggagcgggcttgccgttgccgcctaggaaaccggtgacgccaggcgtgttacgaacacacgtccaagcatcatcatccatctccatgcggacaaggacataacccgggaaaatcttggaatccttggtctcacgcttgccaccctctttaatctcggtgacacgctccataggaatctcgatatcaaagatacggtcctgcatgcccatagtctcgattcgatgctcgagatcggacttaacacggttctcgtatccagagtaagtgtgaacgacgtaccaacgcttagacatggtttagcccctcaatccagagaacagagcaagagcctcgccaaagccagcatcgagcagagcgatgacgacgccgacgacgatcagagaagcgcaaacgacgaccgagtagttcacgagctccttcttatcgggccacgtgacacgcttcatctcggacttgaccgaagcgaaatacttcttggtgcgggcgaagaaaccaggcttctcgttcttcttggacttcgcagccttctcgttcttcttggcaacggccttcttggcctcaaccttggagttggcggcagcgttgttggcaggcgcctgctgctgagccttcttcttgttcttcttgttggccatttgggttacctccgcgcaatgcgcttatacatgagtaaaccgtaagcccccaattgggagcttacggaataatgactggcacgccaggaaggactcgaaccctcaacactcggttttggagaccgatgctctaccaattgaactactggcgtatgtgactagagactagcgagtctctttgtgcagcgtgtggtgacggcaccaggggcaatacttcttgatctccatacgatcaggcatggtcgacttgttcttggtggtcgtatagttgcggcgcttgcactcagtgcacgcaagagtaactagagtacgcatgtatcctgaacctttcatttccgccccgtacgggcacgagttgttactttatcagctccacgtaagtgctgtcaatgaaaacctcgagtcaattggttctcggtggatccattcatatttggaacacatcaatgaagccatcgagatctaatcgacggtgcatccaggaccattgtcgatcctctcgacaccagcaacggctcaatatccattgcagaaaagaacccggcacccatataagtgccgggttctctaagtcagctatatcaaagagctaatttactcaatgatcgtggagacgatgcccgaaccgacggtgtggccaccctcgcggatagcgaagcgcaggccctcctccatggcgatcgggtggatgaggtcgccctcgatggtgatgtggtcaccaggcatagccatctcggtgccctcggggagcttgaccgtaccggtaacgtcggtggtacggaagtagaactgaggacgataaccatcgaagaacggggtgtgacggccgccctcctccttggtcagaacgtagatctcaccggtgaacttggtgtgcggggtaaccgaaccgggcttgcagagaacctggccgcgctcgatgtcctcgcgcttgatgccgcggagcagcagaccgacgttgtcgccagcctcgcagaagtccatggacttacggaacatctcgataccggtaacgacggtgttctgggtatccttgatgccgacgatctcgacgggctcgttgagcttgagctcaccgcgctcgacacggccggtagcaacggtaccacggccggagatggtcataacgtcctcaacggccatcaggaaggggaggtcgttgttacgagcaggcgtcgggatgtactcgtcgacggccttcatgagctcgcggatagcgtccatccacttggcgtcgccctcgagagcgcccagagcggaaccacggatgacgggaatgtcgtcgccggggaaatcgtactcggagaggagctcacgggtctccatctcgacgaggtcgatgagctcgtcatcgtcgaccatgtcgcacttgttcaggaagacgacgatgtagggaacgccgacctgacgggcgagcaggatgtgctcgcgggtctgagccatggggccgtcggtagcggcgatgaccaggatagcgccgtccatctgagcagcaccggagatcatgttcttgacgtagtcagcgtggcccgggcagtcaacgtgagcgtagtgacgggcagcagtctcgtactcgacgtgggagacggagatcgtaatgccgcgctcgcgctcctcgggagccttgtcgatgttctcgaacgcagtgaagtcagccttgcagccctcggtctcggagagaaccttggtgatggcagcggtcagcgtggtcttgccgtggtcgacgtgaccaatggtgccgatgttaacatgcggcttagtgcgctcaaacttctctttggccataaagccctcctctaaacaggtcgtccccggacgggactttgcctttataccatagtggcctctcaacatactattgagaagccaccgtgttacctatggtagcggtgactggattcgaaccagtgacgccacgggtatgaaccgtgtgctctaaccaactgagctacaccgccggatggagcctgcaaccagacttgaactggtgacctcttcgttaccaacgaagtgctctaccgactgagctatacaggcacttgacgggtgggagctataggattcgaacctatgtaggcagagccaacgggtttacagcccgtccccattaaccactcgggcaaactcccaatcgttcaagtatccgcaggtcctttggtcttttggaccgccgcccccgcgaacgaaaaagataatacgatgcaaccttgggggctgtcaacgaaaacctctagatacacggtgccgggcgtatctatatagctgtgacctgcggttttgttgagtttggatatgaaggacggtggatttggctacgcttgtgacatttcacgagggaacactttgtcacggtggagtacatctgcagcatcgaccttcgataccagcttatttgcacctatatataggtcgagatcggggctgcccagacagaagattgctcttcccaggcaaaatcgagcgtggattttcttccgtttgaaatcgagcgtggataatctcccactttgccgtgccatcgaatccaaagtggcagattatccacgctcattcactaggcggaagattttccacgctcgtgtgtccgataatccacgctcgatgacgatgaccaacctcgccccggcctatgtctcgacctgtaacagtaagagggttattcctcccctatctgttacagatcgagatgtttcgcagaaacccccgcttacgtctcattctgtaacagtaagaacggttttcagcctcttcgtgttacggatcgagatgttatcggccttcccttggcaatgtttcgatctgtaactataaggagggtcttcagcccactcgtgttacggatcgagacaaacctgaagcttggttggcgccaaacacgctgacttatcgacataaatagaaacgggccctgtcccacaaggaaacagagcccgaaactctcatggagccagtgacaggaatcgaacctgcaacccactgattacaaatcagttgcgctaccgttgcgccacactggcacacttggcgctttcacgcgaagcgagttaagaataaaggaattgcggacggggcgcaacaggccgcacggcgttatacaaatatgcaaaatccagcaacaacgcgtaccaggcccgttcatttctgtcagtgcgccctcaatcttaaaaccattcgccagaacgaatagttttaattacaattgctatatataaaactattcgttctggcgaagggtttcgcgatgcttactaccaaagaagccgccgagctgctcggcatcactccgcgcagggtgcaggagctcataaaaaacggagcacttgaggcccgcaaggcttctggtgtatggctcatcgacaaagacagcgtcgacacgcgactccgctccgtgaccaaaacggggggacgtccccgccgcggccacggtaagagcgagatcgcgttcaccctcatgaatcgcacgcacgaagtcgctcagctggtctacagtacatcgcgaaaagactttacccacatcggtgccgacatcgattacgcccacgcccctattggagtatttggccctaatagccccatatcgctagactccttccgcatctggtggcgcggccgcggtatcccgctcgcacgcattgggctagcctccctgcttgcagaagccgcagtcgatgttcccgatgaactcgtccagcgaaatctcggcctctccttatccgaccagtattggattaggccccaaggttccggtctcacctgggaggatatcaacttcttcaataacgcctttgatgacgtctcgctgtccattgcaccctttgccccagagggaaaagcggctgccgcaaagcccgataacacctcggacggcaatcttcaaaagtactggacgtgcgagggcgaacgtcgaattctgcataaggcaggagcgcacctggaccaggaaccttataacgagctggtggcgaccgcgctccaccgtcgcatcctaaacgcctgcgattatgtgccttactcgctcgagggcacgggcacttccgccctgagcacatgcgatgtcttcttaactgatgaagaagagtatgtccctgcgttctatgtaaaccagcatgcaaatgcagacgagcgactaaccgattacgaacggtatgtagcaaactgcgaagagcttggagcgacagatataaaagacgcccttgaccgcatgatcgtgtgcgacgacatcatcgccaactatgaccgccattggcgtaactttggccttgtgcgaaacgtaaacacgctagcctgcagaccagcccccatcttcgattcgggctcatcactctggtgcaacatatcactagaagagcttagggcgggagagcacagttttaccagcgcacaatttcattcaagccccgccaaacaaatgttgctcgtcgaggacatgggctggtttgacggcgacaaactcgaaggcttcgttgacgaggcaatcgagattctgtccagaaacgacgcgctcacggcaaggctgccatatctaaaagaggcgcttacatggcgcctccgtagaatgatcgacatcgctgaatggagttagcgagacagcgtcgcgccgtcagctcccctaccgtccgcgcagggccttgagcttggccagggcatcggggctcaggcggctgcccagggtcatcttgatctgcggagcttcctctgcctcgtgaacgtcgttatcgatctgtttgatctcgtccaccagcatacggctcgagatgcgcgtaacgcccttgcccatgacgacggcctggatcgtgccgtcactcgataccacggagcacgcgcggccttcctcgcgtgcctcgatacagagcttctgcaccacggtatcggcagagacgcccgtcggcgaaaactcgatgcgcacgccacgggccggcagattggggcgctcgctggagatattgcccgcgccgtcaaacacgattacggcctcgtagcggccttgggcaaacgcggcaacgtcgttgatgagggcagtgcgcgccatatcgtgaacgtcgctggaatacggatcgtcggaatggtcgtacacgagcttttcgtagcgcggcgtgcagtggatcacgttgtaaccgtcgaccaccagcagctcgggcttgttggagtgcaccgtcgagactgggtcggcgatagcctgcgcaaacgcattgccgcccacgccataggtcgcagccgaaacaatcggcttggccgagccctcgccaaagcgcttggccttggacttggcgcggttcttcttggacatgcgctactcctcccccatgagctcgccggcattgcggcgcagccactcaaagcacagcgccgttgtcgcctgggcaacattgaggctctcggtcatgccgcgctggggaagcttggtcaaaaagtcgcatttctcaagcaccaggcgcgagatgccgtcgccctcggagcccatgacgagcgccacgcggccctcgaagggagcatcccagcagctgccctcggcgtgctcggaggcaccgcccacccaaaagccagcggccttgaggtcatcgagcgcacgggcgatattgggaacctgtgcgataggcaggtgcatgacagcaccggcagaagtcttgtagctgccaacggtcacgccggcggcgcgcttgttggcaatgatgacgcccgccgcgcccacgacctcggcagagcgcacaatggcaccaaagttaccgtcgtcggtcacatgatcgagcacgacgacgagcgccggtccgtcacccgcgcggccgaggatgtcggcgacgtcggcataggggaagttgccaacctcgagcgcaataccctggtgagcgccatggctcgacagcgcatcgagctgcgcgcgcggcacatacttaatgcggacgcccgcggcattgaggtcatcgatcaggcgcgacaaggcggcatcgcgctccccgccctcggcaatgagcgcacacttgatgggaaaaccagtgcgtagcgcctcggcggcagcacggcgaccttcgataaactcgcccttgggagcctgaacgttgtcgcggttgcgatctcgctgcggacgtgcagcctgggcttgggagcgctcgcgctggcccttgggagcggcagcgcggtcgttgcggcgaatcggacgcgagccagaagcagcctgcttgcctccacgcggcgcacgcttgcgattgtcggccataaagtgacctcctaaatacaactatcaaacgaaacaaaataaacgaccgcccatgaatattaattcgggcggtcggtacgggttttccaagtgcccgagattgccgtgaaagaggagcgacgcgtacttgagtacgcgagcgacggtttgaacggcaaggtcgggtgcttgggaaacccgcggggattagagagatttgatacgagtgccggcggcggtatcttcaatcgtcaggcccaggtccttgagctgatcacggatggcgtcggccagatcccagttcttggcggcgcgggcctcggcgcgggcctcgagaatcttggcagcggcctcgtccacgtcgtcgcccgtgtaggcgaccaggccggcggcaacgcctagcagacccagcggcagctcgaccttgggctcggggagctcaacgccaagcgtatcgagcagctcggccagcgtgtcggcggcggcaagcgcggcggccttgtcggcagcgtcgcccgcctgctccaggtactggttgcactcggtcacaaagccaaagacgacacccatggcaccagcggtgttaaagtcgtcgtccatgcactccttaaaggcggcacgagtctcagcggccttggcggcaaacgcctcggcggcagccgcatcggcatcggccgtcgcatggttcgcggcccagcgcaggttctcgaccgtaccggcgatacgcgtgagcgagttctcggcaccctccaggcgctcccaagaaaagtcgagcggcgagcgatagctcgtctgcagcatcagcaggcgcagggcagcagcggagtgctgctcgagcacctcggccagcgtaaagaagttaccgagcgacttggacatcttctcgccgtcgaccagcagcatgcccgtgtgcatccaggtgttggagaaaccctggtgccaggcgcaggtggcctgggcgcactcgttctcgtgatgcgggaaggcaaggtcggagccaccgccgtggatgtcgatcggggtacccaggtagcggtgcaccatggcggcgcactcggtgtgccaaccgggacggccctcgccccagggactcggccagctgggctcgccgggcttggcggccttccacagggcaaagtcgagcggatcgttcttgtcctcgttctcctcgatgcgcgcgccaaccataaggtcgtcgatgttgcggcccgagacctgaccatagttgggatcgctgcgcacggcaaagtacacatcgccgttatcggcggcgtaagcgtggccctgctcgataagcgtcttgatcatggcgatcatggggccgatctctttggtggcacgaggacgcacatccggatcgagcacgttggcggcgcgcatgacgccgatgaacttgtcggagaactctgtcgcgacctcggcggcagtgcggccctgctcgttggcgcgcttgatgagcttgtcatcgacatcggtgaggttctgggcaaacgtgacctcgtagccgctcgcgatgagccagcgacgaatcacgtcaaagctgatgaacgtgcgggcattgccgatgtgaatgttgtcatagaccgtggggccgcacacgtacatgcggaccttgccggactcgatgggctggagctcttcctttttatgggtagcgctgttgtagatacgcattcgttactccttaacggttttctgtagcaggcagacggcccaggcgccgattccctcgccctggccttcccaaccgagcctttcggtcgtagtggcggcgacgcccacgttttcgacatcgacgcccagggcatgggcgaggttggcgcgcatggcatcgcggtgcggggtgatcttgggttgctgacaggcaatggtgcaatcggcatcgacaaactcaaagcccagctcgcgcgcatagtccatcacgcgggcaagcagcaccatcgaatcggcaccctcgtaggcgggatcggtgtcggggaatagcttgccgatgtctcccccgcggcaggcgcccagaatggcgtcggccaaggcgtgcgcgagcacatcggcatccgagtggcccagcaggccgcgctcgtagggaatgtcgacaccgccgatgatacatcgacgcccctccaccagacggtggacgtcgtagccatggccaatgcgcaggttactgaacatggggaaggtcctctccctcggccatgcggccaagcagaatcgcggttacgggacgcaagtcctcgggcaccgtcaccttaaggttatcgcgcgggctctggacgcagcggacgcgcccacccatgcgctcgaccagcgacgaatcatcggtgccgataaagccctcggcaatggctgcagcgtgggcgcgcttcatagcatcgacgctaaagatctgcggcgtctgcgcggcccaatagagctcacgcggcggcgtctcgacgatattatcgccgtcgacgatcttgagcgtgtcgatcgcgggctgaccgcacacgacaccgtcgagcgagcggtcacccatgagcacgtcgatagcgtggtcgatggcctcggtcgtaatgagcggacgagcgccatcgtggatggcgacatattcgaaacccgccggaaccgcatgcacgccggcacgagtggaatcctgacgggtatcgccggcatcggcaaagctgatgggcgtgtcatagtcaaacgggtcgatggccaggcggcgcatctcggcacggcgctcggcaggacacaccaccacgatgtggccgaccttgtcgctacgatcgaacgcgcggatggaccagctcatgagcggacggcccgccacgttaacgagctgcttgccgccgggatttccaaagcgctggccgctgccgccggcaacgaccacagcgcatacgggcgccattatgcgttcccctgtttggtgcccttcatgcggtacagcgagtccgcaagaatggcagggttgttgacgccaaagtcgcccaagcgctccggatcctcgctgatgtcgtccatgagctcctgcagcgagccatactcgtcgacgatcttctcggccacgccgtcgcgcacgacggacacgcgcgaaagcgtgcgcaggcccagcggcgtcatgacggagtcctcgtccaggtcgtcatagcccagaactgccgccacgtgctgcgggtcagacaggtccttaggcgtcatgcgactcagctcggcgcgaatcttctcggcgttggcctcagaggaatcgcttgcgtagtcgcggatcatcaagtcgtattcggtatccatgctggagcccgcgagctgctcaagctgcatctgcacgagcttgccctggttacccagcttgacgatgcaatccttaagctcggtctttgcctgttgcatgatctcgaaactcgagaaaatgccggtgatgtcggcgagcgtgacgtagtcgtcgagctcgagggccgtcaggcgcagcagggagcgatcgagcgactgacgggtagtctggagcgtggcgacgagctggttgaccgagctcatgatggtggtgacgggctggatctcgtagctcttgccgtggacgtacacgttgacgacggcgcgacgagccgaaaccgagatcacgatggcatcggtgagcaccgacatgcgagcggcagtacggtgacgcatgcccgtctcactcgtggcgagcgagggatcgggattgaggtggaagttggcgcgcaggatctgggtgaggtcgccatcgataacgatggcgccgtccatcttggaaagctcgaacaggcggttcgaggtaaacgaaatgttgagcgggaagccgtcgttaccggcagcgagcacgttttcggtgtcgccgacgcagataagggcgcccaggtgaccggcgatgatcatgtcgagggcggtgcggatcggctgaccaggtgccgtcaggcggatggcctgttccatacgcttttgcagctcgttcttatccaaggcatcgctcccatcgtatacgctccataaacgctaaatagtttctcacggtttgtccctgcggcgcttgcgaaatccgatgcttacagaatgagcgaacacagctgagagcccaacccaaatcagctgttcatgtggtagcatcgggattcgcataaatgagggagtagtcgcgtgatcgggttcgcctccggtggcgcggcaagtcaacacactggccgatgcggcctggcttgccttaatgaacgagactcgtggctgtgcgcgcaacgcgtacgccacgggtcttttttgttactcccccaagaggtacacgcgggcccgcccgcagagagggagccagactatgggactcgcagagcttgtgttgctcgctatcggcctttctatggacgcttttgccgtatccatctgcaagggccttggcatgaaaaggatcaaccttaaggtcgccgtgatactcggcctgttctttggcggtttccaggccggcatgcccgtaattgggtgggcccttggtagccagttcatgggcatcatcagccccatcgaccactggatcgcctttatcctgctcgcctttatcggcggcaagatgctgtgggaagcctttactgaggacgagaacgaaggcgacggcaaggatgccgaaaagatcgacctgggcgaatatctaatccttgccatcgccacctcgattgacgcgcttgccgtgggcatctcgtttgccgcgctctcggtcgatatcgttcccgccgtgtcgctcattggcatcacgacctttgtcttctccgttgccggcgtagcgatcggccacacctttggcgcgcgctacgaaaagcccgccaccatcgtgggtggcgtcgtgctcgtcctcatcggcctcaagattttgctggagcatctggggattttggcgctgtaaaacacccttcaaaactaaacgtccggatgaggcctcatgcagagttttgcatgaggccttttcatgcagacttttgcatgtcatgctatgatgcaaaagtctgcacgttaggagatcgccgtggatacccttcccatcaccacaccgcgccaagctggcatctacgtgcgccaggcacgcgaggctcagggtctcacccgtgccgccctcgctaataaggccggtgtttcggagcgcctgctcgcatcgctcgagctgggagatgccacgggcattcggctcgacaagctgttgaccgtctttaacgcactcggcataggtctctttgcgcaaagcgataacgactccatcgcatcaccctccgaacatccgatgacgatagcggacctccctatcgcgaactcgaatgccctgccaaagccaagcgtaggcagacgacccgctcgacaaggaacgccagctttctatggtgccttgctggcccaaatcgcagccgagcaaggcctttccggcacttcagacctctcctttggctgtaaggttgtgaaataaatggcagaaatggagcttgcgaccttcatttgtggcgaaatcgccggcactctccggcaagacgagcatggactctgcagctttgtatacgccccaacctatcgcggagcaccgctatcgttaacaatgccgctttccaatcgcacatatggccataacatcgtccgtccgttcctatttggccttttgcccgacagccaagagcagcgtcgcgctattgccgccgagcatgacgttgcatccaacaaccccgtcgccctcttgtgccatatcggtctagactgcgcgggggccgttcagttttgtcgagccgatcaattagatgccgcccacggcagggtctcagcataccgcccgcttaccaattctcaaatcgctcacaagctcaaagcaattcgcgatgacgaaagagagacatggatgggctccaacgaaagctggtccctgggcggcaaccaaggcaaatttgcactagcttggcatgatggacaatggtgcgaatgtctagggtcatcccccactacccatatcttcaaaaatggtgtcgttgggttcaaacatcaggccttaaacgaattcgtctgcatgaaaacagctcggcgtgttggcattccaactgccaacgtctcctattgcacatttgaagacgaagctgcgctcgtcgttgaacggtacgacagaatggtcaatagcagcggaaatatcgaaaggctgcatcaggaggacttttgccaggcactcggtgtattgccaacccagaaatacaccgccgacggaggaccaactacacgagacatccaagaacgactgattaacacagtcccccaccacatgaatcttgtgctttttacctatatgttgttctataacgccattatcggagcgcctgacgcacacgctaaaaactactcgctcatcctaggcaaaggcacaaacgcggcgctcgcacccatgtacgatgtcgcatcgggcttagcatacgaacgtatgcggcgaaaagcgcgcctcgccatgagcgttggcggcgaaaatcgtgtggggcgaatcggtccaggcgctatccgccgataccacggtatgggcgatcccgcgctggaggcggcgcttaccgatgccgggctatccgagaagttttgctttgcgaccatgatggacctcgcctacgaggtacccatttgcatggaagaggtcatggacgaatacgccgacctgcccggcatggcggacctgcgcgagcatatgctcggccccgtccgcgaaaactgccagcgcaccctcgacctcatcagggcagaaatggactaggtgaccgtaatttcgcaattatcaaacaaaagaggggggcacccgtcgcaaacgctcgaatgccccctctcgtaatgtcatttgcaatccgctagcacgtggctcggactgctgctagcgcaacctttacgcagcgaggcgcttgagcacgtcgatgagcagctcgtagaagcgctcggcagaagcgagctccatgctctcgtccggggtgtggacatcggagagcgtcggacccacggcgatggcgtccaggccgtgcagggcctcggcaaacaagccgcactcaaggccggcgtgaatggactcgatgcgcagctcggagccaaagagctcgcgatagctctcgacaaagatgtcgcggaccggcgaatgctcggcatagctccagccgggatactcgaactcaaacttggcgtcgaagcccaggacatcggcaagcgtctgcaggcggtccttgaactcgttctgcagcgaggtgatcgaggagcgcggggacagcatgatcttgacctggtcgtcagaggtggcaaccacaccgatgttggaggaaacctcgacggagccgtcggtggcgacgttgcggcgaatcacgccgttaggggcaagacgcagggcacggatgagggcaagcgcggacttctcgtccatggcctcgacctcggcgtcgtcggcaatctcgacggtgcaggtaaagccggggtcaaagacctcgagctcggcagtaacgtcggcgatgatgccctttgcgatctgggccgcggcctcggcggcggcgtggtcggcgtagaccagaacagctttgcactcacggttgatggcgttgtccttggtgccgccgttaaagctaacgatggcgggctcgccggcgaccatcaggcggtcgatgatgcgggccatgatgaggttgccgttgccgcgctccaggtggatatcgctgccggagtggccgcccagcaggccggagatgtcgagcgtgagggtgctaccggtcttgtgctcgcgcgcgatcgggcaggtgtaggtaacgacgacgccgccggcgcagctgacggtggcaacgccctcttcctcggagtcaaggttaatcatggtgcgggcgctaatctgggacttgtcgagcgtctcggcgccaaccaggccagtctcctcgtcggtggtgaacacgcactcgagggccggatgagcaatcgaatcgtcgttgagcacagtgagcatcagagcgacggcaataccgttgtcggcgcccagagtggtgccgttagcggtgaggacgccgtccttgacgaccaggtcgataccatcagtcgtaaagtcgtgctcaacggagcccagcttgtcgcacaccatgtcgatgtggccctgcagcatcacggtcggggcattctcggcgccggcagatgcgggcttgcgaatgatgacgttgtagacctcgtcctgatacacatcgagaccgcgctccttggcaaacgcaaccaggaaatcgctgatgcccttctcgttgccagacccacgggggatcgcgctgacctcctcaaagaaatggaacagctgggcgggctcgtagccggtaatcttgtagtccatggtgcctccttggcgcaactggttagacagtaagacatgcgccttgtatattcccagacttcgtttgcataaaccagtcgaaaacgccgagcgctctcgcatcatcggctaacggtggaccgcatagcgtaacggtcacagttaccgcagctctacaaatcgaggcgcccttgccggaacgcctcgattgcacagatcaaattgtcgccacgccctacagcgcgccggaaccggcttgcatcatgccgccggggcccgagctcgcgcatgtaggtacagaagttgtcgagggcgctcaggcccnnnnnnnnnnatgccgccggggcccgagctcacgccactgctcacaggcgcggcgtttccggtgtgcggcgctgccggagcggtatcgcccccgagcgcacctgccggacgcggcgctggaatctcgcctgtgccatggctaaagacgaacttgccgtcggccacgtcgcacaggacggtatcgccctcgccccactcgccggccagcagctcctcggacagcgggtcctcgatgagcttttggatggcacggcgcagcggacgcgcaccgttggtgaggtcggtgccctcggccacgatcttgtcataggccgcatcggtgagcttgatgttcatgccgttggcaatcaaacgctgacgcaggtcgtccaccagcaggtgcgcgatcttggtaagattctcgcccgagagcttctggaacaccacaatgtcgtcgatacggttgagcaactcggggcggaacaggcgcttgagctcgcccatcgcgcggccgcggatctcactcgacgtgaggccctgctcgccggtggtgccaaagccaacgctcgcatcctgcgcgatctcgcgggcgcccacgtttgacgtcatgatgatcaccgtattgcggaagtcgaccgtcttgccctggctatcggtcagacggccctcctccaacacctgcagcaggatattgaagatgtcggggtgcgccttttcgatctcgtcgaacagcacgaccgagtacgggtgacggcgaacagccttggtgagctggccgccctcgtcgtggcccacatagcccggggggctaccgatgagcttggagacctcgaactcactgccaaactccgacatatcgaagctgatgagcgcgtccttgctgccaaagagatactcggcgagcgtcttggcgagctcggttttgcccgtgccggtggggcccaggaagataaagctgccgccggggcgacgcgggtccttgagcggcgagcggctgcggcgcacggccttggcaacggcctcgacggcctcatcctgaccgatgatgcgcgtcttgagcacgctttcggcctgcagcaggcgacggctctcgctctcggtaagcgaagacaccggcacgcccgaagtcannnnnnnnnnctaaccggcatagaagaacggagtcagaaccaggaccgacacgatgtcggcgatctgggagacatcgatggtgagcgggctggcgtcgagctcggcggtccaggcggccttggcctcggcgagctcaatctcggcggccttctgctgctcggtgatctcggcggccttgttcatgtcgtcgctctcggtggcctcctgcgcggcggccttaagctcctccacgcgatgctcggcctcacgcaccggctcgggcgcgcgattcgcggcgatgcgagcgcgggcgccagcctcgtcgatgaggtcgatggccttatcgggcaggaagcgatcctggatgtagcggttggaaaggttcgcggcggcctcgatagcaccctgcgtatagcgcacatggtggtgctcctcgtagcgcggcttgagcgcggtcaggatcttgaccgtgtcctcgacgctcggctcctcgacatcgatggtctggaagcgacgctcgaaggccgggtccttggtgaggtacttgcggaattcctcggccgtggtggcgccgataatctggaaggcaccgcgcgcgagcacgggcttgagcatggagctcgcgtcgatggagccctcggcagagccggcaccgatgatggtgtgcatctcgtcaataaacaggatgacgtcgtcagcttcggtggcctcctggatcacgttcttgaggcgctcctcaaactcaccgcgatacttggcgcccgcaacgaggcccggcaggtcgagcgtccagatgttctggttcataaggttctcgggcacgttgccagctgcaatctgctgagccagaccctcgacgatggccgtcttgcccacgccggggtcgcccaagataagcggattgttcttggtgcgacgcgaaaggatctccatcatacgctggacttccttttcgcgaccaattacagggtcgagctcgccgtcgcgcgccttctgcgtaaggttggtggcgaactgcttaagcgtatcggtgccgctccccttttgctgcgacgcgtccgagccgctaaagaacggcaggcccgcaccgggacgcccggcaccggcaccggcgagcggacgcttcttgtcctggtccttggcggtaagtttctcgatagcctttttgatggaggcggacgacacacccaggcgcatgaggatgtccatggccatgccgttaccctcttcgacgatgccaatcagcaagtgctcggtcgacacgtaggtctggttgttctcacgtgccacgcggaaggagcgctccatcacgctaatgacgagcggcgtaaaggcaagcttggcagcctcggtctcctcgctgggctcgggaaccgtggtctggacctccttgagggtgtccatgatgtcgtcgtaggagatatcaagcgagcgcagcgcctcggcagcgatgccctcgtcctccttggcgagtgcgagcagcaggtgctcggtgcccaccttatttgagtgcagatcgagcgcctcctgtttggccatcgacatgaccttgcgcgctcgatcggtaaatctatctaacatgctcgtttccttacatgagttcatcgaaatcaaaacgcccgcccgtcggcggcgcttttgtctctttacccacaggttgtctatgttaacagctggaggaatatctataaacccggctcacatgaatgcaggttatgaccgcatcgcgggactcaccgcgcgatgcgcgacaggcgccccgcaagagaaaccctaggcgtctttcaccacgtcgggactcgtcgcacgcgatgcgcgataggcatcgacctccttggagacgcgttcgagcagctcggatgtatcgacgccctcgacttgcgcgaccgtttccaccgtctgcatggcgaccgccctcaggtacgcgcacgcgctgtcccccggctgctcgaggtctatctcctcgccgccctcccgggcaaagccgaccgccatcacaaagcccatgatgcccgagaccagaaagcccaccgcaaagctcgaatctgccttgagctcttctccgtcggggtggacgatctctctcacgcggtcgatgatgatcgtatggatgccctgcacgacctgctcggcggcacccgccctcatggtgatgacgatgcgccgcagcaggcagcggacgtcgcgccggtcgaacgccgaaaggtcgccctcgctcgaaaaatgccagagggcatcggtgatgagctcgttatcctgcagcagctgggctatggcgatggcgacgagttcatcgaaatcgtgaaaatagtagtaaaacgttccgcgattgcactgggcggcgcgggtcacctcgccaaccgacagctcgaagatgctgttgttctcgatgagctcccaaaacgcctcgatgatacgggtgcgtgcatcgggcgcatcggcgtccttacgcggtctcgccatgcgcctcaccgcacccctgcgccttggcgttcatgatgagcatctgaagacggttctccacgttggcgaagctcacgtcgggatcgtagtcgagcggcaggaactgcgccgtgggatactgctccttgagcgcatggatgagcccgcgccccacgacatggttgggcagacacccgaacggctgcaggatcacgaagttgcggcagccgcgcttggcgtgctcgagaatctccgccggaatcagcacgccctcgcccgcatcgaacgtatggtgcaggatcttatcgctcgcgcgcacgagctcgggcatgcgcgtcggcggctcgtagagcgggctcgccgcgcccaggcggtcgcaacggtcgtgcgcgagctcgaacaggttgtccgccgtggcgtaccaggccttttcgggcagcgacaggtcgacgtggaactcgcgcgactgcgcatgcttgtagaaataggtcttgcggatcacgtcggtcatgcgcgcctcgatgacctcgagcccgttgtcctcgaggtagcgctcgatctcgtggttggcgccgagatggaaattgagcaggtactcgcccacgatgagaacggtcggatgcgggttcgagcggtcgtacggaacggcgtccatgatcgcaagcgcgcgtttgaagcccgtcgcctggcctctcagcccggagcgctccatgccctcgataacctcatcgagcgcgcggtcgaacgcagcgtccgccgcgcccttctcgagctcgtagggacggatgcgcctaagcatggcctcgagggcatcgatcatgggaagaccgtaggcgatctggatgctcgggccaaggccgagcttgaagcccggatgcgcattgtgggcatcgacgtcgtcgttggtgagcaccgggacatagtcgtatcccgcgtcgtcgagcgcgcggcgcagcaggggcatgtagtgcgtcaggcggcagtcgccgatatacttgccagtcaccacggcgacgtcgtgcgggtcgtacttaccgctctcgagtgccgcgagcgcctcgccgatcacgatttgcgcggggaagcagatgtcgttgtgcacatagcgtttgcccaggcggatggacaacgacatctgcttccccgcgcacgatatcaagggcctcggcgcgcacgccctgattgcgcatcgccgcggtcatgagcctgcagaacgcatgggaggtgttggggaccagcgcgatcttgtcgtgccggtcgcgcttggtgtacttgaccttatacgggtcgtcgagcggatggaccgcgtgcacccgggcgccctcggcacgctcctccgcgcgacgacggttgaccgactcgataaacgaacgcacgcgaatgcccatgggaccggcgacgtcgctctcatcgagcttgatcatcatcggaaccttggagcccatctcgcccatcatgcgcgcgatctcgtcggtgagatacgcatcgtggccgcagccgaagctgcccatctgcacgagctcgagctcgggcgtcgatgcgacgatgaccgcgcacgacagcatgcgcgcatggtagttgttcacgatgtcgatgcggctgttggaaagatcgacgttgcagacccccggcaccgcatcgggcgtcagcacggggatgccgcgctcagagaagagcttgggcagcccgtggttgaccagcgggtcgttgtggtacgggcgcgaagcgatcaccaccgcgtagccgccgtcctcgtgcacgttctcgagcacctgcctgccgcgcagctgcagctggttctcaaacgtctcctgcgcgcggtccgcctgctcggtcgccttggcaaccaggtcggcatcgatatcgaaggtctccttgcaccacgccttgagctggcggtttcggtcgccctcgtcgtaccagtggaacagcggcgtatcgaacggaacgccgaaacgctcctccgggttatcggaattgcgcatcacgtaggggtatccctttacgacggcgcacatccactcgctggtagaggcggtgttttcggtgggcaccgtcgtgatgacgggcatgaagatgcggtcgacgccggcgtcgacgagattgcggatgtgcccgtggacgagcttggccgggaagcacacggtgtcggatgtgacgtgcgccagaccgcgctcgtacatcgccttggtgctgcgtcccgagacgcgcaccttaaagccgagcgtgctgaagaacgtcgaccagaacggcatggtgtcccagaactcgagcacacggggaatgccgatcgtgacatcgcgccccccgctgacggaaaccgtggggtacgactcgaacagcagcttctcgcggtcgacaaagagattgggggcagccgcggtccggtcgcgccccgtgccgggtgcctgtgcctcgcaagcaccctgcggacgcagctcctccgccgcgggaacctcgcgcacgagctcatcccatgagatggcgccgccgcgcgggcagcgattgcccgtgacgtaaagcgagccgtcgccaaatgccacgaccgcgcgctggcagcggttgttgcaccgacggcaggtaacgccgccgaactcgcgatgctcgaagcgctccacggcatcgagcccgataaacgacgtgccggcgtcgcccttgcggcattcctcgcgcgcgagcagggcgataccgatagcgcccatcagccccgggtggggcgcacgcgtgacgggtttgcccagatactgctcgaatgcgcgcagcaccgcgtcgtttcggaacgtgccgccctggacgacgactttgtcgcccagacggttgagatttgaaacgcgaatgaccttggtgaacacgttctcgataatcgaacggcagagaccggccatgatgtcgcccggacccttaccgcgccgctgctcggaaacgacgctgctgttcatgaacaccgtgcagcggctgccgagaacggcgggggctttggacgaaaatgcctcggtcgcgatatcctcaacggctattccgaggtttttggcaaaaccctcgaggaacgagccgcagcccgcagagcacgcctcgttgacgacgatatcggtcagcacgccgtggttgagccagatggccttcatatcctgtccgccgatgtcgagcacgaaggtcgcatcgggaacgcatgcgcacgcggcgcgggcgtgcgcgaccgtctcgaccgtatggtagtcggcgtggaacgcgcgcgcgaaaagctcctcgccgtatcccgtggtgcccacggcatcgatcgcaagcgtgactcccgctgtctcccagcggttcttcaagctgacaagaccctgttgggcgacgtcgagcggtctgccgttattagacgcgtagaacgaatcgacaagctcacccgcctcatcgaccagggcgaacttggtcgtcgtgctccccgaatcgataccgagcgccacacgcaccgtctctccgggcgcatacgcatccggaccctttgccggcgtctctttgccatggcgtgccgtaaaatccgcctgctcggcaggtgtggcaaaaaagggctgggcaagacgtccctccccgcttgcgggcgcgaccgtctcgagcttatccagccggacaaaagcgtcgggaaggtcgatcggttgggacgatgcgaacatgtcggtcagcgacagggcggcaccgcgcgcgaccatgatctgcggatcgcgcgggacgataacctgatcgtccgatagattcagttgctcccggaacacgcggaccagtgtggggttgtaggcgagcgtaccgccctcgaagattaccggcggctcgatgtcgataccctgggccagaccgccgatcgtttggcgggcgaccgcgtgaagcgccgaaagcgccaggtcggtggtaggaatgccctcgttgagcagcggctggatatcggtctttgcgtacacgccgcagcggcccgagacctcgtggacggtcgtcccccggcttgcgagctgctcgaactcgcccgattcggtgccgacccccatgagctttgccatctcgtcgataaatgcaccggtaccgcctgcgcacgagccgttcatgcgcatgtcggcaacctcgatgtctcccttatcgttggtgcggaagaagatcatcttggcgtcttggccgcccagctcgatggcgcagcgcgtctgcggatagaacctgctgatcgcgagcgcgttggcgaccacctcctgaacgtacgaggcgcccagcgcggtcgcgatatcgcgcgcacccgagccggtcaccgcaacgcgcagtgactcatggggaaagcgctcggcgagctcgccgagcatggcgcgcacgctcgctgtctgacacgccccgtggcggcgatatccccaccacgcctcggtcatatcctcgtgcatcgcgtaaactttggtcgtcgtcgaccctacgtccagtcctactagcaacgccataatgctccgtctctcgcatttttcccgctagagatataccactctacgtaatacaacagactgttgtatttaaactccgtataaaaagcggctgccgaaacgcttcagcagccgccgaatgcaccaacagattgttctgcgcgctagcacgtcgggcaacggagcagcacgggccctccggtcatgcgcaccgctcacgcccgcgatgtcgccgagagagctatccacgctttgggctccaaccaagcaagtcgcccgcgctcagcagatccctaagcgagctactcgcactcaggagccatagcctgctccaagagctcggcatgctcctcctcgaaaaccgtccccacagggaaggcgcgacggaagacgaagcgggaaatcggaccggctaccaaaaggttccacggcagcgccatcacaaaattatgcgggatgttgatcatccagatcgcgggcacggaatacaggttcgcaaggatgccgccgggcatgtgcgtcagaccctcacaggcaccgtacagcgacatgatgatgaccatgggaacgaccatgcaggagctgacggcaagcgtcatggcaagcggcgaactcttgcccggcgtgaccaggaatttaaaggcgaaacccttggcaagggggctggcaacaaaccagtcgcagcacatggcaaaaatgtaggcaacggggaagccgagccacgcggcggcaacaacctcgccgttgatggccccatgctgcagggcaacgttgtagatgctcatccagagcaccatgcaaaagcacatgataaaggtgaacagcaggctctctcgtttgttgataggcataaagggcattgtcctttctgtgttacgccgcggcaccacgcaacaaaaacgggcgggcaagatggagctgttgggacttcatctcgcccgcccgtggtacgtgcgtctgcgactacttatgtggtggaactaccctaacacgaacggcgcgcgcttcgtaagcgttgagtttatggagatgcaggacaccaataatccccccccccccccnnnnnnnnnnnnnnnnnnnnnnnnnngaccccataagttgcggtggaatacggactgttttgaccctttaagcagcaattcagtccctatttcaccgcaactcattgggggtgcaaagtaacctgtcccctttgcaccaattagctggtgtggcgccagcgagggtcggtgagtgtacgtgccacacccagaccaacgggcaaaaacgccacgatgagcactgcacgcacaaaccaaccgagcatattgactgtgtcgaaggtgcacatgtaatacatcgagcgatacagatacaaacccggcaccataatgacaatcgaaggcaccgtgagagcgatacgcgggtaggtgagcttgacttcggccaagcttgccagcagacccgataccagcgcgccgataaacgctgctgcctcgggaggcattcccgtgctgaggcccaggaagggaatcatcgtcggcgcatcgacgagcgtaaggcgcagggtattggaaacggcgccgatcaacccagctgccgcggccatctttaccgggctgttgaacatcaccgagaagccgaatacgccaacgaagctcatcaccacgcgcaggagcgtaagggcaagcggcgaaaggcccagtggggcaaagtcgtccggcgccaggccaacacactcggcaaccatccaacctacgagggtcgccatcacaataatcgatacggcatatgaaaggcgctcgataccgcttcgcatgtcgagcttagcgatgtcgaggcctgccgtaatgagcggaaagccgggaatcacaaagagcatggcgccgatatagccttcttggtgcgacattgcccccggtatgacctggccaaggccgagcaatgccagcagatacgaaacgcaagcgagcgcaacaccggtcgtcagcgcgctgaactgaccaaggccttgcttgagaatatgggagcgagcaaagttaccgacaccagcgcctacgaatgcacaggccatctcgatagggccgccgccgagcaaaaagacgaaggcgccgcaagcacaggctgccgcaaggccctgttgccagggagagtaatcgggctttgagctctcaacggtcctgagcatctcgtgatactcgtgtaccgtgaagcgacgaccataggtctcgatttccttgaggaaactctccatcatccaaatgcgatgggtattgactcccgttgtgggcaggctgacaacctcgttaaagcagtggccatcttcgatgcaggtgcactcaaacgacagaagactcaggtcgacgtgaatcgtgacgcccagtacggcagcaacacgattcatggtatcgcgcacgcgccaggcacccgttccgcttgccagcataagcatgccggtgcggcagatgatggatgatttatcggtgagcggcgcatcgacggcaagttcatcgcctgccgtcacgatctggtgccagtcagttttcatatggagcgcgccggcacgaacgccgtgatgcatgggggctctcgaaagcagcgagtcaaggcgcgaaggctgtgggggctccgttaattcgccctcgtcctcgtcgggctcttcatcgaccagatcaaaggaatcaagcggcgctggctcgcgacggtcgatcagctcctcgtcctcatcatcaaagtaattgaactgatcgagcatgtcctcttcgattgaacgctcgctcgcgtcgtccatatagacgctcccttcctaccgactaacccccatcctaggcagcaacggctaaaggaaacataaaaggacggctgtcatgcgagccatgtgcgcaatagccgttgggtagtcgtttgagaacgcccccaatgactacatcgatgttctaagtgtcaaccaagtcaacgccgcagatagaggacggacagcgagcgacgtccagggcgaacaagttggcatgaaaaaggcaaggcatagaccttctggtcatgccttgccttttgaatgacaaattgtcgccctgggcgtcgcgcagcgtcggctggtccgccgttcggtagaacggcggaaccaattagtacatctttgcgccggcgggaatggaggcgtcgagctggatcaggttgaggcgctcctcgccctcctcctcgtggacagcgctgatcagcatgccgcagctgggaatacccatcatcttgcgcggaggcaggttggtgatggcgagcaaggtcttgccaaccaggtcctcgggctcgtaataagcgtgaataccggagaggatggtgcggtcggtgccggtgccgtcgtcgagcgtaaagttcagcagcttcttggacttcttgacggcctcgcatgccttgaccttcacagcgcggaagtcgctcttggagaaggtatcaaagtcgacgaactcctcaaacagcggctcaacggcgatcttggagtaatcgagcgtgggcttaagcgacttaacgaacgggctcgcggcgttgccggcctcggcagccttggcggcagcggcaccggactggaaacccttctcgggcttcatgtgcgggaacagcagcacgtcgcggatagaagcctggttggtgagcagcatgaccacgcggtcgataccgatgccgatgccgcccgcgggaggcataccgtactcgagggcgcgcacgtagtcctcgtcgtactccatggcctcgtcgtcaccgccggccttctcggccatctgggcggcaaagcgctcggcctggtcgaccgggtcgttgagctcggaaaatgcgttggcgtactcgtggccggcaataaccagctcaaaacggtgggtcaggcgcgggtcatcctcaaagcgcttggcaagcgggctaacctcgatggggtaatcgcacacgaaggtggggttgacgatggtgtcctcgcccagctcgtcatagatctcggcgatgatcttgccggcggtccactcgggcttgatctccaggcccttctcgcgtgcggcggcagcaagctcctcaaccggcgtgtcgatggtgacctgcttgccgagcacgtcggagacgatgtcggtcatgggacggctggcccactcaccagaaaggtcgatggtctggccctgatactcgatgacctcggggttgccgatggccttgttagctgccttaatgacaccctgggcgagcgccttcatgccctcgaggtcggagaaggcacggtaggcctccatcgtggtgaactcggggttgtgggtaaggtccatgccctcgttacggaagatgcggccgatctcgaacacgcgctcaaaaccaccgacgatgcagcgcttgaggtgcagctcggtggcaatacgcaggtagcactcctgatcgagcgcgttgaagtgagtgatgaacggcttggcagtagcgccgccctggatggtctgcaggatgggggtctcgacctccatgtagccgtcggactccataaagcgacggaaggtggagagaatctgcgaacgcttacggaaggtctcgcgaacgtcgtcgttggcgatcaggtcgacatagcgctggcgatagcgggtctccttatcggaaagaccgtggaacttctcgggcagcggacgaacggccttggcaagcagggtcgcgctcttaggggcaacggaaagctggccacgctgggtgcgcacgaccacgccggtcacgcccaggatgtcgcccaggtcgagggccttgagcgtactccaggcagcctcgtccatgtcgttgatgcggcagaacagctgaatctcggcagtcgcatcgcgcacgacgatgaacatgatcttgccctgaccgcgcttggcgaccacacggccagcgatcttcacgacgtcctcggtgtcctcgccatcggcaagctcggcgtacttagcctcgatatcggcgacgtagtcctcaagctcagagtgctcaggataggggttctggcccgcctcgaacagggcggcgcgcttggccagacgggtggcgcgctcgtcgttgagcgtcgatgcctgatcggcggcgttctggttctctgccataagttagctcctcaaactaaatcgctccctaggattcggtcccagggagcgaaaacatacctttacgcgggaccgtggtctagcgtgcgatcttggcgatggtgtagacgcgagtcttgccggaaggcgtaacgacctcgacggagtcgccctcgccgtgaccaatgatggcgtgaccgaccggagactcgttggaaatcttgtgctcgagcgagttggtctcggtggtaccgacgagcgtgacttccatgacctcgccgttgggatcaatcagcgaaacggtggaaccgatggagacggtcaggtcgcccgtggtggcagcaacctgagcgttggcgaggatggcctggatctcggcaatacgagcggcgttctgggcctgcttgtccttagcggcgtcgtactcggagttctccgaaaggtcgccgaacgcgcgggcttccttgatgtcctcgacgatctccttggcgtaatcgccctcacgccaagcgagctcctcgacgagcttctggcggccctcagcggtcagtacgatctggcttgcgtccatacggatatctccccaactctgatcaaacaatcaactgtcaacaaaacgaaaaagaccggctagcctgcgggcaagccggtcaggtgctcaccccaaagggatgggactactctgcgtccgcgtcgctgtcctctgcctgcttcttcttggcagcagcgagcttggcctcgagctcagcgatctccttgtcctcctcggactgctcgaccacgacctcctcggcctgcttggtctcggccttatcgtcgccctccataccctcgcggatattcttgacggtagagccgagggacttgccgagcttcggcaggttcttgggcccgaagataatcaggacaacgacgagaataatgatgagctcaggagccctcagtccaaacatgtagacctccacaatacagcgagacaagctcgaatgagtataccgcgggtatcgcggtatcacaacactagctaaaaaaagggaccgcaagaagcggtccctcctcatgctctggtcgggttgactggatttgaaccagcgacccctgcgtcccgaacgcagtgctctaccaaactgagccacaacccgttagctcgactatagtaacaaagattttcgccgcgtgctagagaaatttttatttctttggcgcgtcgatttgaaccgtgttgggaatgagctcagtcgcgcaggcccaccagccattttgctggacagcgtcggcaagcctttcggccgtggcggcggtgtcgcaaatggcaaacgagcaggcacccgatccgcacacatctacagcaacggtgccgtcctgtttacgcagccaatcgagaaccgtttgaatctgcggctccatctgtgcggaaatgatacccaggttgttatggatgagcgcatatgccgtctcggcatcaccagcacgcaaggcagaagctatcgcgccgagcttgtccgcaggcaccggggcctcgtcaaaacgtcgataggcttcaattgtcgaaacacttgcctcgcgcggcttgaccagcacgacgggcgtcgcgggcagcgcggggtactcagttgccagcacgtctcccccacctacgtagaacgcagggctcacgtgcaaaaagaacgggacgtcggcaccaatgcctcgcgcaatatcgtcgagcgctgggtcggtgcgatcaatgccccagagctccgccaaggcgacaatgaccgcggccgcatccgtcgaggggccgcccaagccggcgcacaatggaatgcgcttctcaatcgtcacgcagatgtttgcctcgcgaccataatgctcggccatagcaaccgcagcccgatacgccgtattcttttgcatgggaaaatctgatgctggaaccgtctggacggtcagcgcctgcgccggcgtgaccgtcacggtatcggaaagaccgacggctgccatcagggaatcgaccctgtggtagccgcggtcatcgcgctcggtatgaacccccaggtagaggttaatctttgccggcgcggaaagagtcagggaccgatcggtcaccgttaatgctcctcgagctgattgccgagcggggtaaagatgtgctcgccgctctcggggtcgaacagctcgacctgaccggtgaggacatcgatatactggtaggactgacgcgacttgcggccacggcgctcgtcgacctcgacgataaagactgccggatggacgctcttgatggtgcccatgcgctcgacgacgcgggtgcggcccatgttggccttcaccttaacgcgatcgcccaccatatcggtcagcttctcgtggatgtcgtcgacgtgattgacttccatctcttccatgaacagggcctccagaaggtgcaattcaaaaaggggataatacccctaagatagacaaaactctaatactatagcactctgttgtggccatacgcaagtagctaaaaaagcccggtcccaaattgactacttacagactatcggtgtccaagacgatggtgaatgggccgtcgttgacgaggtcgaccttcatgtcggcaccgaagatgccatgcgctacgtgctcgacgtcctcgcgcacaagcgtcaggaagtactcgtagagctcgttggcgacatcgggggcgccggcatccgtaaacgatgggcggcggccgtgacggcaatcggcaaacagcgtgaactgcgacaccacgagaacctcgccgtcgacatcggcaagtgccaggttggtcttgccgttctcgtcctcgttaatgcgcaagccccggagcttgccccacagcttatcggcctcggcgcgcnnnnnnnnnnnnnnnnnnnnnnnnnnnnnnnngcccagtagcaccagatagccgcgcccaattttgcccacgcactcgccgtctaccgtcacgccggcgttgagcacgcgctgcaccaccgcacgcacggcctactcctcgcccgtcagtttggcggataggtgctcgagcgcatggaatcgatggctgatggcgttcttctcgtccgccgtcagctcggccatggtcttgcccggcgtgtcgaccggcaggaacagcgggtcgtagccaaagccgtgatcgccgcggccctcgtgtgcgataacgccctcgcaggtgccctcaccataggtgaccaaaccgtccgtgtcgatgaacgcgacgacgctcataaagcgcgcggtgcggtcctcgtcggccacgccctccagattcacgagcagtttggcattgttggcggcatcgtcgccgtgaacgcccgcgtagcgcgcgctatacacaccgggctcaccgtccagcgcgtcgacgaccaggcccgaatcgtcggcaatggccataaggcccgtctcctccaccgcagcctgggccttgatgatggcgttctccaaaaacgtcgtgccgttttcctcggggtcctcaaaatcgcccagctggccgagcgccacaaagcgaacctcgggcataaccttgcccaaaatggcctcgatctcggtgagcttatgggcgttgcccgttgccacgacgatggtcgccgccgggtcgagggtgtcgatgtcgatcttctcaagtgccatgagtggtctccttgtccgtatagcaatgccgtgttgaggacgacgaggtctcggcctctcctcctcttaatcagcggcagtcttatacttcggcgtttccgcagataaaacctgccaaaataaacctgtccctttttggcaggctaggcgagagcttggcgctggagctcgatgagctcggcaatgcccttgtcgcccaaatcgagcagggaattgaggcgcttgcggtcgaagggcgcctgctcgccagtgccctgaagctcgatcatctcaccggtatcggtggcgacaaggttcatgtcgacctcggcgtgactgtcctcggaataatccaggtcgagcagggtgttgccgtcgacaacgcccatggaaatcgcggcgacctggcccgtgagcggaatgcgctcgagcttacccgcctcgacccacatggcaagggcatcgtgcagcgccacccaggcgccggtaatgctcgccgtacgcgtgccgccgtctgcctgaatcacgtcacagtcgacggtgacggtgtactctccaagcgccttcatgttgacgacggtgcgcaggctacggccgatgaggcgctcaatctccatggagcgacccttgcggttggcgtgctcgcgcttgcagcgcttgccggtcgatgccggcagcatggcgtactccgccgttacccaaccggccttggcgcccttgcgccagcccggcacgccctcctcgatggtggcagcgcacagcacgcgcgtatcgccaaactcggccaggcacgaaccgtgggcgtgcttcatgacaccgcgagtaagcttgatggggcgcagctcatcggcggcgcggccgttggcgcgattgacctgcatatactccatagaaaaatcctttcggcaaaaggtgaaagtgagcctttggtcggtgaccttttatctatttcagttcgtcgatatcgatatgctcaatgctcttgagcggctggccaaagataaaactgcccgccaccgcaaactcggcaatgttatcggccgtcgttgcaaaacgatgctgcggctcggctgcgtcgcccgccagctgctcgcggcgcgtgagaatatcggtcaactcacgcgtggtctcctcggcggagctcaccacgcgcactccgggacccagcgcatggcgaataggccccacgagcagcggaaaatgcgtgcagccgagcaccacggtatcgatgccgtggtcgcgcagcggttcaaccgtggcaccgaccagcgcgcgtacggcaggcgtatcaaagatgtcctcgttctcgagccactgctcttgcagatgtgcgcccgaggcgagctcgtgctcaacgacctcgacaaagctcgaggcagggcagccgtatacgtcgacgccggcatccaggtcctgaatggcacgcgtgtaagcgcctgagcgaatggtgaggttggtggcgagcacgcccacccggcgcgtgcgggtgctgttgattgccgcgcgtgcgcccggtgcaatcacaccgatgacggggacgtcgagcacctgctgggccaaacgcaaggccgcagcggtcgccgtattgcaggcgatgaccatgatcttgacgtcgtgcttcgacagccaacggcccgcctgcagcgcaaacgagcgcacctcgtcctcggtgcgggtgccgtaggggcagcgcttggtgtcgccgaagtagtagacggactcgtgcggcaacgccgtcgcaatcgcgcgcgcaaccgtcagaccgcctagacccgagtcgaatacgccaatggggcgtgtgtcgccagccagattctcaatatcggacatgacctcaccagattctctctcgaaaagatatggctcagcgcgataggaccgcactacgaacgagccgcgacgagcagctctgccgttgccgcccagccgtcgacaatcttgccgcgcgtgacgtaggcgttatcgcaagcatccaggaactcgggcgcgccggcgctggtcaaaccgttctcgaccagacagaacgtgcccacgtggtcagccatgtagaagtcggactcggaatcgccgagcgccagcgtctcctcgcgctcgataccaaggtgctcgcagaaacgtgcgatagcgacgcccttgttgagaccggcgggattgatgttaaacgcgcggccatcctcgacgcgttcgagctcgagcgtcgtcggtttggacagatgggtcaggtgaccgttgcaggcccagaccaggccgcagccggcctcgtcaagaatggcctggacctcgtcgtcgggcacatcaccgcgcatgccgacggtgacctcgcggtacttgtagccagtcgacatgtcgttgtggtactcgatcttatgcggccagcgggcgagaatcttctcgcacacgccggtttgctcgatcacctgatgcggcgtgaggccgcaggcggggtcgtagggcatatcgccggtcaggtactcccaatcgttggccttgaggtcgtacatgaccagaccacccatctcgccgatgtaggagttgaggccgagcacgcgcgcatcctcgtggatcatggtacggttgcggcccgaggtgggaaccacctggatgccggcgcgggcaagtgccacgacagcctcgacgagcttggtcgaggggttgccgtcgttgtcgcgcagcacgcacgagccgggtgcgagcatcgtggcgtccaggtcggtaaagacgtacttaaccttggcaagacgctcgcgcatctcgcccgaaagctcagcgacggtcggcagggtattgtgggacatggtcactccattacgtagaaggggcttctggtcttaggcgtcgtacgccgcaagggtgcgcttgagaatcgaaccgtcgcgctcacaaggctcgggtccgttcttgcacagcatacgctcttcctcgcccttaccggtcacgatgaccacggcaggacggacggtttcgcgcacggcagtctcgatagcggcaacgcgatcagtcacgatttgccagttatcatttccctgcgcttgaacgttgcgcgcgatctcagcgcaaatatcctcgacatcctcggggccggggtcatcctcggtaatcacgattcggtcggcatacttgccagcggcgatacccattgtggtgcgccgatcgacacccttaccgcccgtagcgccaaatacaaccgccagctcacgctcgggatagttctcgcgcaagtcacgcaggagcgtctcgaggctcatgccgttatgtgcaaaatcgacgattcccaggattttgcccgatacggacggatagagctccatgcggccgggaacgaagacgccctcaaagccgtagacgataccctcttcggaaatgcccagggcctcggcgcaggcaatagcggcaagcgcattggagacattgaacttaaccggcgtgggaatcacaatgtcgcgcgtaaagcggggcgtgcgcaccgttgccaccacgccgcagtcgtcattacgaatcgccagcgcaagcacgtcggcacgctcgtcggtcagggagaacgtcaccgcacgttcgcaacgagatgccgcctcgagcacacgatcgaccttatccatatcgagattgaccacggcaaaacggctctgcgagaagattttgagcttgctggcaaagtaatcctcgagcgtcggatgctcaatcggcgagatgtgatcctcgccgatattggtaaaggcgccgacttcaaaggcgatcttgcccgtgcgctcgtatttgaggccctggctcgatgcctccataaccagccacggggcacccgcctccgcagcatgcgcaatgcgagactgcagcaggaaggattcgggggttgtcagtttggaagggcctgcctcgatgccgtcgtcgaactcaatgcccgtattaagagcgggccgatgacagcccgtaagcttggcctcgttggcgagaatgccgcgcagataaaagctgcaggtcgacttgcccttggtgcctgtaaaggcgcagaccttcaccttacccgacgggtgcccataaaaggcatctgccaccacggcgagcgtgcgacgaatatcactcacaatcaccgcgggaagatcaacatcgtaatcgacctcggaaacgtaggccacggcgccatcggcgattgccgaaagcaggtactcgcgcttaaacgcacggcccttgcagacgaacaacgtgcccggacgcacctggcgcgagtcatcagtcgcaaactcaatgcgctggtcgcacgaagcgctcggtctggaaacaacaaggtcatcttcctcgagcaactctatatagcgcatcagagttagcttctcttgtgtcggactcgacatacaaagacctctctcgctaaattcagccttaaagggcaaaagacgtcccgcggcagaaacgatgaaacattctgtattatcaaccatcctaatatgccacctgaccttgcgcgcactgcagccttctaaaaaattgcatggactgtgccgtggattaataaatgacaacagtgttcgccccgcgtaaaaacaaggaaatctgggtgctattctttatccaaatgtcttgatgtgcctcattgacccgcaatgccgacccatcatgccaaagcaaaggattccagatgaaacgacacttcgaacgtcgccaccactcgacacgtgtccagttgacccggcacatcgtctgcgccttcgcgacggtcattgtggcccttgccaccatcatcggcgcgagcggctgttcgtcctcccagaacgcctcgagcacctacacactcgtcgagaatggcaagctcaccgtcgcaagtgacttggccacgcccccgtttgaatacgtcaacgattccggcgaagaccagggctttacctatgaactcatgggcatgatcgcagacgaactcggtctggagctcaactacttgccggcgcaaaagttcgacggcattatccccatggtcaagcagggtgtaaagaccgatgtcggcgcatgtaacatcacgattaccgacgagcgcaaggaagaggtcgacttcaccgatccctatatcgactccaaccagggcgtcgcagttgcaaagaacactggatacgacacggtcgatagcctcaacgcaccgggcgtcaaaattgccgtgcagtcgggtaccacgtccgaggagtgggcaatcgaaaacctgccgcaggcaaccaccgtcaactttgacgactggacggcagccttcaccgccgtcatgagtggtcagtgccaggcggtcgtatgcgatctgcccgttgagcagtggatggtttcgaactcctttaccggtatggagatcatcaaagaggttccgacgggcgagcagtttggcattgccgtctctaaagacaaccccgagctgacacaggccatcaacgatgccctcgccaagatcaagagctccggcgcctatgacaaactgtacgagaagtggtttggcatggcacccacgagcgggtccgataacgaggatgcctcgagctcagacgacgcgacgggcacttcactcgccgtcacctcggcgaccgccaagtcaaacgaagacggcggcaacggcgtgctcggcggcatcgcaacccgcctgacctgggaagcgacaacgggtagcgacgagggcgacgtttcgcaaattgagcttgagttgcccgagggcgggtcatttgaaagcaccgatgttaaggtcacgctgctcgacgggctgaaccagacgggtgtcaaggcatcgtgctcgctggacggctcaaagctcgtcattaagttcgccgatcccgtcgccgccggctcacagattcgcgttgtcgtccccgacgtcgtattcccgagcaacgcgggtgcctatgccgtcaccggcagctatgtcgccgtcggcgacaagcgagatcttcccgagagccccaccatcagcgtctcggagagcaccatggtgcaagaaatcgtcgcctggctcgatgcccagccttgggttgccgcgtggaactccaacccgtttttgggcatgttctgcaagccgcagattatcgtcacctcaatcgtctcgctctttaagggctggggcatagcacttgccgtgaccgctatcggttttccgctcgccatccccatcggcttgctgtttgcctttatgaaaatcagtcatagtcgtatgctgcgcggcatcgccgtaacatacatcaacgtcctgcgcggaaccccgctcttcctgcagatctgcattgcgttctttgggttccctatgatcggtctcaacgtgcccaatctgccgctcggcgttggcgtcctagccatcaactgctcggcctatcttgccgagattttccgcgccggcatcgagagcgtaccgcatggtcaagcggaagctgcctactcgcttggcatgacttggtcccaagttatgtcgcgcatcgtgatcccgcaagccgtacgttacgttataccgactatgaccagcgagttcgttatgctgtacaaggacacgtcactgctttcgagcgttggcgtcatggagctcatgctgttctccaaaaacctcacggccaccacgggcaacattacgccctacatttgcgccgcactttactatctggtcgtgacgattccgctcatccacatcgtcaccaaggtggagcaccgtctcgccgagcgcagcaagcgttaaccgctcatacatagcattcgcaaccacggcccgacgcttcgtctgaagatcgggcgtggttttttcggttcgctcggcgcttatgccctatcacgaaacaaaagattggcatgatagtaaagattatttgacatcagctgccacaatccttgcggcagtacacctgagccgtcagcagaaaggatcttgcatgtgcggttttgtcggttttaccggtacagatgaacagagtgagctggttctcacggctatgatgaatcgcatcatccaccgtggtcccgatatgggcggccagcatatcgtcaacaacgttgcccttggcttccgtcgtctttcgattcttgatctttccgaagctggagctcagcccatgtcgagcgacgacggcaaggtcacgattgtcttcaacggagagatctacaatttccaggagcttcgcgccgagctggaggcagccggctacgccttccactgcaacgctgataccgaggtcctggtacacggttacgaggagtggggcgaggacctggtcaaccgcctgcgcggcatgtacgcgttcgtgattcacgaccagaacaagaacaaactctttggcgctcgtgacatctttggtatcaagccgttctattactaccaggcatccgatggctcgctgctgtttggctccgagatcaagagcttcctggaccatcccaagtttgagaaggccgtcaaccacgacgcgctgcgcccctacctgacgctgcaattccccgccacggaggagaccttctttaagggcgtgttcaagcttgctccggcgcattgctttacgtatgacctgacgaccaacaccatggacatcaagcgttactggagctgtgacttcaccgacgacaactccaagaccttcgaggagtacgtggacgagtgcgacaaggtcgtgcacgaaagcgtcgctgcacaccgaattgccgatgttaaggtgggctcgtttctttctggcggcgtggactccagctacattgccgcctgtcttatgcccgacaccacgtattctgtcggctttgattacaagaacttcaacgagaccaactacgctgctgagctttccgacaagctgggcatcaagaacgtgcgcaagatgattaccgccgacgagttcttcgatgcactgcccgatatccagtatcacatggacgagccgcaatcgaacctgtccagcgtgccgctgtactatctggcgcagatggcttccgaggaggtcaccgtcgtcctttcgggcgagggcgccgacgagctgtttgccggctacgagtggtacgaggacacccccgagatgcgctcctttaagaagcgcgtgccgctcggcgtacgtcgcgccctgggctcgctcgttcagcatctcccctactttaagggccacaacttcctgacgaaatgcgccgaggttcccgagcgctggtatgtgggtcaggcaaaggtgttcgatccctccgaggtcgacgaggtgctcaagcccgcttatgacaccggcaagaacgccgccgagatgtgcgccgagtactacaagcaggttcccaactgctgcgagctttccaagaaacagtatctggatatgaacatgtggctaccgggcgatatcctgctcaaggcagacaagatgtgcatggcgcattctctggagcttcgcgtcccgttcctggacaagaaggtcatggagtttgccgagcacattcctgccaactaccgtgttaacgaagaaggctgcaagctcgttctgcgtcacgctgccaaccgcacgctgcccgacgagtgggcaacgcgcaagaaggtgggcttccccgtaccggtcaagttctggctgcgcgagcaaaagtactacgactacgtaaaggaatacttcaccgcaccgtgggctgctgatttctttgacaccgatgcgctcatgaaactgcttgacgatcactttgagggccgcgcgctcaaccagcgcaagatctataccgcgctgacgttcctcatctggtacaagcgcttctttatcgacgaggacaagggcgccgaagtcgccgaagtcgccgcgtaagtttcgttatgaattagcggtgaacagcacggggtttccgctatactcaatccctgcgggcgattggcgcaacggttagcgcaggtgctttacacgcacaaggctgggggttcgaatccctcatcgcccaccactgaattggaaacggtcctcgaaagaggaccgtttttgtttgggcccatttcatgggattcgaacccgcaagggtgcggagctgaggaaacgcgtaagcgttttccagcgcagcacgcgaggagcgaagcgcgctgtgttaggccaaaacgtccgacaaaatctcgatcaggctgtccacgtcggcttcctcgcagataagcggcggcaggaaacgcagcgtatgagctccggtcgcgttaatcacggcgccagcggccagcgcgcgggcaacaatatcatgtgcatcgcccgcagcgtcatccaaatcgcagccgagcattaagccgcgaccgcgtacctcaaccacgtgcggaagcttggccagcgcctgctccatataagcacccaccttggcggcatgctcagcgtaatcgccgcgcacaagcgcggagagcgtcgcggcgcacgccgcgacggccaagcagctaccgccaaaggtcgagccgtggtcgcccggcttaaacacatcggcgatctccttctttgccaccacggcacccatgggcacgccatcggcaatccccttggcaaggctcataatgtcgggctccacgccataggtctggaatgcaaacggcttgccggagcggaagatgccacactggacctcgtcggcgataagaacggcgcccacctcgtgcgccaagtcgcgcgccgccgccataaactcctcagtcatggggtgcacaccgctctcgccctgaatcggctcgagcatgacggcgcagacctcgcttcccagctgcttaaagatcgagcgcagttcgtcgacatcgttgggcgtgcaggccacaaagccacccggcagcggacggaagctgtcctgtagccaatcctgcatggtggcggcaatggtctcgagcgtacgaccgtggaagccgccgcgcatgcatacgatggtgttgccgccgttaccggcacgcttggcgtacaggcgcgcgagcttcatcgagccctcgttggcttcggcgccggagttggcaaagaacgtctcccacacctgctcgtccgcagccggggcaccgagcgcagcggccgtggtctcatcgccggcggcaatggcatcggccagaacgcacgcaccatctacgtcgtcgttggcaagcttggacagcagcgccgcgacctgtccacgctgctcgatgtagaagtagttagacacgtgcagaagctttttggtctgagcctcgagcgccgaaagcactgcaggattaccgtggcctaggctacacacgccaataccagcgagaaagtcgagatactcacgaccatcgtcaccgatgagcttcatgccgtggccttcgacaaactctaccggagaacgaccaaaagtatgcataacgtaatgggattcgagcgattgttgagttgcaagtgacatgggatgcctttcgttgggcgccgtacggcgcagggctatgggtgcagggacgcgacgaccgcgggtcagctagaccgtctggagcttctcgacctcgtcgaggttctcggtcaggcgcgccgcaaacgtcgaaagcgggtgcggatgcgtatcgaactcgtaggccgtctcggtggagtggatcacagtaccgacgccggcatcggtcagcagctccaagagcagcgaatgcggcgtggtgccgttgatgatgtgtgcgcggaacacaccggcggtaagcgcatcgacggcggcgcgcagcttggggatcatgcccttgtcgacctcgccgccgtagagcatctcattgacctcgtcgagcgtcaggttggagataagcgaatccttgtcgctaaagtccttgtacagaccgtcgacatcggtcaaaaaaatcgccttatgcgcatgaagcgccgccgcaacggcaccggcggcggtatcggcgttgatgttgaagaagccaccgtcctcccccgccgcgaccgtggcgataacgggaatgtactcactgtcgagcaaacgctcgatatagtcggtgttgacgtgcgtgaccttgcctacgcgtccgagctctggatcgagtggctcggcgataagggtaccggcgtcgctgccggacacgcccacggccaggttgccgtggtggttgagcgccgcgaccagctcctggttgactttgccgcccagcacctcgcgcacgatatccatggtggcaggcgtagtcacgcgctggccgttcttaaactcgacggggatgtcgtagtggctgagagcctcgttgatggccttgccgccaccgtgcacgataacagggcgcatgccaataatcttgagcaggacgatgtcgctcatcacgtcacgacgcagttgctcgtcgaccatggcggcaccgccgtacttgataacgaccgtcttaccggtcaggttcttaatccacggcagcgcctcgaacagcaactgcgcggtaacttcgttggattcgctcgagcgacaatcgcgtgcgaacttcatagtctgcctcgtctttcgtgtagctatcgcgccgtacctcgttgcccgctattgcagcggggcgcgcggcacatcgggagtctaggaacggtagtcgccgttaatggagatgtactcgtgcgtgaggtcgcaagtccacacggtggtcgccgcgtccccggcgcccaggtctgccgagatcacaatctcgggcgcctcaaaacgtcgcagggcttcgtcctcatcgaaggggaccgtcaggccatcgcgacagacgggcatacccatcatgtcgatggacacatcttcttggttaaactgcacgccgcacttgccgagcgccatggcaacgcggccccagttgcagtcgtggccggcgatgcaggtcttgacgagcggcgagttggcgacagcacgggcggcgatatcggcctcctcgtcgtttacggcgccggttacgttaaccgtcacgagcttggatgcgccctcgccatctgcggcgatgttgcgcgccaggctctcgcacacttcatgcacggcaaaggccagctcgtcgaaggcgtcagagccctcgacaataggctcggcatctgcggcagcgccggaagcaagcatgatgcaggtgtcgttggtcgaggtgtcggagtcgaccgttaccttgttgaaggtctgcttgacggtggagagtaacagggcgtgaagcgccgccggctcgacgggggcatcggtagtgatgactgcgatcatggtggccatgttgggcatgatcatgcccgagcccttgcacataccgcccaccgtataggcattacctgcgtgccccgcggcctcgctgcggtaacacacagcatactccttggagtgcgtgtcggttgtcatgatggcgcgagcggcatcggcgccaccgtgggcagagagcgcctcgtaggcagcaggaatggcagtctcaaacgtgtcgatcggcagaatctggccaatcacacccgtggaggcaaccagaatctgctggggctcgcagccgatgacctgcgatgcgatgctgcacgtctcgcgcgcgcatgcaaggccggtctcacccgtggcggcgttggcattgccagagttgaccgaaacgccggcgatgattccgtagcccttgtcggcaccacccaggttggcacggctcacctgcacgggcgccgcgcaaaagcgattggtggtaaacacgccggcaccgggacagggtttatcgggcacgacgagcgcatagtccaagcgctcgggattcttccggaatcccgcatggatgcctgcggccttaaagccggccgctgccgtaacgccaccctcgacggcgcgaatcttgatatcaaacagctcggtattcatcgtctttatgactccttatgtcaaacaaaaaacggacatcggttggtgcgccatgccagtcgtgatcatgagaccagcttaagagtggcgccccactcgatgcccgactaccaaatcgttaacaatcgaatgtgctacaccgggcacgccactgtgggcaagcctcgtcgctcgtcaaaaccaaagacgatgttggcgcactggaccgcctggcctgctgcacccttgcacagattgtcgatggcgcccgtcgccaccagaacgcccgcgcgcttgttgagcgcgaggccaatctgggcggcgttggttccgacgaccgaagccgtcttgggctgctggccggcgtcgagcacgcgcacaaaggtgcgtccagcgtagaactgcttgtaatagtcgacgacatcctcaagagccagggagtcgatggcctgcggcgtgagcggcagcgtcaccgtggagagcaggccgcgcttgagcggtgccagatgcggggtgaagacgacgcgatcggtcaggccaaggatttgctcaatctcgggcgtgtggcgatgcttgcccacgccgtaggcctccaagttctcgtcggcgctgcaaaaatgcgtgcgagcgttgcaggacttgccggcacccgtcacaccgctgatggcatcaacgatcacggggccgctctgggcaacccagccagcgcgcacggcgggcgcggcggcaaggctcgttgcggtgggatagcaaccggcgcaggcgaccagcacggacttgccagcggcatggctggaagcagcggtctctaagtcctggcagaacagctcggggaggccgaaagcacgcgtcttgagcagctcggggctcgtatgcgcggcggcataccacgcctcgaacacggccggatcgctcagacggtagtcggcagacaaatcgaagcaggaaacgcctgcggcaaggagcgcgggcacctgtgccatggcagccgtgtgcggcacggcaagaaaaaccgcatcgcagctcttgagctcgggggcgtcgtgcgtggtaaaaaccagatcgctcacgccggcaaagctcggatagaccgaagacagcggccggccgacatcggcgttggacgtaatggcaacaagttcaaactcgggatgaccgagcacgaggcgaatgagctcggcgccggcatatccagccgcaccgacgattccaacctttaaagacatatcagactccttgcccgcacagttatgcaccaatacgtatctcgcagccgtcgttatgaagtgggttgaaactttatcaccaaaagatgcatatatacgcaaatcttttacatattcatgcattgaaacagtcccgacacattcactcgaaggaattgacaaatgaatacgggccccatattgctcagcgcaccttacggtgacgttgcaatgtggggcccgctacatgcgagaatttgaattgtcgaagcttgctgagagactcgtttagagctcgaccggcacccattcgtcatggttgcagataaaggcctcgggttcctccacgctaaagaagacgagcgtgggatcgcctgcgccctcgtagtgctcgcctaggcgctccaggtgcttccagcctgcctcgcgcatatcgggagcggcctggtcatcaagacccgcacgcccgcgcaagatgagccagccatggcccggccaccaactcgtggcctcaaagcgttgattttgcagcaactcttgccacacgtctttggtgcgcgccgttacaaaccacagcttgccgtcctggatctgcgcaaacgaaaacggacgcacatgcggctgtccgtcaacgctcgtcgccaaataccacgccggcaccgacgtcagatactccaaaaccgtattcaatccgtccacgtttcctcctgtcacctgaccagtctttttggaatgggaagtcaatttgggaaattagagctccagacgctcctcgctgccgtcgatatcacagaagcggacggcgatattgcgcaccgagaaaaacgcaaggcggccgtcgttggcgctctcgtgattctcgccgatgcccaccatgtgcttaaagccggcttggcgcacccggtcgctcacgaccgcgtcgtcctcgagcgcggcctcgccggtcagcacaatccaacactcccccggtttccaacccgaaacctcaaacttggggttcgcgctgagctcggcccacacgtccttatcgcgcgaggtgcaaaaccacagcttgccatcatcgaccatggcaaacgagaacggcctcacgcgcggctgatgtccgtccgtcacgtcgatcgtggcgagataccacgccggaatacgcctaagatacgaacaggcgcgctcgagctgcgccgtgcgatcgttgtcggtcatagggacccctttcctgcgctcgaatcgcgcctaaacaagttgaagattgatgacaatgacgcagatgagcagcaacgccgtcaccaccgccgccaacgcgtcgccgcggccaaatgcaagcgcatgcagacgtgtgcggccctgctcgccatgatagcaacgggcatccatggcggcagacagcgtttcggcatgacggaacacgcccgtgaacagcggaatcgccacactgccgagcatacgcacgccgccgagcgggcctcccgtcacgcgcgcaccgcggctcgcctgcgcatcggccgtctgcttcatctcggtggcaaactgcggcataaagcgcagcgcgatacccatgatcatgccgagctcgtgcgcaggaagtcccacacgcgcaaacggcgcgagcaggcgctcaaagcccgcggtgaggtcgagcgtcggtgtggtgagcgtgatagcgctcataccggccatcatcaaggtcaggcggcacgccataaaggcggcggaatgcagcgagccctcgcttatctgcaaaaagccgagctgccacagaatgcgcccgctctggtcggaaaacaggttgagcaccgcgaccaccgcgacaatcgccagcagcggcgccatcgatgacaggacgagacgagccggcacccgggacacggtatagatcaggacaacgaagattgcgaccgggaccagtccgcggaagctgctgaccgtgagcgtcgtgatcagaaacacaaagcccaagagcaacttggttcgcgggtccaggcggtggattgcactatcgccgggatagtagctgccaaacgaaaacgcctccattagcagccctcctctcgcgcgaccgtttcggatttggctttgtccgagacgtcagaagaaccgtccgagcgaccgataagcaggtccaccaactcgtctgccagcgactcaaccgtatagaggccgtcaaagcgcagcggcacgtctgccttcgcaagcgccagcgccatgcgctgggcagcgggaacacccaagccaatcgacttgagctcatccgcatgcgcaaaaacctgagcgggcgtaccctcggcaaacaccgtgccctcgttcatcacgacaatacggtcgcagcaattggcaaggtcatccatactgtgcgagaccatgacgacggtcaggcccccatggtgaagtcgatcgatgagctccaggaaatcactgcgcgccgccggatcgagccccgccatgggctcatcgagcaccaggacctcgggctccatggcgagcacgccggcaaacgccacgcgccgctgctgcccgcccgaaagctcaaaggggctcttgtcgcccaccgtggccagatcgaggcccacgcgcgcgagcgacgactcaacgcggcgggcaacctcggcctgcgacaagccaaggttatgcggaccaaacgccacgtcctgtgccacggtctcggcaaacagctgacgctctggatactgaaacaccacgccgacctttgccttaaccgcggcggcatctttcttatttaccaggtcgagccccaacgcgtaaacggaaccctcctggggacgaatcagaccgttgagatgctgaaccagcgtcgacttacccgaaccggtatggcccgcaaggcccaggaactcgccacgacgcaccgtcagcgatacatcacgcagtgcccacggactgctggggtcgttgccccagagagcctgtttgttcgatgcgccctcgacggctgagcgcttgtgccaacggcgacgctcgcgggcgctcagcgagtagctatacgaaaggtgcgaaacctcgatgacgggctccagcgcgtctgcgccatcgattgcagaggagacgttgtcgggaatacgaggatcggatgcgaaaggccgcccggcgatgcctgtcctactccgctcggcataagcctgcgctatatcggcgaccatatccgcctcgcgcaccttcgcgcaaatgggcatacccttctcacgaagtgccatgcccaaacggcacgactccggcatatccaagttgagctgtgcaagttcgtccgcctgcgtcaagatttcatcgggagtaccgagcatggcaacgcggcccgcttggaagacagcaacgcgatcggcctcagcggcctcttccataaagtgcgtaatcatcacgatggtcatgccgcgttcgtgcagcgcgtgacaggccttcataaggcccttgcgcccgcgcggatcgagcatcgaggacgcctcgtccaaaatgagcacgcgcggctccatagcgagcacgccggcaagcgccacgcgctgcttttgtccacccgagagcgcgtgggtctcgtggcgctcaaagcccgccaggcccacggccttcagcgcctcgcgcacgcgctgcgcgatcaggggcgattcgacccctaagttttcgggaccaaacgcaacgtcatcttcgacaagcgtcgccacaagctggtcgtcgggattctggaataccatgcccgcggtcgaacgaatgtcgtagaccagctcgggatcggacgcgtccaagccgttgacgcacaccgttcccgcatcgggctgcagcagcgcgttcaaatgcttggcaaacgtcgacttgcccgacccgttgccgccgaggatgcagaaaaactccccctcctcgatgttcagatcgatgccatcgagcgccagtgcagcaccgtcatagcaaaaggaaacgccccgacactcaatcatgcgcggcctttgacctggtcctttttaggcgtgatgaggttggagaccgccttatacaccgcaagcgtcaataccgagttaagcacggtcttgataaggttgaacggcagcacggcgggaatcatgagcggggcgatcacatcgaccgagccataccagaaccatacgccaatagtaaggtttgcgaccatagacagcaccgtggcggcaaagacgccgagcaccaggccaatcatggcacccttataggtatgcatcttctggtagacgatagccgcgggcagaatatagcccatcgtggcaaccaagttcataagcgcgccgacccagtcgcccgtggtaagcgcatggataacgatcgccatagcggcaacagcggtaccggcaccggggccatatgcaaacccacacaccatcgccggcaccagcgacgggtcgtaggtcaaaaacggcgccgaaggaaggatgggcagctgcacgtacataaacagggcacccaaggcgcacatcagcgccatggtaacgagctgtttggtgctccacctattcgtgttctcaaaatggatatgctgcgactgttcagacataagatcacctgcctctttcatccggactctaaccgttggtactgggatctcaccagttcagccggcatgcgaaccaacgcacacacgggtcgcggactcatcagctcggacgcagatatctcgcccgcgccacggcgtccctttgacaccgcccgatttaccgccagtggggaatttcaccccgccctgaaacagcaattgcaagtgtagcaccagcaggctttcgcgcaagtatgccaaaggtaatttatggctgggaccagttgccgcaacaaccacgttccccacccattccaaagtagcgcgcctttcgcgcaaagcgcgaaacagcgaaggggacacgtatccctatcaaccacgtccttctccgcccgccgacctcaaggccgtaaacgcagggaatccgggggcgtgacggggcttctctccggaacatttccgcactgatatcttctgtattgaagacgtcgatgatgcacccgtataccattgacgtcgacaccatcagatgcggaccgcgcggtgaccccacattccgctggcgcccacagggctgccctcgtttcctgacatgtcccgcgcgggccgcggcgagccgagaccgccgcatgacctaataggagcatggagcgataccgcggacccgaacagccgcattctatcgcgccccgtcagtgtgccgtctgcccggtccaggcgagcacggaaagaacggagcgagacatgcaaaacgaatcgacacccgacgcccgcgggccggtcttctgcggggtcgacacccacgccgactcgcactggctgtacgtcctggactggaggggccgcaaggtcctgttccgccagttccccgccgacgcggcgggctacgaggcgctcgccggggcgatcgccgcggccggggagccggcctgcggatttaaaccgggctcaaacgaacatgcctattgacaatggctttctcatattagaagaggggtcgacgccgttaaggcattgaccccttgaactaagtaacggcgctgcccagctatcacccttgggctgccgtcgactttattctacccacggttgccaggtttaacaaatgaattttcagtaatggagcctcggagcccgctcgctcaaccacctggccatcggattagccggattctgggacacgccttccgtcccaggcctctaccggaaaatgcgtcccaccctgaggctcgattccgggacacggtttccgtttgaagccccgatgggaaagcgtgtcccgttccgagagctcattccgggatgcagtttccgctagagatgccaccgggaaagcgtatcccgttttggagccgaattccgggtcgtagtttccgcctgagggccgatccggaaacggcatcccattctgaagccgaaatctggaacgcactttccgccaaaggtcgcaaaaggaaagcacatcccattcccggcatcaaatcaggacgcgcttcattatccccgccctcacatctcgtcaaacgagatcagcttgacgtctcccctactctccgcggcatcccgacatccctgcgtaaagccgctttttgagaaaagtgcatagctttttcgttgccgtctaaagagctcacttcggtgcacgagcttttgcagcacgtcttcgcccgccggttcattgcgccatttgcactccgcaaacagcgcagtgccctcgccatcgtcaacaatcaagtcgatttcttcctgcgtatgcgtgcgattatccgtcccccaccagcgcccgacactcgccggaaccacatcgagctggcccgcgcgcgcgagttcgtacacgtattgtctgcatataagctcaaagaccgtacccatgtaatccgatacgtgcggctcaatgcgcttatacgccatctcggccatatcgttttgaatcagcccgatgttctgcggaacaaacttgtaccagaacctaaacatctggtcgctcagcagatacacggctcgcttattgctcgtttcgtttaggggcagctcgcgctcgacaatcccaagtgacgccagcttatccacatagctctttacgttgctcgcagggattcccgtagagctcgcaatctccgagatcctcgagcgcccctgagcaattgcttgcacgatcgcatcatattgctcgggattgcggcactcttgcaatagcaggttactcggctcctcaaagagatagcccgtaggagtaagaaaaagacgtttgatgttgtccttgagcggtgcggcaggatcgactttctcgatatatgcaggaatgccgcccgtcatgccatagcaaactgcagcgtcttcgcgacccatgctctgccacaggccgagggtcgtcataaaatcgagcggcaagatcttaaactgggccgtacgcctaccgtatagtgggctctcgtagcccaacacctgttcctccataaacgaaagagacgagccgcacaggataagcatgagcttggtctctttgtacaagtgatcgatcttgtcttgcagcaacgagctgatctcgggattcgattgggcgagatagggatactcgtcaatcacaacaatcaaacgttccgtgcgagccatggtggccaacgcatcgaacgcctcgtcaaaactacgaaacgacacacctgcagcaccaaccgaacccgcaagtatcgcctggctaaagccgtgcaggtttgccactgcattggtacgacgagcttgaaagtaaatagccttcttgtcttggatgaattctgtgatgagacgcgttttgcccacacgacgacggccgtaaatcacaggcatctcaaaggagcccgtgccatacagtcgattgagctcggacatttccgccgttcttccgataaacatagggccatccttcctttgcgttatagctagctatattatactttcctataatatagctagctataacgcaattcgacaagcggcgcacgaaaaggggcggtacaccaccgctcatggaccgttctggaaaatgaatcccgctctgagcgctcattccggggtgcaatttccgccagagacgccgccgggatagcacatcccggtttggagccgaaatctgggatgtagtttccgcttgaagggcgatccggaaagcacgtcccattccgagcggcaattccgggtcacgggttcctcaggtacaagacgacgatccgccgcccttatcacaggccttcaaacatgcgatccagaaacgcaaaacagcagatagaatgctctttttcaaaaaagtacacgtcctgaaacttaccaagacttcatatctcgtcaccgttcaaggtcgccgattaccgcccaccgattcaaacaagaaatatgtcgtcaaaagcaggtcatctacctgcatggttagattttggtcagcttttggtcagctgagcggcaagttccagctgatacgtttttgctacccaaaaggaggcggtagctcatgacccattgcaatgaccagctcatcgaccaactgcccactcaagccgaacaagaggggcgctgtctgattcccccgagtacggcgatccgaaaagcgctccttcggcgcaccggcggcacggttgtctcgcccatgccggggttgtttgcgcgaaaaacgcgctgggatgaactcaaccgagcgcaacgccattgcgagattatccgcgcccttgcgatcatccatcccgattggacgttctgctcgttttcggcagcttgcctgctggggctcgaggtctcgtggcgacacctgaacgtcgtgcatgtttgcagctcgacaaagccgtcggctcgtccgggcgcacatattcagcgacaccagattgagccggccggagcaatacgcagggccggcatatcggtaacgccgcccatccaaacggccacagattgcctgctgcaaactggttttgccgatggcatgcccattgccgattcggcgatctcaaagctcggcgttgcgccggaacagctgatggaggccgttgagcaacgagtgaccgcccgcaatgatcgcgcgattcgcaccgccctcacaacgcttcgatatgccgacgcccgcgccgagagcggcggggaatcggtcgcccgagccgtcatgatcgagacgggctttgcgcccgactggcttcaatacgagctgacggaccccttcgattcggccaagcccatacgaacggactttgcctgggagcgtcaggcgcgggaactcacgctgggcgagctcgacgggctcatcaaatataccgaccagaccatgctggccggacgcaccaccgccgaggcgctcgttgccgaacgacagcgcgaggcgcacctatcgctctacggccaccctctgctgcgctttaccatgaacgaggtccgctcgacaggaatgctcgccaaaaagctgcagacggcaggcatccggcagaccgcgctgccgacatggctcaacgatattgagctgtaggagctgctgagcttatgcccgcctgcccaccaaactgggacacactttccggttggcagcacccgcggaaaccatgtcccaaattgagcgctcaaaacgggatgcactttccggatggcgggcctagcggaaagcacgacccgttccgagaccgaattccgggacgccgtttccgcttgaggcttcaaccggaaaatgcatcccacgctggagccatattccgggacacagtttccgcctgaggccgatccggaagttgcatcccattctgaggcatgattccgggacgcagtttccgcatgcggaggcgctccaaacaaaaggccccgactcacgatggagctggggccagaggcgcagcatatgcagttgatgttgagcgcgaacagcccgtcagcaagggtcgtccgcaccctaccctacccgcggttgcgagcgcggctgtagggcgtatccaccatgggcagatcgggacgcagcttgccgtcaaatgcgcgataggcgttctgtacggcgggtgccgtggggatcgttgcgatctcgccgatgcccttgccgccgtatgccacgggcagcagctcgtccttctccacgtagatggcatggatatccggaatctcgggcgcacggaacagcccgagcgtaccgtaccttgcctggggcacgcagtccttgagcggccagtcctcggtaagcgcatagcccatacccatgagcacaccgccttcgatctgaccctggatggagatggggttgaccaccttgccggaatcgtgcgcggcgtagacctcgctcacgcggccgtcatcatccagaatgaccacatgcgtggcaaagccgtagcagatatggctcttggggttgggaacatccgcacccagtttgtcggtcggctccaggtacacgtagccaaactcgcatccctcaagcgccttgatggcggccgcgggatcctgaggatgcataccctggccggcgacgagctcctgcgtgcgcagctggtaggcgcgaccgtcatcgtactcgatcttgacgccgtcgccatgcgcgctcacgggagcatcgggcgcgggcttgccggcctcgatgccaaccatggcatcgcgcagcaggaaggcggcgccgcgcacggcctcgccggtcacgaccgtctgacgcgaaccagacgtggtgccggagtcgggagcgttctcggtggagcactcgccgttggcgatgcagcgaagcggcaggccgcatgcctcggcaacgtcctgcaaaaagacggtgttacagccctggccaatgtcggacgtggcggcatagaccacggccgcgccgttctcgatgcgaatcttgcagcggccggcatcgggcaggcccacgcccacgccggcgttcttcatggcgcaggcgatgccggcgtgtccgggatgcgcatagtaggcatccttgacctcgagcagtgtctccttcagcgccgtggagcagtcggcaatctgaccgttgggcaaaacctcgcccggctcgatggcgttgcggtagcgaatctcccacggatccaggccgaccttctcggccagcaggtcgattaggctctcgagcgcaaactcggactggcaaacgccaaagccgcggtacgcgccggcgggcgggttgttggtgtagtagccataaccgcgaatatcggtgttctggtacttgtaggggccgacggcatgtgtgcaggcgcgctcgagcaccgggccacacagcgacgcgtaggcgccggtgtcaaagttgatctcgcagtccagaccggtaaagttgccctcggcgtcgcagcccagcgtaaaggtaccgtccatggcatggcgcttgggatggaaagcgagcgactcggcacgcgtgagcttgcacttcacaggacgctgaaacttatatgcggcgagcgcggccagatgctggatggacacgtcctccttaccgccaaagccgccgcccacgagcatggtctcgacgaccacgcgctcgggttcgttgtcccagccaaacatgtgggcacactctttgcgcgtgtcgtaggcgccctggtcggtcgactgcaccttgacgccgttcttgtacgggaaggcaacggcacactcgggctccaagaaggcatgctcggtaaagggcgtggtaaagcgctgcgtcacggtgaacgcgctttcggccagcgccttggcggcgtcgccgcgcgtcacgtggcggctctggcacacgttgtccttgagctccaccgtgttgccaaaggcaaagaagctgtcatgcaggcgcggagcgtcggcggccctggcctcgacaatgttgcgcacgggctccagcggctcgtagtcaatctttacgagcttcttggccttctcgagcgtcgcctcgtcctcggcgaccaccagcacgatggcatcgcccacgcagcgggtgatatcgccctgagcgatcatgacgtcccagtcctggataaggtggccgacctggttgaccggcacgtcctcggcgcgcaggatgcccaccacaccgggcagggcctcggccttggaggtgtcgatggagagcacgcgggcgcgcggatacttggagcgcacggcgctggcataggtcaggcccggctgatcgagctcgtcgatgtcgtcgggatacttgccctcgccgagcaccttcttgcgcacgtcaatacgaaaggcgcgcttgcccacgccgtagtcatcgccgcgctccaggtcctcgtcgatctgcttttcgccgcggagcaccgcagcggccagcgagatgccctcgataatctttttgtagccggtgcagcgacagacgttaccgcgaatggcgtacttgatctgctcctcggtgggctcggggtcctcggcgatgagcgccgcacccgccatgaccatgccgggaatgcaaaaaccgcactgcacggcgcccacggcgccaaaggcgtacacaaaggcctcgcgcacgtcctcgggcaggccctcgacggtcacgatgttgcggccggcggcaagagcggtggtcagcacgcacgccttgacggccgcaccgtccacatggatggtgcaggtgccgcaggcgccctcggagcagccgtccttggcggagtgaatgtgcaggtcgtcgcgcagatagcgcagcagtggtttattctccgtcgtcgtgtgctcgacaccgttaacggtaaaagtgaattcctgtgccatggtgattcccttctacacgccggcggcgatgccggtgcggtcgtggatggcgccatgcgggcagacgacggcgcacatgccgcacgacaggcagtccacgccgtcgatatgggcgcagttgtcctcgatgcggatagcgccggcagggcactttttggcgcacataccgcaaccgatgcagctcgtgtcgcaaatcttgcgcgcaatggcacccttatcggtgttgttgcagcgcaccagaatgttctggtagccggggacgaaggcaatcacgcgctgcgggcacgccatgccgcacaggccacagcccgtgcactttgagcgatccacgcgggcgatgccatcgaccagcgcaatggcaccgtgggggcaggccgtgacgcaggcgccacagccaatgcagccttcgctgcagcgggcgtcgccgcctgcggaggcgcaaccgcttccgcaggcaacgtaggccacgttatgttgaatggatttggccataagagactcgcctatttcttaaggagatacggatagttgtcgcgcacagccctgatggtcaggcggacggcctcgggaaggccggtgttgacggcatcgaccgagacggtgcggaccgtgccggcgacgcggaccttaaagtggtcctcgtccacagccaggaagccctcgttctcggagttctccatgtcctgctcgctccagaacagggtgagcttgtccttgtagggacggccctcctggtagggacagaacacggcgcagttgccgcactcgttgcacatgccatcgacgtggacgacctgatgcttggccaggcccggcaccttaattgccacgttggcacggttggggcacacatcgcagcagacctcgcacaccgagccgcagcccaggcagcgagtcttggtgcagttgcgcttgtcgcggcacagcgaccccttnnnnnnnnnnnnnnnnnnnnnnnnnnnnnnnnnnnnnnnnnnnnnnnnnnnccttgcgctcgtagcaagtgtcctcgcggccggcctgctcgttgcagtcggcgtacttgttaaagtccacgccggcgatggcgcgggcgacctcggcggcatcggcaatagcctcgaccacggtggcaggaccgcggcggcagtcgcccgcagcccaaacgccctcgacgccagtggaggtggcggcaaggcggccgcgacggtcgtgctcgacacccgcggcatcgtacaggctggcatcgatgccctcgcccacggcgcagatcaccgtggtggcggaaagctcgacggtctcgcccgtggcgacggggctgcgacggccgcttgcatccggctcgccaagctccatgacgtcgcaggtcagcacggcgccgttaagcgccttggggaccagcagctcgcagaactcaacaccgtcggcaagagcaagatcaagctcttcctcgtcggcgggcatctgcttcttggtgcggcgatacaccaggcgcacgttcttcacgccggccaggcgcttggccacgcgagccgcatccatggcggtgttgccggcgccaatgaccacgacgtcctcgcccagctcgagcttctcgcccctcttggcggcctcgaggaactccagcacatcgagctcggcgccctcgcccaagcccgcagagccgggcatccaggcaccggtggccacgaccacgtcggtaaagccctgggccttgagctcgtcgatggactccacgcgggcgttgagctgcaccttggcgccaaaggccagacagagctcggcatcgtgggagatatcgtcgctcgcaatgcggaactcgggaatgacgtgacgaaccacgccgccgagcgaatcgcgagcctcaaagatggtgacgggcacgccggcacgcgtcaggaagaacgccgtcgccagaccggccgggccgccgccgataacggcaacgttgcgctcgctgtcgttggcgatggcctgagcacgcagcttgggcagcacggcggtcatggcctcgcgggcggccttgagcttgctggcgcgaatctgggcgccctcgggctcgtagaatgcacgctcgcaggcacggccgcagggatgcgggcagatggtgccagtaatgaacggcagggcgttgcgctcgatgatgatgttgagtgcgtcctcgtagcggccctcgtcaacagccgccagataggcgggaatatcctgctggatggggcagctcgtgcggcacggcgtggtaaagcagtcggaaagcgggctcttgccggcgaccttgcggtcgggcagcgggcgcagcggcttcttgtagagcggattggtgagcgagtcggtctggatcgccgtcacggcctcgagagagacgcccgcgaacggcttgccgtccaggtcggtaaactcgccggccatctggctaaagcgctcgtagccaccgggcttgagcacgtcggtcgccagggtaacgggccaaatgccggcatcgtacagggcgcggatgttgtagaccgtggcaccgccggagtagctgatgcgcagcttgccatcaaactgctcggtaatgcgacgggcggcctcgatggtcagtgagaacagcgaacggcccgacatgtacatctcggtggaaggcagctcgttcctcgtcacgtcgacggggaaggtattggtgagcttgacgccaaactccaggccgcgctcggcgcacagggcaatcaggcgctcgaacataggcacggcatcggcccactgcaggtcctcgcggaagtgcgtgtcatcgaagacgatgtagtcaaagcccagctcgttgaggcgctggcgagcaaactcatagcccagcagcgtggggttgcacttgatgtaggtgttgaggcccttctcggtgatgaggtaggtcgcgatgcgctcgatctcggcgggcgggcagccgtgcagggtagactcggtgatggagttggagacgcgtgccgggatggactcgacgaacgcggcgtcgacatgctcaaacttgtccaggttggcgagcgcccatgcgcggcactcgttccagacgtcggagccgctggcgtccttcatgccctcgatgtaggcgtcgaccttggggctcttgatgccctccaggtcataacccacggacatgttgaagacaaagccgtccgggctgcccaggccgtactcgcgagcgatcaggtggcaggcaaaccatgccttcacgtactcggcaaaggcctgcggaacctcgagctcggtcgaccactcgcagttgtagcactcgtcctgtgccacgatgcagggcttgttcacacacttggagagctcctcgccgtccataacctgaacggtcttgagctcaaagaagcgggaaccggccacataagaggccacgatgttctgggcaagctgcgtgttgggtccggcggccgggccaaacggggtctcgatgcgctcgtcaaaaatgggaagcgcaccctcctggttggccgtgaccatcttgcgcacgccaaagacggcgccctgagtcttgtgctcctcgatgatccagttcatcagctgcgaaaacgggatcggcctcatgatgtcgctcatagtgagctcctctctgtaacgcccggcgagaccgcgcggcgggcgcaaatacggtgtagcgctagcacagcgccggcgaccccgcggaggtcgcctatacgcgcgtcgaatgcggcgaaacacccgacgcgcgtgaatctacttgtgaattagtaggtgcgatcgttgagcgtgctccagagcttcttggactcagccatggtccacgcgttgatcttgtcctcatcaatcccaacgaactcgcgatccttgtacaggacgcggccgttgatgatggtggtgcggcagtttttgcccatcatgccaaagagcatgtggccgtcgatgttctcctcgctcagcggcgtaaagggcttgtagtccataacgataacgtcggcggcagcgccggcctcgagcacaccaagcttgcgatcgaagtacttgctcgccatcttggcgttgttctcaaacagcatcgtcatggcctcgcaccagcccacgttggacatggcagcgttgtggcgctgaatgatcaggaagaccttaaggctctcgagcatatcgtgggtgtaggcgtcggtacccatgcacacggggatgccgcggcggaagaactcgagcacgggggcgcagcccacggcgttgcccatattggattcggggttgttgaccagccaggtgccggactccttgacgatatccatctcggcaggcgtcacgtggatgcagtggcccagcatggtgtcgggaccaagcaggttgtgctgcagcaggcgctcgacggggctgatgccaccgcggttgaggcgggagtcccacacgtcattcatgccctcgcacacatggatgtggaagccggtcaggccgttgttggcctcggccatcttgtccatggtctcgtccgacagcgtaaaggtggcatgcccgccaaacatggcagcgatcatgtggttgtcgttatcgcgacgctccttggcggcccactgggcaaattcggcgttctcggcaatggcctggtcgcatttttcctggccacggcgatcggaaacctcgtagcacaggcacgaacgcatgcccagctcctgagctgcatccttaatggtaaagaggcttcccgggatctcgcagaagctcgcatggtgatcgaagatcgtggtgacgccatcacggatggagtccaaaatcgtggcataggcgctggccttggtgccgtcgagcgtcaggttgtcgtcgatcttccaccactgctgctcaagattctccaggaagttggtggggttgcagcccttaatggcaaggccgcgggccagacccgagtagatgtgggtgtggcagttgatgagtccgggcatgatgaggttgccctgggcatcgacgtactcggcatccgggtacttggccttgagctcgcgctcggggcccacttcgacgatcgtatctccgtcaatggcgaccgcaccgtttggaataaacggggtctgagcgttgcgggtaaagacggaaccgttagcgaccagaagcatggatgctcccttcaacatcagaggcggggtttgacacctctgacatggcggagtgcgaagcgccggcctacaccggaaacgggccctctcccgtcaacgcttcaccaaagggacaaaccctttgaagtgcggcttggtgccgcatggcgtcggcggacgaggcgatgcgtccgccgacgaatagcaccgaattggttacttcttgctctcgggcaagaccagatccacggcagcgtccttggcagcatcgatgtgctgagccacgaccggcgtctgcggaaggatcaggttaaggacaatggccatgatggcggtgggggttacggcattggagccgatgacggtggacacccaggcgggcataccctcgccggcaaggcaaccgctggccatccagatacccaggccaaagacgacggaggtgccgacgatggtggtagtgcgctgcgtgaggccctcgcgggtgaacatgcgcacgccgttcatggtgatggtgccaaagacgccgacggtcgcgccgccgatgacgggctgcgggatagcggaaaggacggcagagagctgcgggaacagaccggcgatggcaaagacggccgcaatgatcacaaagacccacttgttgacgaccttgttggagcagatgatgcccacgttctggccaagggcgctggtgggaagaccgcccagcagaccgccgaccatagaggtgaggccctgggacacaatagcgccggagagctcgcgctcggtgggcatacggtcgatggagcccaggcaggcggcggaaacgtcaccgataacctggatggcgaccatggggaacacgacagcgagggtaatgcagacctcgggatcaaactcgagcgcgtagggcatgagcttgggaagggcgaagacctgggcggtagcgacgctggagaagtcgatcatgccaaaggggatggagacgatcatgccaacaatcatgccaaagaacacagatcccagcttgagcgtgcccttgccaaagttggcgagcgcaaagaccacggcgaaggtgataagagcaacgcaccaggcctgcggggtgccccacagcggcgtacccataccgccggccatgtacttgacggccgtgggatagagagagacgccaatggagaagatgaccgtaccggtcacgacgggcgggaacagccacttgatcttgctgtaggccagaccaaagaggaccgcgacggcgccgccgacgatctcgccgcccagcagcgcaccaaagctaaagcccgaggcacccatggcctggagggccgggaggaacgcgaacgaaacgcccatgacgatgggcaggccgccgccgatgcgacggaagggagcgaaggcctgaagggccgtgtcgattgccgaaagaatgagcgcgacctggatgatgtcggtgctctgctggctattaaagccgtagacgccggccatgatgaccgccggggtaatgatgccggcaaacgatgccagtacgtgctgaagggcacacgggatcatttccttaacgggaggcatgccttcgcgagtgaacagggcttcagtgccgttcgtaaccgtctcctgggtcatttgaccaccaatcctcgaagtagttgttttcgcatctaacgctctattgtgacgcagtgcggggttgaggttgtgccttcattgcatatcgtattaaagatgattctcattctcaataataattttttgttatcagactattcttcagctgaaataacgcatttccgcaggtcagaaaagtgtctggtaaaaatagcatctaacttttcttttggtcaaccgtttaccgctaaattcctaccgttcgtctgcattacgcaatgtacctgcggatatacgagatgatgggcagcgtgttaccatgagaaaaaattgttatgaacatttccgatttcacccaaaggagttgcccgtgaacgagaccgtacgtcgctttttgccgatggtcgattttctggagcagatactcggcaaaaacagcgaaatcgtgctgcacgatttctcggatcccgaccacgccatcgtcgatattcgcaacggcatcgtgagcggccgcaaggtaggcggtcccgccaccgatctggcactcaagatcatgcacgatcccaagtatcgcgacctgccgtttattacgggctacgaggggcgcggtgccggcggcaagacgctggagtcggcgacgtactttatccgcgagaatgacgagatcgtcggtatgctctgcgtcaacaccgacctctcgaccgtgcgctccatcaacgccatggcgcagcagctcatggcgtgcttcgacgcggcgccgacgcgcacggagcccgcccctatcgaggtcgaaagcctttcagagtccacacaggagctcatcgaccgcagtattgccgagctgctgagcgcgcgcgggctggatgtggcgtcgcttggccagagcgaccgcgtggacgtcattcgccacctcaacggcaacggggtgttcatgctcaagggcgccgtggcctgcgccgccaccgcgctgggcatctcggagcccagcgtctaccgctacctgcaaaaagttcgcaaggagggctaacgagcaacatggagcgcggctccacaagcgatccgtcacttgacaaaagaccctgcagctcgcactgcgctgcagggtctttttgcatgtcatgtttagttgtggccaacgccttagagagcggcgacgacctcgatctcgaccagaccgccagccggaagggcggcaacctggaaggcgctgcgcgcggggaacggggcctcgaacttggaggcgtagatctcgttcacggcggcgaagtcggcgatgtcggccaggtagaccgtggtcttgacgacatcggcaaaggtggcgccggcagcggtcagcagggcctcgacattggcgagggactgcttggcctgggcctcgacgccctcgggcatcttgccggtcgcggggtcgatgcccagctggccggacaggaacaccatgttgccggcctggataccgggggaatacgggccgatggcggccggtgcgttatcggaagacacgacggtcttgctcatgtttttctccttacaatcaaatagagagcgtgagcgcggcgttcgcaccgggaggcacaattcggtctgaacaccgcgcttgattgggatagtactcaaggtttccgtgcgatgcaagattattatcacgttgcgagaatattttatcgcccaacggtttccccgaaccgctgaacggttctccgcggggtcagccagtccaagctgctgaagactttgtcctgcttaggctgcgggcatcgcccaccgcagcgacgccactatacttttgagtatctgagcattttgaaaggcaggatatgaccgcaaccgccagtcgaaccaccaaccgcagacccgagcttttggcgcccgccggagggcccgagccctttgccgccgcactcgccgcgggggcagacgccatctactgcggcatgggcagcttcaacgcccgccgcaaggcaaccaactttaccgacgaggcctttgagcaagcctgccgcgccgcacatctagccgggtcgcgcgtctacgtcacggtcaacatcgtcatcaagcagtccgagatgggcgatgcgctgcaactcatccatcgctgctccacgctgggcgccgacgccttcatcatccaggactggggcctgttctttgaggtcaaacgcacgatgcccggcatcgagacgcacatctcgacccaggcgaacatccatgacgaccgcggaactatctggtgccgcgagcagggcgccgaccgcgtgaccctctcgcgcgagctctccatcgacgagatcgccgccatccacgacgccgcgcccgatgtcgacctcgaggtctttagccacggtgccatctgcttttgctactcgggtctgtgcctgctctcgagctttgccatggcgggccgctcggccaaccgcggcatgtgcgcccagccctgccgcctaccctacgagctaattgacgagaacggccgctcgctctcccctgccggtcgcgagcgcgcgctgtgcccgcgcgacaccaacacgtcgctgcttgttcgccgtctgtatgacgccggcgccgcatcgctcaagctcgagggccgcatgaaggcccccgattacgtgtattccatcgtcgacgtgtaccgtcatcagattgatgacatgctggccgatgtttcgacctccaaggatgaggatgcagcccgccagcgccagctcaagcgctgctttaatcgcgactttacgcacgcctaccaggatggcacctcgggcgacgagatgatgagctacgagcgctccaacaaccgcggccagattgtgggcacggtgctgggcagccgtctggccaaccgcgatgtacgcggactcaagcccgacgatcgccgtcgccgcgccgccatcgcccgcattgagctgcttgagcccgtgggcaagggcgacctgctggagcttcgccacgataacgagtttgaccagttcctgaccaccattgccgccgatgatgccgccgccggtgacatcattgagtgtcgcgtgccccgcagcatgcccgagggctgccgcgtgcgcgtgattcgaagccagcgcgccatcgacgccgccggcgccgcgctcaagcgcgatgtactgcgccgccgcgtcgttgatgtaaccgtcgtggcgcgtctgggcgagccgtttactgtcacactcacctgctgtgacaaccccgcgctcaccgccaccgccacgggcttcaccgtcgaggccgccaagacccgcgccgtcgaggcatccgatctgattgagcacgtcgggcgcatgggctcctctccctttgaggccgcgagctttgatgtggcgctcgatgagggctgcggtatgggcttttccgccgtgcacaaggtgcgcgccgccgcttgtaaggcactggaaaaggccattctggcaccgtacgaggagcgcgcgaaaacgctcgagctgccggcgattgtaaccagtgattcccgccccgcgcccgagcactaccgcgatgagccgcagatctgcgccaccgtcacctcgctcgaggccgccgaggccgctcgcgccgagggcgtaacgcgcatctacatgaccaccgacgcgctcgatgcggccgagctctcccccgccgatgtatttgagcagggcatcgtacccgtactcgacgaggtctgccgcgccgttgaccacgtacgcgtcgacccgtgggttgttgccggcgccacggtcgctattggcaacatctctgagcttgccctggccgcgcatgccggcgccacggccgagattcgctcttgcctgccggtgcacaacacgccctgcatggaggcgcttgccgggcgcggagccggtgcgttttggctctcgcccgagatcacgctcgacgagattgtctcgctcggcgccgccgcgcccgcggctctgggcatcaccgtctttggccgcccgcgcgtcatgacaagcgagcattgcattctgcaggttgccaacggctgcatccacgattgcgccaactgccgcctgcgtgcccgcaagctctcgctcaagaatatcgacggaaaggtcatgccggtgcgtaccgacatccacggccgctcgcgcctgtacgacgcctaccccatcgacctcacgcctcaggttcctcagctgctcgatgccggcgtgcgtcgtctcatggtggacggaacgctgctcgagacggatgagatcgcccgtgccgtcgctcgcgtccgtcgcgccgtcgaggcagctcaagccggccgcaagcccgccgcccgcctgcgcggggcgacttcgggctgcatgtttgtgggaatcagctaaccgaaaggcttacacgtgaacgaagaacctcaagtcctctactgcgacgcctggcttatggccatcgacaagcccgccggcatgatcgtccacggcgacggcaccggcgagcgcacgctcaccgactacgccagcgacctgctgctggcgatgggcgacggctttgccgcgaccgacatgcagccgctcaaccgcctggaccgcaacaccaccggcgtggtgctgttctcgctcgacaagcagacgcagcccgcctttgaccagatgattatcgaccacgctttcgaaaagcactacctagcgctcgccgagggcaagatcgactggaacgagaagctcatcgacaagcccatcgcccgcgaccgtcacgacagccgaaagatgcgcgtcggcgccagcggcaagccgtctcaaacgcgcgtgaaggtgctcaaacgtcttaagagccgtcgtggcctgcccacgcgctcgtatattgatgtcgagctgctcaccggccgcaagcatcagattcgcgtgcatctggccagcgagcatcaccccctggttggcgacgacctgtacggaacgccgcgcccctgcggcctgatgctccacgcccacagcgtgtcctttacgcatcccgtaaccggcgagcacatccacatcgaagccccctgcccctgggagccctaaaccaccacaatggggacaggcaccttcgtggtggttttgccccaatggctcagccgcggtcccaaaacgtctcgatctgtaacagttagaacccattttccggtctatctgttacagatcgagacattcgaatccccctcaagggaaaatctcaatctgtaacaataactcgtcaaaatcggtcccagatgttacagatcgagacaaagggacggcaaggttcggaagcatctcaatctgtaacacctagcccacttttaacggtctagttgttacagatttagacaaaacggcagacaacaaaagcggcatcgcccatcgagggtgttgccgcttttctattgaggaacctaaatggttttgaccttgccctgtcgctagaccgtgatgacgttatccatcgcccgatacttggcggggacctcacctgcggtaatgatcgttgcgtcgcggaagtccgcaaacttgacgggcgccaccatgccaaatttgctggcgtccgagattacgaagcgtttggcggtatggcgcatcgagatacgcttgacctgcgcttcctcgatatccggtgtggtgagaccttgctcggcggcgatgccattggaaccccaaaaaccgcagttgaagttatagcggtccagggttgccaaggcatcggggccaacgagtgcttcggtctcgggcttgagctcgccgcccagcaccacggtgcgcatgccgcgcagagcgaggtgctgagcatggagcacggaatcggtcacataggtgacgccctcaaggcgcggaagatgctcgatgagcctaagcgtcgtcgaacctgaatcgatgtacacaaagctctcgggctccacaagcgccgccgcacgggcgcagatgcgctccttgtcatcattatggagatcgctgcgctcattgagcgttaggtcgcgcgtcacgtgcgcgcgctccagacttgtcgcgcctccgtgcaccttggcgatacggtgcgcgcggtcgagcgtttgcaagtcacggcgaatggtggacggtgtcacgcccagggcttcggcaagttccggtacggtgaccgagccggtctgctgtatcatcgacacaatcgcgttgagcctatcttccgcaagcatcgcttactcctcctcggggtacacgactccccaatcggcgcggagcttggtcataagctccataacatcggaagcatagcccagaagctcgcgcttcgaatcatcgccggcaacggccttctccaggtcggccatctcgtagcacagagcgtatgcctcggtgccagcgtggacctcctcacggtgaccgtctgcagtccacacgatggttgcatggtcggcgcgcggataatcgttgacctcgatatagcacttatcgaaactgatgaccgagcgcttgggctgtttggagtggagcgtaaggctcacgacgcccagctgctgctcagcattacggcagacaatgccacccgcgacgtcaacgccagtctcgcaggtattgcccagagacacgacctcggctggctggctggccataaacaggcgcatgacggacagggcatacacgccaatgtcgagcatggcgccgccggcaaggctacggttgtagaagcggttggtcaggtcgccgtactccttatagctgccaaagttgagctgagcgagattcatgcggccgaactcgccagcatccatgcgacggcgcagctcctgatacagcggcatgtgaagcaccgtggtggcgtccataaggaccacgttatgctcgtcggcgatggcacgggcctcgtcgagctcggcggagttgagggtaatggccttttcgcagagcacgtgcttgccggcggccagcgcggcacgcagataggtgatatgcgtgttgtgcggcgtggtgatatagacggcatcgatgtctggatcggcgtagaggtcctcaatcgtctcgtacaccttctcgacgccatactgctcggcaaaagcctgggccttggacagcgtacggttggcgacacccgcgagcttgcggccggccagagcgagggactgggccatttggttggcgataacgccgcacccgatcacggcccagcggagctcgggggccgtaaagatatcatcggggaacggctgatcctggaccgaggcaaacaccgcctttgcggctgcctcggcgtcgagcggagcctgtttggaatctgccatatgtgcctcctgaatcatcggaagttcttcatttccaacagccctatattcgcacaaatgcgcgcgcatttgctcgtatttgcgtgtttatttgcttgtcggtcattatttagccatagttagcagatatttgcgcggccatgcgaatcatcgcgcaagactctgcgcgtaaatgcgcatgcgacaatccttgtgaaacatataggggcggagcaccaaagccctaaagacagagccagctgtattacttcacccctctggggacaccagacatcgaaggactgtccctaggtgccgctttcgttgaagcctatcctagatggccagatatacagatctaaagaccgtccctatcaactagtcatttaagtctgtccccaatgactgccaatcaaggccactcatttaagtctgtccccaatgagtggggatagaaaaaggcccggatgccgtggggcatccgggcctttgctagcaacttgatgttgcgggcagcttagaacttgtggccgcacttcttgcagacgcgcagcttgttcttgccgtccttctcgtgaccgacgcgggtaaccttaccgcactcggggcagacgagattgacgttggaggcgtcgatgggagcctcctgcgaaacgatgccgccctgctggttggcagcgttgggcttgacggccttcttgacgaccgaaacgccctcgacaacgaccttgttctcggcggggagagcacgcaggacaacgccctgcttgccgcgatccttaccagagagaacctggaccttatcgcccttcttgatatacatatatctcccctaactacagggtctcgggagcgagcgagacgatcttcatgtacttcttgtcacgaagctcgcgagcgacgggcccgaagatacgggtgccgacgggcgaaccatcgttgttgatgacaacgcaggcgttctcatcaaagcgaatgtaggagccatccttgcggcggatctccttaacggtgcgaacgacgacgcaacggacaacgtccttcttcttgacattggcgccaggggtagcctcctggacagcaccgatgaacacatcgccgatgcctgcataacgacgcttggaaccgccaagcaccttgatgcagcgaatcttgcgagcgccggagttgtcggcgacgttcagcatggtttgcatctgaatcatggtagatgttcctccgaactaagaaccgaagagaggtgcgcagcctttagacggcctgtggtatgcaaaccaggcatacgcacatcttcggaaacgtacaagtcgtaagagcgactgcttatttagcgcgctcgacgacctcgatgaggcgccaacgcttcatcttggacataggacgggtctccataacgcggacggtatcgcccacgccagccgtgcactcctcgtcgtgagcgtgcagcttcttggagctggtcatcatcttgccgtacttggggtgacgcttgcgctcggtgatggtgacgacaatggtcttggcaccggagacggaggtaacgacacccgtacggaccttacgcgagttacgcgaatcagtcatgttctctccttaggtcctactcggcgacagcggacttctccgctgcgatctcgcgggcgcgctgctccgtgaggacgcgagcaatgtccttcttcacggtgttgacgcgagcggtgttgtccagctggctggtggccatctggaaacgaaggttaaagagctcggcgcgcatttccttcagcttctcaacgagctgagcgtccgagagctcacgaatctctgcgggcttcattagttctcctccttggcggcggcggcgtcctcagcagcccacttggcctcgagagcggcctcctcagccatctccttctcgatgcgctgctcagcgttcttagcagcaacaatcttggtcttgatgggaagcttgtgctgtgcaagacgcagagcctcgcgagcgacctcctcgggcacgcccttgacctcgaacatgatgcggccgggcttgacgacggccacccactcctcggggttacccttaccagaacccatgcgagtctcggcaggcttcttggtgatgggcttatcggggaagatcgtgatgtagacacgaccgccacgcttcatgtagcgggtcatggcaatacgagcggcctcgatctgacggttggtgatccaatgggcctcgagagcctggataccaaactcgccgaaatgcagctcggtattacccttggcctggcccttcatggagccacgctgcaccttgcggtgaagaatacgcttaggggcaagcactactgacccctcctctcggagttacgacgacgaggacgggaagagccctcgagtgcagggttgggaacaggctggcccgggagcttctcgcctaggtagatccagaccttcacgccgcaagcgcccatagtggtgctggcgacagccgtgccgtagtcgatcttggcacggagggtgtgcagaggcacgcgaccctcgcggtaccactcacgacggcccatctcggcaccgccgagacgaccggagcactggatacggatgcccttagcgccggccttgcgggcagactggacagccttgcgcatagcgcgacggaaggcaacgcggccctcgagctgctcggcgatagactgagcaacgaggttggcgtcgagctcggggcgcttgacctcgacaacgtcgacggagagctggcccttggagacgccagcgaccttctcgagctcggtacggagagtatcgatctcggcacccttcttaccgatgacaacgccggggcgagcggtgaggatgatgaccttcaccttgtcgccagcgcgctcgatctcgacgcgggagacagctgcgcgggaaagacgcttctcgaggtacttgcgaatctcgagatcgttaccgagggtcttagcgtaatccttctctgcgaaccagcgggagcgccagttctcggtaatgccaagacggaagccggtggggtagactttctgacccatacagctttacgcctcctttcgaggagcaacgacgacggtgatgtgggaagtacgcttcagaatgcgagaagcggaacccttggcgcggggacggatgcgcttaagcgtcggaccctcgtcaacataggcagcggcgacaaccaggttgtcggcacgcagaccgttgttgttctcggcgttcgcaacggcggaacggagaaccttctcgacatccacggcgacggcgcggtcgcagaagtggaggatgtcgaaggcctgagcgacaggcttgcggcggatcagatcgaccaccaggcgggccttgctgggggaaacacgcacgtacttagcgacggcgcgaacctcggtggcctcagtttcaatagacttagttgccatttacggttaaccccctatttggccttgtggccacggaacgtacgagtcggcgcgaactcgccgagcttgtgaccaaccatggactcggtaacatacacgggcacatgcttgcggccgtcgtggacggcgatggtgtgaccaaccatctcggggaagatggtggacgcgcgggaccaggtcttcacgacgtccttcttgccagcctcgttcatcgcggtgatacgcgagagaaggcgagtctccacgaacgggccctttttgagacttctgctcataagtgctttctcctaaaactcggtatccgaaattacttcttacggcgacgaatgatgtgctggttcgagaccttcttcttcttgcgcgtacgaaggcccttcgtcggcttaccccagggggtaacggagggacgaccagaggtgtggttcttgccctcgccaccgccgtgcgggtggtcgacagggttcatgacggtaccgcggacggtcgggcgcacgttcatgtgacgcttacggccggccttgccgatgacgatgttggagtgatcggcgttgccgacctcaccgacggtggcgcggcaggtaacgaggatgcggcgcatctcggaggaaggcatacggacgatagcgtacttgccctccttacccatcagctggcaggagttaccggcggaacgggcgatagcagcgcccttgcccggctggaactcgacggcgtggatgagcgtaccgacggggatgtcggcgaggggcagagcgttgcccggcttgatgtcggcgtcagaaccggacatgatggtctgaccgacctcgaggcccttgggggccaggatgtagcgcttctcaccgtcagcgtagtgcagcagagcgatgcgagcggaacggttcggatcgtactcgatcgtggcaaccttggcgggcacgccgtccttgttgcgcttgaagtcgatcacgcggtaacgacgcttcacgccgccgccctggtggcgggtggtgatgcggccgttgttgttacgaccggccttcttgggcaggggctcgagaagagacttctcgggcttggtgcaggtgatctcggagaaatcggagatcgtctgccaacgcctaccagcggaggtcggcttaaggtgctttacagccattacaatccctttcaataggaatccgttagccatcgcagacagggattcgaggttctgcctcgggtgcgatgacaccggacgtatacacggttccgggcgtgtccattttatacgcccaaaaccttgagctctcgcctcccctatttgggaggcatgagctcactcaacagcagcgagtcttaggcctggttgccaaagacctcgatggtgtcgccctcggccagcgtgacgatggccttcttccaagaacgggtcttgccggcgacatagcgcacgcgcttggtcttgggcttgaccgtcagggtgttcacgcgaacgaccttgacgccgaagatctcctcgacagcgtccttgatctgatacttgttagcatccttggcgacctcgaacgtgtacttgttcagctccatgccggagaaggaacgctcggacacgatcggacggatgatgatctcgtgggcggtcatttatgcaagcacctccccgaagtgagcggcgatgtcggcgggcatcagcacagcgttgttattgacgagatcgtaggtgttggcctcgtcggcagtgatgatgaacgtcttgggaatgttgcggaacgacaggtaggcgttgacgtcctcatcgcgaacgatgatggtcagacgcttgccctcaaggccgagagccttgagcatggcgacggcagccttggtggaaggcttctcgaagccgtagtcgtcgacgagcacgagctcgccatcggccagcttggcggacagcgcggagcgcatagccagcttgacctccttgttgttcatacgcttagcgtaagaacggggcttgggggcgaagacaacgccaccgtgacgccactgggcagcacggatggaaccctggcgggcacggccggtgcccttctgacgccaaggcttcttgccgccaccggaaacctcagagcggcccttagcggactgggtgccctgacgccaagaggccatctggcacttgacgatgtggtgcataacgtggatgttcggctcgatgccgtacacctcagcggcgagctcggcctcggcgaccttcttgccctcgctgttctttacttcaaactttgccatttaagtgttctccttggtatgacgctgggctaaatgggctgggcccttaggccatacggatggcgacgagaccattcttggcacccgggacagcgcccttgaccaagatgaggttctgctcggcatcgatgcggacaacggaaaggttcttgacggtaacgcgctcgttacccatgtgaccggccatcttgacgcccttgaggacgcgcgcaggataggcgcactgaccgatagaaccggggtgacgctggaagtgagaaccatgcgtcataggaccgcggcgctgaccccagcgcttgatgcgaccctggaagcccttacccttggaggtaccgatgacgtcgaccttctcgacatcagcgaaatcagcgacggtgacgacctcgccgaccttgtgctcctcgccgttctcgacgcggacctcacgaaggaaacggacaggctcgacgccagccttggcgaagtgaccagccatgggcttgttcacgttcttggccttgatgtcgccgaaaccgatctggacggcgtcatagccgtcggttgcctgagttttaacctgcgagacagcgcaggggccagcctggatgaccgtgacgggaacgacgttgtcgtcctcgtcccaaacctgggtcatgccaatcttgcggccgagaatcatgctgatcaagatatgatcccaactctcgcgtggtcttgggacaatgcgtacaccaccgagcgtacgcccctagaggaccactacttacacgacgtgctccccagccttgtattgcgtccggactacctgacaaccctattaagcaggcattttgtccagccagaatactcccctggttacacacagttgtttagtatacacggctgcgggcgtatccatcgagattcatatttcactcacattgtttacgcaggtaaagtgcgtggagtcgcctgggcttggcagaggggcggcgaaatatattaagtttgctgctctacagtcctgcgcaagacggaaagcacattaagtgctttcctttgcgtgcggaactcgcgacaaacttaatatatttcgccgcccctctgccaagctcgggagacgacacgttgatgtctgcttaactctgctcgctcagctaatttctttgttgggggtccactatttgctggagagtgaacttgcattgcattggctcgccctctgcttgtagtttttcctcgtcaaaatcgaagatcatgatggcgcagttggggagttttgttgggagctcgaagccctctggggctgcagccttgatgaattggcggctggcgctgccgtggcttactgctaggagggtttcgatgccctcggctcccatgagattggtgagggtgcctaccatgcgttcttgcagcgcgcggttcccttctcctccaaaggggaccaaatcctcacccggatcccagacgtcggtaggcaatgcgtcgtgggggccttcttcgaaggtgccgtagcagcgctcaatgatgccttcgcagggctcgactgctgcgtccgggccaaggagttcggttgcgacgagccgagctgtgtccatggctcggcctaagggtgaagagaccactttgtcgggaacgacgttgtgagatttgatccatgtagctgccatcccggcttgctgacggcctaagtcggtgagcggtgagtcgcagcggccctggaccagctttttgacgttgaattccgtctggccgtggcggagtagatatagacgcttcatgctctccccttctgtataacttgctttgccggcacagccctactcgtgggtatgtcctacgtagtcttcgtcgatcgtaatcttggcaatcgacttggggtattccgattcgaccctctgggccaacgcgtgcttcaggtcctcggcgtccatgcccatatccgagggacgcacgcagtcaaagatcacgttggtgtgcgtaggacccggcacacagcgcagatcgtgaatcgaaaggcggctatcgatctgttgggccatggcgttaatgcgtaaacgcatgctcgccacctttggatcgtcggtcacgatgggatcgtaatggagcgtgacgatcatgccgtcctcgtccctaaacgcctgctcgatgttatcgagcgtgtcgtgactttccagcgggctggcctcggccgccatctcggcatgtgcgcttgcaaacttcctgcccggaccgtaatcgtgaaccatcaaatcgtgaacgcccaaaacgccggggtagctcatgatcttgtctcgaatgtgcttgaccaacttaggatcgggcgtctggcccaaaagcgggctcaccgtatcctggatgagttcaaaaccgctccagccaatataggcgccaacggcaaggccgacccatgcgtcaagattgatgtgcgtcatctgcgaaacaattgcgcacgctagcacggcgcccgtggcaagaacatcgttcttggaatcttgcgcggtcgcatgcagcgtctcggactcaatgcgatcgccgagcttttggttgagggccgccatccagagctttacgaccatcgaaagcgctagaactgccaccagggcaagcgagaactcgacaggttcggggtggatgacgcgctcaaccgaggacttcaccagctcaacgccaatcagcagcacgagcgccgccacgaccaatcccgagagatactcatagcgaccgtggccgtaaggatgctcggggtcggccggcttgctcgccagcttaaagcccagcacgctcacgatattcgaactagcatcggacaggttgttcatggcatccgccacgatcgaaaccgatcccgacagcacaccaattgcgcccttcgcagcacaaagcgccacattggcgacaatacacaccatgcccgctaacgtgcccacacgcgcacgatcgccctgcgcgcgcttaactatccactcgaccatctgcatccgcccccacggtactacctatatatctattgctcaaacggattgtagtgtagccactttgtcctcaagatacaaaaaggccgcagcccacacgggccacggccttggaatgtgacaaaggaatcgtccttttgtcgcacaggtttatgcgcttacctcagcagcgctcgccactgtttcggacgaatcggctccgtcccccgtcgtctgccccttcgtcggcaccacaccaaagcagtagctcagcgccgcagacatcgcgaatgctacaccaccggcagcgcagcaccacagcaggttcgagatgccgcccgtggcaaagccaatgaccatgaggacattcgtcatgccgatggtataggccgtaacgtggcccacggccgcaacaaggcctccgacggcgccgccaatggccatgcacgtcaggcacctgccatatttaaagccgcaaccgtacagcgccggctcgcttacgccaccaagcacacccgagatcgaatagcccagcatgagcgccttctcgtccttatccgcaacgcgaagcgacgcgccaaagggcatgccccaaacggcgaacgttgccatcgtcgcggcgatcaggatgcacgaatccgttcccacactcataaactgcgcataggcgagcgataggacgacgttgctgacgcccgcgatctttaggaactcccagcctgcggcaagccccatgagcgtgagcagcgacacaatgccaccggaattgccaagcataaacataagctggcccaacagcatgcccagatagctgcccgccggcgccgtaatgcacagcgaaaccggaaccatgacaagcaaggtcgcaaacggaacaaacgaaaacgccacggccttagggataacgcgcttaaagaaacactccactcgccatagcacgggcaccgagatgagaaccggaataacagtcgtcgtgtaatcgttgaccggcgcaggaagcagaccatacacggaagtcatcgatgccccccgtcgtcgatgcggcatcgacaagcttgagtaaatcgggtgcaatcaatacgccgcccagcatcatgcccagctgctccgagcaaccgagctggcgggcggccgcccaaccaagataaatgggcaaaaagtagtagccggcgttatagagccaactgtagaacaggcgatagatatcggaatcggcagaccacaggcccagcatgccttcgcccataatgacagcgacggtgcggaacaacgccgcgcagacaataaacggcagcgccgacatcatgcttttggacagatagtccaccacggccatggcgtttgatgaaaccgacgttgtaaacgaggtgttagaaacttgtagcatggaacgcctttcccaatatgacatgcgggctgtccctttgtcacatcgtgcggtatcgaccgattgcgcggtacttttcgtagcggaggtttgtgagggtcgcgtcgtcgagctgcccaagcgtatcgaaggcatcaaatgccgaggacatgacggcaccggcgatctcctcatgcgacaggcccttatcgtcaacaatgccgtcgatgatgccgagcgccagcagatcgggggccgtgagcttaagcgcctcggcggcctcatccgcacgctcggtatccttccacaggatcgacgcacaggcctcggggctcacgaccgaataggccgagctcgagagcatcaggatgcggtcggccacggacagcgccagcgcgccaccagagccgccctcgcctgtcaccaccgagacaatcggcgtcttaaggccgctcatctccatgagattctgggcgatggcctcgccctgaccgcgttcctcggcaccgatgccgcaaaacgcgcccgaagtatcgaccaggcacagaaccggtcgaccaaacttttcggcctggcgcatcaggcgacgcgctttgcggtagccctcgggatgtgccataccaaagttgcgacgcatgcgctctttggtcgtggtgccgcgctcgatggcgatgaccgttacggggcgtccgtctttccagccaatgccagccaccacagcagcgtcgtcgccaaagtagcggtcgccgtgcagctccacaaatccatccaggcccagcgagatcatctcgcctgccgtggcgcgatctgccgagcgggtctgcttgacaatctcgagcgcggtttttggtgcggccgagcgcttgaacaagtgtcccagctttttgccgcggcgacccgtatgcacgatctcatgcggtgcccccaggccgggcgcgtgcccttcgtgcagcgccagcagctcgcctaccgtgagcgcaatctcgccacgcggaacaacggcatcgcaaaagccgtgctccagcaaaaactcggagcgctggaatcccttgggcaggcgcttgtgcatgttctgctcgatcacgcgcgggccggcaaatgccgtcagggcatcgggctcggccaggataatatcgccctccatggcaaagctcgcggttacgcctccggtcgtggggtcggtgagcaccgtgatatacaggccgcccgcctcgctgtggcgcctaaccgccgcagaaatcttggccatctgcataagcgatgtcacgccctcttgcatgcgcgcaccgcccgaaacggtaaagccgacaactggcaatccaagctcggtcgctcgctcaaatgtgcgacagatcttctcgcccaccacggaacccatcgagcccatcataaagttggcgtccataaagaagagcgcggtatcgcaaccgcagattttgcccctgccgcacacaacggcatcgtgctcgcccgaacgctcgctcacgctcttgagcttgtcggcatagccgggaaacgagaggaagtcctccggcgccagactggcatcccattcctcaaacgtgccctcgtcaatcgtcatgcgcatgcggtcgcgcccgctcacgcgaaagtgtttgccgcaacgagggcagacctcgaggttgtcgtgcaggcgcgcctcatcgatcacgcggcggcactccgggcacttgataaacacgtggcgcgcgggaaactcggcgcacgactcggtcatcggtccctcgaggacgttgaccgtcttcgcttttctattcatcagcatagagatgccccatcagatcggtgtgatacatgcccgacaagaactcgtcgtttgccagcacgtcgagctgaagctcgctgttttcgctcacgccctcaatcacgagctcgcccagggccgagcgcatcttgcgaatggcgccgtcacgcgtgggcgcacacacgatgagcttgccaagcatggagtcgtagtacggcggaactttagcaccggtaaacatggcggaatcccagcgcacgcgcggaccacccggcacacgcaacgcggtgaccgttccgcatgacggcagaaaatccggcgtttcggcattgatgcggcactccatggcgtggttgcggaccggcatgtcctcctgctcaaagggcagaggctggccggctgccacgcgcagctgccacttgaccaagtcggtatcggtcacaaactccgtaaccggatgctccacctgcaagcgcgtgttcatttccataaagtagaaattgccgtcgtccgaatacaggaactcgatggtaccggctccttcgtagccgacggcacgagccaggtcacgcgctgccttgtgcatgcgagcacgaatgtcgtcgtgtccgtcgaggcacggcgcggggctctcctcgattagcttttggttgcgccgctgcaccgagcactcgcgctcgccgagcgaaaacacatggccctgcttatcggccataatctgtacctcaacgtgatgcgccggcgcgacgaacttctccatgtagcactcgccgtcgccaaaaacggcctcgccctcggcgcgtgcttcaataaaggcctttgccgcatcttccacgcgctcgaccttacgaataccgcgaccgccgccgcccgcacgcgccttaataagcacggggcagccaatgcgctcagcctcggccgttgcctcctcgggacttttgagcaaatcgcagcccggcacgatgggcacgcccgccgcggcagccgttcgacgtgcggcgtccttgtcgcccatgctgtcgatcaccttggccgaaggaccaacaaacgccaggccatacttgtcgcagtcgcgcacgaagctcgccttctcggagaaaaagccatagccaggatgaattgccttagctcccgactttacggcacaggtgagcacagcatcgtcgttgaggtagctctcggcaagacgcggaccgccgatgcaatacgcctcgtcggcaagctgcacgtgcagcgcgtccgcatcggccgtggaataaacggcgacggtcttgatgcccatatcgcggcacgcgcggataacacggaccgcgacttcgccgcggttggcgatgagcactttgtcgaacatgaagccttccttaactttcgtgcatgagtgcaaaagacatatcggcgcggcagcaaacctcaccgttgacgctcgcagtacccgtcgcaaagcggaacggcccgcgcgcacgcgtgatggtgcacaccagatcaaccgtgtcgcccgggcgcaccggacgcttaaagcgcaccttgtccagactcgtgtagaacggcgtcgcgccgcgcgcttcctcatcgcccatcagcagcacgcaacagttttgggcgagcatctcgcactgaatcacgccggggaccaccgggtttcccggaaaatgcccctgcaaaaagtactcgtcgcccgtaatcgtgatcttgccgtgggcctcgtcgcccaccagctcggcctcgtcgagcaaaagcatcggttcgcgatgcggcaacagttccttaagctcttctttgttcatggatatcacctatccgatcctcataaggcaactgccaaactccacgaggtcgccgtcggccacgcagatctcgagcacctcgccgtctgcctctgccgttacctcgttgagaaccttcatggcctcgatgatgcagagcgtctcgccggccttgaccttagagcccacgtgcacaaacggctcgtcgcccggcgccggggcagcatagaaaacgccgaccatgggagcggtcacctcggtgcccttgggctccggtgcggcggcaggtgtctgcgcggcgggctccggtgcggcaggcgcgactgtgggagctgcaactggagcggccatagcgctcggcatgggcatgggcacggcaaccggctgtgcggcgctcgcgcgctcgagttcgaccgcggtgccatcgggctcctcaacgcgtacgcgcgtgaggccgcggtcctccataacatcggctatctcggcaagtcttttggaatccatgctctagctcctcgtatatctacgcagcgcgatggcggcgttgtgtccgccaaagcccaggttggtcgaaagcgcccaggtaaggtcagcgcgaaccgcgcgattgggcgtgtagtcaagatcgcaggcgggatcgggcgtgtggtagttaatggtcggcggcaccacgccctgctcgagcgccatggcgcaggccatgacctcgatggcgcccgtggcaccgatcatgtggccggtcatcgacttagtcgacgagacgtgcgcggcgcgcgccgcgtcctcgccgagcgcacgcttaatgcccgtcgtctcggacgaatcgttgagcttggtcgatgtgccgtgggcattgatgtagagaccctcggaaggcttgacgtcgccctcggtcaccgccagcgatatcgcgcgggcaatgccggcagcctcgggatcaggactcgtgatgtgataggcatcatcggtgttgccgtagcccacgacctcggcataaatgtgcgcaccgcgcgcctgcgcatgttccatgctctcgagtaccagcacgcaggcgccctcgcccatcacaaagccgtcgcggtctgcatcgaacggacggcaggccgtcgcgggatcggggttggtggtcaatgcgcggcaggacgtaaagcccgcaacggcatcggggataattgcagcctcggcgccgcccgcgaggatcgcgtcggcatagccgtgcttgatggcgcggaacgcctcgcccaccgcatgggccgaggttgcgcacgcggtcaccacgggcagggtcgggccctttgccttgtggcggattgcgatattgcccgatgccatgttggggatcatcatcgcgatcatatagggcgatgcgcggcggggcccacgttcggcaatcgtatggacgttgtcgacgagcgtcgtcatgccgcccacgcccgagcccacgtagacgcccaggcgctcgcgatcgatggcgccttcgacatcaaagcccgcatcgtgcatggcttcgtccgaagccgccatcgcaaactgaacgcaggggtcgagatgcttggcgtcacgcttgccaaagtactcgttgctgtcaaagcccttgacctcggctgccaccttgacggcaaacgcatcggtatcgaagtgcgtgatcgggccgatgccgcacgtgccagcacacattgccgcccaggtggcaagcgcggtgttgccgagcggcgacacggcaccgataccggtgattgcaactctctgttccatcatggtctcctcatccaagccgttcttcggccctggtttctacatcgccattccgccgtcgacgcgcacgacctcacccgtaatgtaggcagccgcatcgctcgccaaaaagcgcaccacgccggccacctcctcgggacgcgccatacgcttaaggggaatctgctcctcggttaccgtacgcaccttctccgagagctttgccgtcatatccgtctcgacaaacccgggggcaaccgcgttcactcgtacgccgcggggcgcaagctcgcgcgccaccgccttggtcaggccgatcacgcccgccttggaggcagcgtagttggcttgcccagcattgcccatcaggcccacgaccgagctcatgttgacgacgcagccgccgcgctggcgcataaaggtcttggtgagcgcgcgcgtcgtgttaaacgttcctttaagattgacatcgagcacgcgatcgaaggcgtcatcgcccatgcgcatgagcaggccatcgcgggtgatgccagcgttgttgacgagcgcccaaatggagccaaagtcgttgaggaccgcttccacgcacgcgttgacggcagcggggtcggccacgtcgcattgatatgagcgcgccgtggcgccagccgcctcgcaggcgtcgcacgtctcgcgcgccgcatcgacgctgccggcatagacgacggcgatatcgtagccatcctccgccagaccgatagcgcaggcgcggccgataccccgcgagccgcccgtgaccagtgccacgcgacgtgagtcgttgcgctcgagcgcgccgttgttcaagttgcccatgtcattcctttcgggttacagccctgtggaccatgcgagctcgtcggcaatagctgcgacctgctcggccgtctcgcacgaatacacacgaacgtcgctcaacgtacgcttgatcaggccggacagcgttttgccggggccgacctcaataaatgtgtcgatgccttgatcctgcagagcatgcagcgtatcgacccagcgcacggcatggctcacctgattggccaagacatccgatgccgtctgggggtccgccggatagggcgccgctgtcatatttgccaaaacaggaatgagcaacggggacggcgcgtgaccggcctcaatatatgctgcaaggccacaggtcgcctcggccatataggggctatgaaatgcacccgacaccgcgaccttcatggcgcggccgccagcctcttttactaggacgtcgagggtctgcagcgcatcgggcgctccggccacaaccgtctgctggggactgttgtagttgaccggccagcagtcctcgccggcctgcgcagctaggttctcgacttgcgcagcatcaagtttgatgacggcgcgcatgccgccggggtgacgctcggccgccgtggccatcaatgccgcgcgctcacacacgagctcaaaacccgctcgcgtatcgaatgcccccgcaaaggtgagtgcagcgacctcgcccagcgagaatcccgcacaggcggcaggcaccacgccgcgctcgcgcagggcgacggcgacagccaagtcgtgcacgaacacgcaaggctgcgtgttctcggtctgcgagagctcctccttggaggcgctccggcactgctcgctcgtccccgggcgcacctcatcggcaatggcgaacacctcggcggccgccggcgatgtctcgatcaagtcgacgcccatcgcggggtgctgggcaccctggccggcaaacaaaaacgctacgccacccatgcgcacgcacccttcaggacgtgctcggcgccggcgaccaggtcgtcaacgatttcgcgtgcgctctggcgctcgttgaccatgccggcaatctgtccacacaaaaacgaaccctcttcgtagttgccgtccttggcggccttacgcagcgcaccggttcccatagcaccgagctcctcggcactcgcgccgaaaccctcgctcttggcataggcgttggtgaaggggctcttgagggcgcgcactggatgtcccgtcgagcgaccggtcgcacgcgttgaagtgtcgttggccttcaggaccatctctttgtactgctccgagacggtgcactcgtctgcgaccagaaagcgcgtacccacttgcacgccttcggcgcccagcataaaggcggccgccacgccgcggccgtcggcaataccgccggcggccacgacgggaatgtcaaccgcatcgacgacctgcggcaccagtgccatcgtcgaggtctcgccaatatggccgcccgattcggtaccctcggcaacaaccgccgtggctccacgacgtgccacgaggcgcgccagcgccaccgaggcaacgaccgggatgaccttgatgcccgcctcgttccacgccttcatgtacttggcgggattgccggcgcccgtcacgacgaccggcactcgctcgtcaatcacgacctgcgcgacctcgtcggcaaacgggctcatgagcatgacgttgacgccaaagggcttatccgtcttggcgcgcagctcatgaatctggtcgcgaagccagttggcgtcggcgttcatggccgcgatgatgcctaagccacccgcctcggacactgcggacgccagcgaggcatcggcaatccaggccataccgccctggaacacgggcttttcgatgccgagcagatcgcagagaggagtcttgagcatctctacttctccaatgccgcctcgaccgtatcggcgaactcgccgaccgtcttggggttctcctcggtatcgagctggatgccaaactcgtcctcgacggcaacgaggatctcgacggtgcccaggctgtcgagaccaatctcctcgagcgtggactcgggcttcatctcgacatcgtcaagaccggcggtctcgcggataacgtcgcaaacgcgctcgaaggtcttctgatctgccatggtagttctcctttggttgtgccctagggcgtttttatttcctatgtgcgactacttccaacgaagcagatagccacctatatccagaccggcgccaaatccaaccaaggcgatggtgtcgcctgtgtgaagtgcaccggcgtttgccagccggtcgagggcaagcggaatgcatgcgctcgaaatgttgccggtctcgcgcaacgtgcgaaccacgcgctcgtccggcacgcccaggcgcttgaccgcctggctcaggattcgttcgttagcctgatggaatacaaaatgatcgatgtcttcgaccaaaatgcccgcatcgatcgcaagcttatggaccgtgtcgcagatggcgttgacgccgaacttgaacacgcggcggccattcatggacagcacgctcgcgctatctgcggaagccttaaacggcgaggtaccgaccagaccgggaacgcgcaacgtctcgacgtcgggcgccgtcgaaagctcaacggcaaggggactgtctcccccagcctcaatcactgcggcgcctgccccatcgccaaagagcacgcaggtggcacggtcggtccagtcgagcgcgcgcgtcatctgctcggcagcaacgacaagcacgcgctcggcgcgaccgcgggcgatatagccctcggcgacatcgagcgcaaatacgaagccggcacaagccgccgagacatcgaaggcagggcacgtcgcgcctagtcgctcagcaacggcacacgcctcagcgggaacaaggtggtcacccgtcgtcgtcgagcagacgatcagatccagctggctcgcgtcgattccggacacctggagtgcccgctcactcgccgctacggcaaggtcgtcaagtgactcggtggtgcagacgtggcggctcttgatacccgtgcgggtaaaaatccactcatccgaggtatcgaggaactcagacagctcgtcattggaaacactgcgttcaggaagcgccgagcctgttccaagaatcgtgaaacccatcactaacctcctttgagttgttgacgtgtttacatcgaccaagagaggataacgcatttcagtctttgttgacgtgttaacattaaattgtccaaatgcgacaaaggcttcacattgtgtctatctctcgacaccattgcgtcattcacttattcaataaggaggtagcagccgctatggatgcccaattaacgattgtcgacgtaaccggatcgaccaacgatgacctgctcgaggcaggaaaacagggtgcgccgcacggcacaggacttgccgcccgcgcgcaaacggcaggacgcggccggcgcggccacaagtgggattcaaccgccggcaacctattgctttcgattgtcctgcgtccatgcgttaatcccgcaaagtactctggtcttgccgccgtcagcggcctagcggtgctcgaagcactcgaaaagcaaggccttgcaagcgaaatagccctcaaatggcccaacgacctggtcgcgcgaggacgcaagctcggcggcattctggtcgaggccgcacgcgataacgaaggcaaacctttcgccgtctgcggcattggtgtcaacgtaaactacacgccccaagaggtgcccgatggcggcctggcggcaattggcctctcggacctcaacgagagcgttcccgccgtcgacatgctcctcgatgaggtctatcacgcagttatagacgctgtagatacctgggcagagcgcctcaacgccatggaagaaaacgccggtccgctcgcgcccgtccacgacgaatatatcgctcacctcaattggatcgggaagcacgttatcgcccgctcccccgctggagacgagctggcacgaggcatatttagaacggtcgacgattgcggccgcgcatgcattgagaccgagagcggcttgtgcgtcttccacttcgaagaagcatccttgcgccccctgagcgaatagggcgccgcagccgccggctcggcagacgaattcgctatcccaaaatctaaactcaaaacaaaagggccccgctaccgtaacggcagcggggccctttaagctatgagcgatatcgcttagagcttgatgtcgatgtcgacgccagcggggaggtcgagacgcatgagcgaatcaacggtgcccgaggtggggtcgaggatgtcgatgaggcgcttgtgggtgcgcatctcgaactgctcacgggagtccttgttcacgtgcggcgagcggataaccgtgtacaggttgcgctcggtgggcagggggacaggaccggaaacgcgagcgccggtcttctgagcggtctcgacgatgagcttcgcggactgatcgacgacctcgtgatcatagcccttgaggcgaatgcggatcttctgggtagccaacttaaacctccaaagagtgcgagagatgttctcgcaggattacgtaacagggagctcgaacttaggcgttcttgctcatgacctcgtccacgatggacttgggcgcaggctcataagagtcgaactgcatcgtgtaggatgcacggccctgggtctgggagcgaaggtcggtagcgtaaccgaacatctcgcccagcggcaccttggcacggatgagcttgctgttcttgcgatcctccataccctcgatcttgccgcggcgaccggagaggttgcccataacgtcgcccatgtactgctcgggggtctcgacctcgacagccatgatcggctcgagcagctgcggatcggacttcttgagggcgtccttgatagccatggaaccggcgatcttgaaggcggcctcggaggagtcgacctcgtggtaagaaccgtcgaacagggtgaccttgacgtcgaggaccgggaagccggcgataacaccggtgttcagggcctcctggatgcccttgtcgatggacgggatgtactccttgggcacgacgccgccgacgatagcgttgacgaactcgtagccgaagccctcctccatcttctcgagcttgatgacggcgtggccgtactgaccgcgaccgccggactggcggacgaacttgccctcagccttctcgacgtcgtgaccagcggtctcgcggtaggcaacctggggcttaccaacgttagcgtcaaccttgaactcgcggagcagacggtcgacgatgatctcgaggtgcagctcgcccatgccggcgatgatggtctggccggtctcgtggttggtggacacctggaaggtcgggtcctcctcggcgagcttggtcagagccagggacatcttgtcctgctcggccttggtcttgggctcgatggcaacgtcgataacgggcttagcgaactcgatcttctcgaggacgatctccttgccctcggcgcacagggtgtcaccggtggtggagttcttgaagccgacgcaagcgacgatgtcgccggcggcagcgtcgtcacggtcgatacgctcggcggcgttcatctcgaggatgcggccgagacgctcgcgctgaccgttggaagcgttgaccacgtaggagccggactcagcgcggccggagtaaacgcggacataggtgagcttaccgacgaacgggtcggtcatgatcttaaagaccaggccggagaagggctcgtcgaaggaaggatgacgctggatctcctcgccggtgtccggatcggtaccggtgacggcctcgacgtcgagcgggctgggcaggtagtcgacgacagcgtcgagcagctcctgaacgcccttgttcttgtaggcggagcccacgaagacgaggttgagctcgttggccagaacacccttgcgcagagcagccttgagctcctcgacggtgaagtcctcctccatgaggatcttctccatgagctcgtcgtcaaagctggcagcagcgtcgaggagctcctcgcgcttggtggcagcgatgtcggcaaactcagccgggatctcgtccatcggctcggggtaggtcatacccttctcgtcggccttgaagtcccatgcagtcatggtgaccaggtcgatgacgccccagaagttgtcctcggcgcccatcgggacctgagcggccacggcgttggcgtcgagacgatccttcatggtctcgatagcgttgaagaagtcagcgcccacgcggtcatacttgttgatgaaggcgatgcgggggacgttgaaggtagaagcctgacgccaaacggtctcagactggggctgaacgccggcaacagcgtcgaagacggcgacagcgccatcgaggacgcgcaggcagcgctcgacctcggcggtgaagtcaacgtggcccggggtgtcgatgatctggatgcggtagtccttaccgtccttgttccagaagcaggtggtagcagcggaggtaatggttacgccgcgctcctgctcctgaaccatccagtccatggtggcagcgccctcatggacctcaccgatcttgtgggtcttaccggtgtagtaaagaatacgctcggtcgtggtggtcttaccggcatcgatgtgagccatgatgccgatgttacgggtatcggaaagcttgtacttaggcttagccatgttagttccttaccttaacttaccaacgatagtgagagaacgcgcggttggcctcggccatcttgaagacgtcctcacgcttcttgacggaagcgcccaggccgttggaggcgtcgaggatctcgttggcgagacgctcggccatggtcttctccttgcgagcgcgggagaagttgacgatccagcggatgcccagagcggtggaacgacgggagttgacctccatcgggacctgataggtagcgccaccgacacgcttgggcttaacctcgagcgtgggcttgacgttgtccatagccttcttgaaggtagcgagagcgtcgccaccctcggacttctcggcaacgatctcgaaagcggtgtaaacgatgcgctcagcggtggccttcttgccgtcaagaaggaccttgttgatgagctgagtcaccaggcggttgttgtaaacggcgtcaggctgaacctcacgacgattagctgctgcacgacgcggcatgtgaaatctccttaagtgtctaccgtgcggcccttaggcggcacacggcgaaagtatcaaaacgttatctggcttatttagccttggggcgcttagcaccgtacttggaacgggcctgcatacggttctggaccggagcagcgtcgtaggcgccacggatgacgtgataacggacaccagggaggtcacggacacgaccgccgcggacgagcacgatggagtgctcctgcaggttgtggccctcacccgggatgtaagcagtaacttcgatgccgttgacaaggcgaacacgggcaaccttacgaagagccgagttcggcttcttagggctcgtggtgaagacgcgggtgcacacgccgcgcttctgggagttgtgctgcagagcagcgttcttggacttcttgggcacggaacgacggccctggcgaaccagctggttaatagtaggcaaagcgtactccttctcgaatgattccagctttctgtaaagtgcaacggcttgaatcgaggggtcagcatccccctacgaaacacgcagttcgataggatacgtggcgttagctgtgccgtcaacagaccacgccgccgggcgtatcccaaaatgagcatatttccgcaaagcctacacaaaaggaatccccttctgtgcgcgggggcggattcccggtccgggcggcccgctgtttaagtttgctgctctacagtcctgcgcaagacggaaagcacattaagtgctttcctttgcgtgcggaactcgcgacaaacttaaacagcgggccgcccggaccgggaatccgatgtgctcgtcggggcaacgttacctgccaaaaagggacaggtttattttgatcggttttatctggggaaacgtcgcgctccagcggtaatctgctctcatctgtcgcatggaaatcggcggcgtttccatttaacgcaaaagaggccgcttcccctagtaggaagcggcctcagaccttacgaatagacgatagtaaaggactcttccgtttcggtctctcctgttgacgtgtacctcgtgccctcaagcgttactgagaccacttggtcgacatcgatcaacttcgttggcagccagatgttctctccgctattgcgcgcataagaaaaatataagttgaacacccctgcgtcgtcatcttcgataatctgctccgatccatccttgtagctgacggtcagcttattatcaactgcatcaatgcccagatcatcgatgtgtgtctggatagaaaacgggctgatctcgagaggcgagtcatcggagcggagttcctttgtatcgacgtaagctccaacgctaaactcgggcgtcgatgcctcgaacggcttcgcatcctcgccttcgccctcggtccacgagatattccaggtgaccgcatgttgaaaacctcgctcgcgatccatagaggcaaagtacatcgtgccattaatgaccgtggcgcttgatgtgtccttatcaatggtgcagcgtgtgtcagcccattcctcgccgaagttcatgctgggcgtgccgatgccttgttcttcttcaccatagagaacaagttcgcctgtctctgctgccggcttgtagtagttaacgccatttggattggacaacgtaaacgtcacggctccgcagccgttttggtcaatagccatctcatggatatcgagcgtatagccattaccctcgacggacagatcaaccttctggactgtgccctccaggctttggggcgcgatgccgtcaccgaactctctggtgtaggtatattgagtccccgatgagccgccgttggtccaggtaatggaatccccgttgccgtggtttccccaggctgaggcaaaatagctggaattgataactgcgtaggcgacccctccggtcgccaacactccgacaagacacccgattacggcaacatagagaggcttcgcatggccctttcgatgaagcggctcacccgcagcagtattaagaacgcgatctgcaagattgctatcggcttggatggactcgaaggcctgcttgatttgattggatttcacggtcgccctcctctaggatgaacttgagcttcgacctgccgcgagccaaacgcgttcgaacggtcgcggctggtacatgcaacaactcggcaatctctgaggtcgaaaagcccagatagtaatagagcacgatgggaacgcggaatcgctccggaagtcgcataacgtctgacaggaccgccttggtctcatcctgcgccgccgaaagcgaatcggccaggttctcaatatcctccacacgcctccatggctttcgaaagagcgatttacattcattgatcgtgacccggataagccagcggcgaagatgttcccaactttcaaagtgtccatcgcttttaagcaacttaagaaagacatcctgggcaatatcgtcggcatcggcacgatcgcgcaggtacgtcaatgcgattcgaaacacgacatcacggtgatcctcgaccgcctgtctaaatgcttgttcttccataatcacctcccggtgacgttaataattcttggtgaggccctcaccttagatacgctcttgtcgggcgaaatgtttcaaattcaagcaggaaaaacctaccaaaatatacctgtccctttttggcaggttttctttaacaaaaagacccgcttccctgttgggaaacgggtctttggaaggacggttaacgtactaggaaattactcctcgtcgttgtcctttgcctcttcggcgtcgtcggtgtccacgagctggttgagcagctcgtcgagggacgccatgtcctcgttgatcgcgccgttggcgggagccttcttgtcgtcgatcggggcgcccaggagctcctcgtcggcgtcggcgtgatgcgtcggcgtggcggaggtgcccagcaggatgtcgtccggaccgtcggggctaaagaccatctgcagcagctgcgagaggtcttcctcgtcggcaacgtcgtcgttgttctcgaggatgtagagcaggtcgtgggcctcgaggccgtcacggagctcctcgatcgccttggcaccgatgccatcgatgcgcagcagatcctcctcggacttgccgaccaggtcgccgaccgtctcgatgccgacctcgctgaacttgttggtccagcgctgcgacacgcccaggtcgtcgaacaggtacaggcgagccttctcggcggagatggtgtggccgttgcgggtgaacgaaccgtcagcaccaccgaactcgtcgtagccggcccagtcgagctgctgcgggagctgctcgtccaggtccttgagctccacaggagcccactcgggcagcgacttggcgttgggcgaagccgggccgtcgatgtccacgtagccgtcggccgtgcgatacgtcagcttggcgttggcgtacggcttgaggccggtaccagccgggatcttcttaccgacgatgacgttggacttaaggtcgagcaggtggtcgaccttgccctcaatagcagcctcggtaaggacgccggcggtacggatgaacgaagcgctcgacagccaggagtcgatgttggacgcgaccttgagcgtacccaggatgacgggctcggccacaggagcctgaccacccagacgggcaacgcgctcgacctcgtcggcgaactcgtagcggtcgacgtactgaccaagcaggtacttggagtcgccggggttagtgatctgaacgcgacgcagcatctgacgtgcgagcacctcgatgtgcttgtcgttcaggtcgacgccctggctggtgtagacgtcctttacgctctcgacgaaggtgtgcatcgtcgactcgatgtcggtcagcttgcgcaggttgcggaagttgacgaagcccttggtgatctggtcgccggcgcgaacctcgcagccgtcctcgatctcaggcatgaagcgcaccgaagcggggacgcgacgctcgtcgaggacacgggtgtgatcctcggagtcggtgagcgtcagcacgtactcggacttctcgggcttaatcgagaggtgaccggagtacggagccagctcggcctcgcggcccaggatcttctcgttgacgttgccgacgatatcgaacatacggctgaccgtaggcagaccctgcgtaatatcgtcgacgccagcgacgccgccggagtgaatggtacgcatcgtaagctgcgtaccgggctcgccgatggactgggcggcaataatgccgacggcagtaccgatagcgaccggacgacgggtggaaagatcccagccgtagcacttctggcacacgccgtacttggagcggcaggtgagcagcgcgcgaagcttgaccttcttaaggcccgcatcgaccatcttctggatgtcggcgaccttctcgatgtagccgtcctgctcaaagagcacggtgccatcgggggccacgacgtcctcaatgaagcaacggccgacgaggtcggtgttgaggtcggtgttgaggtcggtggtgccggggatgatgaggttgtaggtgacgccctcgtgcgtaccgcagtcctcctcgcggacaatgacgtcctgggccacatcgaccagacgacgggtcagataaccagagtccgaggtgtgggatgcggtatcgaccaggcccttacgggcgccgtaggtcgaaatgaagtactcgagcggcagcagaccctcgcggaagttcgccttaatgggaaggtcgatcgtctcgccggacatgtctgccatcaggccacgcatgccgccgagctgacgcagctgggtcttagaaccacgggcgccggagtcggccatcatgtacagcgggttctcctcgtcgaacatgtcgagcatgagcgctgcgaccttatcggtacaagcggtccactcgttaacgacttcgatgtggcgctccgtctcgttgatgaagccctcctcgaagtactcgttgatctggtcgacgttggcctgggcgcgatcgagcagctcctgcttctcggcagggatgagagcgtcccacaccgagatggtgaggccggcgcgggtagcgtagtggaagccggagtacttgatggcgtcgaggatcgggccgaccttggcctcggggtaacgatcgcagcagtccgcaaccagtttggccacgtcgcccttgaccatcttgtagttcatgaactcatagtcttcgggcaggcactggcggttgaagatgatgcggccgatagaggtctcgaagcgcgcggtcttgttgccggtaacgtcgtagtcgacaaactcgttcttgccgttcttgacgcggaagatacgggtgccgtcctcgttgatgacgttggcatcggcagcggacacgcggacctggatcttggcctgcatgtcgacctcggagcggcagtcataggcgtgcagcgcgtcgtcgaagctcgagaacacgtggttctcgcccggcagaccctcgcgaacctgggtgaggtagtacacaccgatgatcatgtcctgcgaggggatgttgaccggcttgccggatgccggcgagcgcaggttgttcgcagagagcatgagcacgcgggcctcggcctgagcctggctggacagcggcacgtggacagacatctggtcgccgtcgaagtcggcgttgaagggcgagcagaccagcgggtgcaggtggatagccttgccctcgaccagcaccggctcaaaggcctggatagacagacggtgcagggtcggtgcacggttgagcagcacgacgcggccgtcgatgacctcttcgaggatgtcccacacaaaggtggcaccacggtcgatagcgcgcttggcgcccttgatgttctcgaccttgccaagctcgaccaggcgcttcatgacgaagggcttgaagagctccagcgccatggtcttgggcagaccgcactggtgcagcagcagcttagggtcggtaacgatgaccgaacggccggagtagtcgacacgcttacccagcaggttctgacggaaacgaccctgcttgcccttgagcgcctcggcgagcgacttgagcgggcgaccgccacggccagagaccgggcgaccacgacggccgttgtcgaacagggcgtccacggactcctggagcatgcgcttctcgttgttcacgatgatcgcgggggcgtccaggtcgagcaggcgcttgagtcggttgttacggttgatcacgcgacggtacaggtcgttgaggtcggacgcggcgaagcggccaccgtcgagctggaccatcgggcgcagatcgggcggaatgaccggaatgacgtccagaatcatattcgcggggctgttaccgcccttcaggaaggcgtcaacgacctcgaggcgcttaacggccttctcgcgcttctgcttctgggagtcctcgtcggcgatgatggccttgagcttctcggcctcggaggggaggtcgatggcagcgagcaggtcgcggacggcctcggcacccatgccacccttgaagtacatggagtagtagcgggtcatctcgcggaacagcggctcatcggaaatgaggtcgcgctcgctgagcttcatgaaggcgttgaaggcgtccgtgcggagctgcttctcgtccttgcactcttcctcgatgtcgacgatgccagaggcgatctcctcgggggtcagcggctcctcgtcggagaactcgtcgaagttctcggggtcgccctgctccttgagggactcgatctggcgggcgcactcagcatcgatctcttccagatcggcggcgagctcctcgcgcaggtcatcggcatcggcctcgcgagcctcgtagtcaacctcggtgatgatgtagctggcaaagtacagaaccttctcgaggtccttggacttgatgtcgagcatacggctcatcgggaagctcgtggggctcttgaagtaccagatgtgggacacgggagcggcgagctcgatgtggcccatgcggtcgcgacgcaccttggccgaggtgacctcgacgccgcagcgctcgcagacgatgcccttaaagcggatgcccttgtacttgccgcaggagcactcccagtccttggcgggaccgaagatcttctcgcagaacaggccgtccttctcgggcttgagggtacggtaattaatggtctccggcttcttgacctcaccgtgcgaccaggaacggatctggtcggcggaggcaagggagatctttaccgagtcaaaatcagtagcttcgaaatctgccacagtcaactactccttatcagtggtcgtggcggcgacagcctcgggtgcctcggcggtctcggcatcctgggcctcgacgtcggcgtcaacgccggcgagcgcagccaggtcgtcgagagcagaggtctcctcggcggtcacaggggcggaggcgtcctcgtcggcatcgtgcatgggctcgatgtccagtgcgagggaacggatctccttgacgagaaccttgaaggactcggggatacccggaaccgggacgttctcgcccttgacgatggactcgtaagtcttgacgcggcccacggtatcgtcggacttgacggtcaggatctcctgcaggacgttggaagcaccgtatgcgtacagtgcccaaacttccatctcgccgaagcgctggccgccgaactgagccttgccgcccagcggttgctgggtaaccaggctgtaagggccggtcgaacgggcgtggatcttgtcgtcaaccatgtggccgagcttgaggatgtaggacgtacccacggtaatgggctcgcggaactcctcgccggtgcggccgtcgaacaggcgggtcttgccgcgctcgtcaagctgggtgacaaactcggggcgcatgtgatcgccaaaggcagcggtggccttgttgagcatgttcttgttggcgcgacggatgacctcggcgatctcgtcctccttggcgccgtcgaagacgggcgtcgagacgaagaacggaccggggacatacttgtcggagtcggcatcctcggtatcccaaccgcaggcagcagcccagccaaggtggcactcgagcagctggccgacgttcatacgcgaaggaacgcccagcgggttgaggataacgtcgatcggggtaccgtcagccatgtagggcatgtcctcgaccggcagaacgttacagataacacccttgttgccgtggcggccggcgatcttatcgccctgctggatcttacgacgctgggcgacgtagacgcgcacctgctcgttaacgccgggggccaggtcgtcgccgttctcgcggctaaagcggacgacgtcgatgacgcggccataagcgccgtgaggcatcttaagggaggtgtcgcgaacatcgtgagccttggcaccgaagatggcgcgcagcaggcgctcctcggcggtcagagcgctctcgcccttaggcgtgaccttgccgaccaggatgtcgccagggccgacctcggcgccgatgcggatgatgccgtcctcgtcgaggttggcaagcatgtcctcggagaggttcgggatctcgcgagtgatctcctcgggaccgagcttggtgtcgcgggcgtcgatctcgtgacgggtgatattgatggtcgtcagcaggtcctcggccaccaggcgctcagacacgacgataccgtcctcgtagttgaagccttcccacggcatgtatgccacggtgaggttctggcccagtgcgagctcgccatgatcggtcgaaggaccgtcggccagaggctcgccctgctcaacggtgtcaccgacgcgcacgagcggacggtggttgatgcaggtggactggttggagcgctggtacttggccaggtgatactcgtccatgccgccggcatgcttgacgataatcttggaggcgtcggcatagatgacctcgccggcgttcttggccagggtgacctcgccggagtccagggcggcgcgacgctccatgccggtaccgacatagggagcggcagggtgaaccagcggcacggcctgacgctgcatgttggcacccatcagcgtacgcttggcgtcgtcgtgctcgaggaacgggatcagcgtggctgcgacggagagcatctgacgcggcgagacgtccatgtagtcgacgtcctcgacgggcacgtcggcgggagcgccgaaggagccgtcgaagtcgcgggtacgggcgatcacggtgtgcgggcggacaagcttgccctcggcatcggtcgtgatgaactcgttggtcttgggatcgagcggcgtgttagccggcgcgatgacgtgcttctcttcctcgtcagcggtcatccagtcgatctggtcggtggcaacgccgttctcgacgcgacggaacggagcctcgatgaagccgtactcgttgacgcgggcgtagagggcgagcgagccgatcaggccgatgttggggccttcgggggtctcgatcgggcacatgcggctgtagtgcgagttgtgaacgtcgcggacggccgtcggcacgttggtgcggcggctggagccggacttgtggccggcaagaccgccagggccgagtgcggacaggcggcgcttgtgggtcagaccggtcagggggttcgcctggtccatgaactgcgagagctgcgaggaaccgaagaactccttgatggaggccacgatcgggcggatgttgatgagcgactgcggggtgatctcgtcgatgtcctgggagctcatgcgctcacggacgacgcgctccatacggctcatgccgatacggaactggttggcgacgagctcgccgacggtgcggatgcggcggttgccaaagtggtcgatgtcatcgaccttgaagccctgctcgccgacagcgagggacagcaggtagcgcagcgtcgcgacgatatcctcgtcggtgagcaccgtgacctcttcctcggtggtgaggttgagcttcttgttgaccttgtaacgaccgacgcgggccagatcgtagcgctgcgggttgaagagcaggccctcgagcaggctgcgggaagcgtccacggtgggaggctcgcccgggcgcagacgacggtagatctcgatgagggcgtcctcgcgagtgagggcggtgtcgcgctccagggtgcgcttgatcacatcggagttgccgagcagctcgatgatgtcatcgttggtgacggcgatgccaagggcgcgcaggaacatcgtggcgctctgcttgcgcttacggtcgatggagaccatgagctggtcgcgcttgtcgacctcaaactcgagccaggcaccgcgggacgggatgatctgggccttgtagatctgcttgcccgaatccatctcggagctgtagtacacacccggggaacggacgagctgcgagacgacgatacgctcggtaccgttgatgatgaaggtgccctgatcggtcatcatggggaagtcgcccataaagacgagctgctccttgatctcgccggtctccttgttggtgagacggacgtcggtcagaagcggggcctgataggtcatgtccttctcgcggcactcctcgacggtgtgcgcggggtcgccgaactgatgctcgccgaaggtaacctcgagaacatggttctggctctggatggggctggattccttgaacgcctcacgaaggccctcgtccttaaaacgctcaaaggattccctttgaacagagataaggttggggagctccatggcctccgggattttcccgaagctgacgcgcttgcgctcagtggcagtgtatgcgtaggtcaccaggtttttcctccttcacggaaatgctcggtgggttggcgaggcatagcttcgccagttatcgcaacctaatagtttatcaggtaccgaccgttgggcaagaaaagccttgacgcgattgagtttttggagtagcaaagtttttcgacagaaaacacgcaggtagatgtatgtgtatcgaacatctgttcatatattttctgtgaacagagagccggcaatcgcagctcttataaaaaacgggcgcgaaccgaggtccgcgcccgtaaatgtcgatgcccgaaggcttacttgcgcatcaatccgccgcgctcgtcgatggcatcccagaaggcatcggcaaagcgggggtcgcttgcggccatgagggcgttggtggccatccagccagagggagtgccggtgtcgtagcccgacagcgggtcaatgacgacggcatacatggcctcgcggtcgagcgaacgggccatggcgtcggtgagctggatctcgccgcccttgccggcctgctgatctgccagcaggtccatgaccagcgggctcagcaggtagcgaccgacgatgtacagattggacggagccgcctcgggagcgggcttctcgaccagaccgccgatgcgccagacagcgcccggctctgcatcggcaacgtcctcggcaccctcgagcgaaccgacgcgctcaccggcgataacgccgtagcggctgacttcctcgggcgagcaagcagcgacggcgataaccgaagcgccaccgtgctccttggaaacggcgagcatcttgtcgcagatgtcgcggttaggcacaacgtagtcgcccagaagaaccaggaagttctcccctgccacggcgtcggcggcagagcgaatagcatggccgaggcccttgggctcgtactgataacggaagtcgaccggcataccgccagcgtgggcgacggcgtcggcataggcgttcttgccgcgctcgcgcagcaggttctcgagcgagcgatcgggctggaagtagttcagtagctcgggcttaccgggagaagtaacgatgatggcatcgtcgacctcctcgggatcgagcgcctcctcgacgacgtactggatgacgggcttgtcgagcaccggcagcatctctttgggcgtgcacttggtgccaggcagaaaacgcgtgccaagaccggcggcggggatgattgctttcatgttattcaaagatcctttcgcaggcgcaagatgcgccctgtgcgcgcggcacggcggccgcagaccaaattgcgatacccaagcatcttaccgctggaactatatgtcgctacaaggcagagacaattcttcagcaggtcaacgcaaattattgctcgaatggtgcaattttattgcccaacggcagggtgcccgatacgacgcaaattacagaacatggcagtttgagcaaccgatgtcgagggaccgaaaaacaaaaaagacggggctcgcaatgcgaaccccgtctgcaaagaaatctggcgagaaagcctgattacttgagggtgacagcagcgccagcagcctcgagcttctccttggcagcctcggcgtcctccttcttggcaccctcgagaacagccttgggagcgccctcgacgacctccttggcctccttcaggccaaggttggtgagctcacggacggccttgatgacctggatcttgttgtcgccgaagccctcgagcacgacgtcaaactcggtcttctcctcggcctcagcagcgccagcagcgggagcggcgacaacagcggcaggagcagcggcggaaacgccgaaggtgtcctcgatagccttaacgagctcggaagcctcgagaagggtcatttccttaagagcatcgatgatctcatcggtggtaagcttagccatttctaagtcctttcggtttccgtgcgaatgcacggagatcagttaaaacacggcgcgaatgcgccaggggtgcggcgttgccgccgcgggtgaaaacagcgactaggctgccttctgctcggagacctgctggatcgaacgagcgagaccagaggaaacgccgttgacgcagacagcgatgtcgcgagcgaaaccggagatgagaccggcgatctggccgagaagctgatccttggtgggcagctcggcgatagccttaacatcatcagcggaaacggccttgccgtcggagataccgcccttgatctcaaggacgcccttggacttagcggagaagtccttaagggccttagcggcctcgaccggctcggactcgtagaacacataagcgacggggccggcgagaatctcgtcgagctcgggctgctcctggttcttgagagcgatcttgaccaggttgttcttgtagaccttcatctcggcgccgcactcgcgaagctgatgacgcagctcctgagcctgcttaaccgtcagaccgttgtagttgacgacgaacagaccggcgttctcggcgatacgggactcgatctctgcaaccttgtcgattttgtactgctggggcatgaattacacctcctcgaattctttccgggcacggtccgccacaaggacgtgacgggggcatgtccaaaaagaaagcccccgcgctgcatgagcgacgggggcgagaagacatatctactcgaccacctcggctggcgggatatcccattaagctcgcgggtaagacccgtttgcgccggctgtctctggcagcggattcgtgcgtgaaccgaaagtattatggcggggaccccggcgtcggtcaacgggaaaccgggctgcacacaattccaccatccggccgcgccgccgaaggccaggcgcaaggttttcgctcggtcaggtcctgggctcgcacgaagagcacattaagtgctcttcggctcgtgcggaatctacgaaaaccttgcgcctggccttcggcggcgcggcctgcggtgactttggggcagcccggtttcccgttggccgacgcccccactcataagccttaagtcggtgggctgatatgttgcgtccctgatggctacaaggttgaaatgaaggtggacaggcggcggagaccttcgtccaggtctttgtcggaaacgcagtagctgaggcggatgtggccttcggttccgaagcagtctcccgggactagggctacgtttgcttctttgatggctttgatgcagaagtcttcgctggttaggccgaactttttgatgctcgggaaagtatagaaggctcctgcgggctctactacgtcgaggcccatggcgtttaaggcttcgagtacgcgctcgcggcgggctcggtagactttgagcatgggggttgggtcgacggtgagggctcgggctgcagcgtccatttcgaaggagacggcgctcgatactaagtattggtgggcctttgcgatctcggcgatgacgggggttgccgctgcgagccagcccaggcgccaaccggtcatagcccagggcttggaaaagctctcgatgaccaccgtctgctcgcgtagctccgggtggcgctgggcaaaacgctcatagccatccacatagactaggcggctgtatacgtcgtcgcagaccacgtagatgcccgactgttctgctacgcgcgccacggcgtcgagcgatgccgcgttaagaatgcagcccgtgggattgttgggcgagcagataacgatggccttggtcgccggggtcacacaggcgcgaagtgcgttttcgtcaatctggaattgcgcaggctccgtatccaaaaagaccgctttggcgtggttggccacgacgatgctctcgtacaggccaaaggccggcgtggggataatgacctcatcgccggggttgagcatagcaatgaatgttgccgacagtgcctcggtcgcgccgtcggtcaggatgacctcgtcggccgaaaacgtaaggcccgcatcccccatgtaggcagacaacgtctcacgcagggcggggcgaccgttgttgggcggatagtgcgtgtcaccgcggtccagcgcggcggtcacctcggcgctaatcacatcgggcgtgggaaaatcgggctcgccaagcgcaagcgcgatgcaccccggatgctgggcggcgagtgcgttgatccggcggataccggagggcttaagcgtggcaagcgaggtattcatgggcagacgcatggcgttcctttcgtaagggttgcactaggatagcgcggcggagcgccaccagacggtgtaacctaaacggaaaccaaccggaaaggaggcggcatggagacgaccgcgcgcggcgatgtaccaaaaacactgcataacatcgcgtttgtcagtattcccgaaagcaccgatcttgagtttttgctttgggacctgcaggatgccatcgccgcctatgcccggctttccgacaccgtactcccccacccggttgacttgaaggcggatgatgccggtgcagtcgatggcatagtgctcgctgttgatgatgcatttgacgatgaggctatgatcgctgtcgagcagatactcgatcgccttgggaatacagaaacacgcgtctatgtcgtcgtccaggccctgtccaacaacgccaagcagacggacgaagtcctcgaccgcctgtatcgggcatgtcttctacgtgacctgccatggtgcgacggcgttgtcgtctgcaccggcaccggcatcgcagcgcttcgccactccccgcgcatgggtctcttgcgtcggccattttcggaagcgatggataagcttgtgggcgccgtacgcatgggctgctccattgagcatgcgcagctgcttggcggtggcaatgccggaggcgtcgatgccgacggcatggtgcgcgtcaagcccgcgctgcccgcaccgatctggcatgccatcatgaaacgcctcggcacccgcgcccaatcagatatctaaattacagagcgccccagtcaacggcctcgcgccagcgcccaacaaggcgctctaggcgccatgccgcattggcgggacttgtcgacggcagaacgatggccggcagcccggtgcgttcttgtagatagcgcttgtagagccggccagctgtaccaccgttgcatatcacctgcttaatgggagccgcgtcggtaatgcgctcgatatgtgccggcacaacgtttttgatgctggcgtcactcgaacccttaatatcgcagctctcgatcacgtcccacagggccacaccgccgttgagcagcatggcccgcttggcggcaatcgaggcatcgagcgtcgcgggctcaccgcttgccaaaggatcgccctcgttgggcggcacgggcacaccgaggcacgcggccatcacgcgccaaaagcgattctgagggttgccgtaataaaaggcattggcgcgcgaaagcaccgagggaaacgacccgagcaccaaaacgcgcgagtgctggtcgaacacgggctcaaacccatgctcaatatgttgatagccctcgtcagacgctgccatggcctaggccctcagcagataacgcacctcgtagggtgcaagctcaagggcacccgacagctcgaccgtgggcgcatcgtcggcaagcaggtcgacgaaggagccgctgagttcgccagctccaaaggtgtagggctcgttcacggcattgaccgccacgagcaccgtcgcatcgtcgcaggcgcgctcgaacagcagctgcttgttctggatcaccacgttgcgataggcaccgtagttgagggcacgggctgccgcgtcgtttgccgagcgcaggtgcgccagctgcgtgacaaatgccgtcagctcgttgggcgcgggctcatcgagcgcaggacgtagcgcccaatcgccatcggggccgcccttttcgccggcaatcccccactcgctgccgtagtagacgcacggaatgcccggcataccaaagagcatgccgtaggcggggcgcaggcaggacttgtccgtcaggatgctcgccaggcgcggcacgtcgtggttgtcgacaaacgacagcagatgcttgccgcgataaatgcaccaggggtcgccgccaaactggcgatgaagcgagtgggcaatctcgaacatgttgaccgagttaaagctggagtacaggcccttgtagcactcgtagttggtgcaggagtcgagcatctcgtcgttgacgatctggttgtagtcgccgtggagtgtctcgccgatcagcacgaagtcgggcttgagctcgcgggtaaaggcgtgtaggcggcgcataaaatcgcgatcgagcatataggcgacgtccaggcgcagaccgtcgacgccaaagacttcggaccagcgacgcacggactcaagcaggtaatcgaccacggcagggttttgcaggttgagcttcacaagctcaaaatggccctcccagccctcgtaccaaaagccgtcgccgtagcacgagtcaccgtcaaagctaatgtggaaccagtccttgtagggcgagtcccacttgcgctcctgcacgtcgcggaaggcccaaaaaccgcggccgacgtggttgaagacagcatcgagcaccacgcggatgccatgggtatgcagcgtgtcgcatacggcggcaaagtcggcatccccacccaggcggcggtcgatatggcgcagactgcgcgtatcgtagccgtgactatcagactcgagcggcgggttgatgagcacggcgccaataccgagtttttgcaggtagtcggcccactgggcgatcttcatgatgggggcatcggagttgggcgcgtcgttggcagcctgggcgagctcatcctcagcaacgggcgcggcgttttcgcgcggagctccgcaaaagcccagcggatagacctggtagaacgtcgtctcgtatgcccacatagcaacctcccggtaagctcaacacaacgacatccattgtatgcccagcagagtagttaatttgggacggggctcttttagccaccccgaccctcctgggttgtgattaggcgacgggcttggcgcgacggatggctgggaacagcacggtgatggcgaggatgacgcccacgacggtaatcgccccgcccacgaagccaatccaagcgataccgggacccgaaaccacggcaccgccgattgcggcgcccgtgccgatgcccagattgaacaggcccgagaagatcgacatggcgacggccgacgaatccgccggcgtgtacttgatgagctcggcctggaacgccacgttaaaggccgtggcgcagcagccccacagcgcgcagacggcaagcactgccacgagcgacgatgcgaccggacccataagcagcagagccaccggcacgccggagagcgtgatagccaagaacgggaagcgatgcccgtcgaacaggcggccaaacagccagctgcccaccagaccggagaagccaaacgccgtcagcgtcatggtgatggcgcccgcgtcgacgtgtgcgacctgcgccaggaaaggctcaatgtagctgtagcttgcgtaatagccggtcgccataaaaaccgtgaccgcgtagagcgcgaccaggaacggattcttgagcagctcgggcagctgtttgacggtaaagcgctcgcccgccggcatggccgggaacaccgcggcctggtagacgaccgcgatggctgagagggccccgaccacggcaaacgtcatgcgccagcccacggccagcccgatggcgcggccgatcggcaggccaaagatctgcgcgatggacgagcccgtggcgatcatgctgatggcgagcgctccgtggcgactgtcgaccaggcgcgaggccataatcgaggcgaccgaccagaacacggcatgcgcgcaggcgaccaccagacgtgcgcaaaccaaaataggataggtgggagccacggcggacaggaactggcccagcgagaacacggcgagcacgccgagcagcatccgcttgaactcaaagcgcgaggcaaacaccataagcggcagcgacagcagcatgacgccccaggcgtagaccgagatcatgatgcctgcttgggcctccgtgagcgagaacgatgcggcaatatcagtcagaagaccgatgggcatgaactccgacgtgttgaatacgaacgcgcaacaggcgagcccaataagcgggagccactgcttgagtgagatgccatcttgtcttgcctgagtcatgtaggaaacctctccgattgtcttgggcggtgggcgattatatagcaacggccccgcatccgtcagtacagatgcggggccgcaatcaactcaatacacagaggttgcgccgtcaataaataactaagccaaacccagcaatatgcccgccgaatgcacgacaaacgccacgatccaggcgaccgtcacctgaaacgcgaacacagcaacggcatagcgcgtgcccagctcgctcttgacggcgccgatggacgccacgcagggcgggtacagcagcgtaaagaccaggaacacgtaagcggtaaacggcgaaaacatggttgacagcaccgcgggcgacgttgcgcccaaaagcaccgtgagcgtcgagatgacgctctccttggcgatgagtcccgtgacgagcgccgtcgaggcgcgccagtcgccaaaaccgagcggggtcaacaccggcgcgatgatgctacccagaccggcaagcagactctgcgactgatcggcgaccacattaaagcggatatcgaacgtctgaaggaaccagatgaccacggtagcggcaaagataatggtaaaggccttggtaataaagtccttggccttatcccatgccagcatcaccgtcgtcttgacgctcggcaggcggtagttgggaagctccatgataaacggcaccgggtcgcccttaaatgccgtacggttgagcaccaaagccgcaatgcaaccaaccgcaataccaatcagatagagcgagaccatggcgggaaccgtcgcctgtgggaaaaacgccccgcacagcagaccatagaccggcaacttggccgagcagctcatgaacggcgtgagcatgaccgtcatcttgcggtcatgctcggatgggagcgtacgggtcgacatgatagccggcacggtacagccaaaaccgacgagcataggcacgaagctgcggcccgacaggccaaagcgacgcagcaccttatccatgacaaaggccacgcgtgccatgtatccggagtcttccagaatggagaggaacaagaagagcacgacgataatcggaaggaaggtcagcacgctgcccacgcccgtaagcacgccgtcgacagccagcgagcgcaccacgtcgttggttccgaacgccttgaggcccgcatcggccgaggcgatgatgacagcgatgccgtcctccatgagcccctgcaacgccgcgccgatcacgccaaacgtcagccaaaagacgaggcccatgatcaccaggaacgccggaatggccgtgtagcggcccgtcaggatgcggtcgatcttgacggagcgcacgtgctcgcggctctcgtgcggtttgacgacgcagcgcccacacacgtcgccgataaagctaaagcgcatatcggccagcgcggacaggcggtcggtgccggcctcgccctccatctgagtaatgatgtgctcgatagcgtcgagctcgttgcgatccaggtgaagcgcctcggtcaccagctcgtcgccctcaaccagcttggtcgccgcaaaacgcacgggaatgtgcgccgtcgcggcatggtcctcgataaggttggcgatgccgtggatgcagcgatgcagcgcaccgccgtctggaccatcgggtgcgcaaaagtccaggcgaccgggacgctcgcggaaccgcgccacgtgcaaggcatgatccaccagctcgccgataccctcgttgcgggcagcgctaatggggacaacgggcacgcccagcaggctctcgagcaggttgacgtccacggcgccgccgttggccgtcacctcgtccatcatgttgagcgcgatgaccatggggcggtcgagctccataagctgcagcgtcaggtacaggttgcgctcgatgttggtggcgtcaatgatgtcgatgatggcgtccgggcgctcgtcgaggatgaactgacggctcacgacttcttcgcctgtgtacggcgacagggagtaaatgccgggcaggtcggtaacgctcgcctcggggtggttgcgaatggtgccgtccttgcggtcgaccgtcacgccgggaaagttaccgacgtgctggttggagcccgtaagctggttgaacagcgtggtcttgccgcagttttggttaccggcaagggcaaaatgcagcggcgcgccctcgggcacggccgtttttgccgcacggggtgaatacgtcccctcgcccagggccgggtggtccgtcgtgccgattgcggcgttaacgcgcgggccggtatcggtgtcgtgcacatccacgagctcaatgcgtgcggcatcgtccttgcgcagcgtcaactcgtagccacgtaggcggatctcgagcgggtcacccatgggggcgtacttcatcatggtgacttcggtgcccggcgttagacccatgtccaaaatatgctgtcggagtgcctgatcgtccgatgccaccgatgcgacaacggcgtcctttccaatctcgagtgtatcgagcttcacgtccgtgctcctcccccgacgcccacagggcgttgcatttagtttaccttggctaaccgtttgccacggctaaccaattgtaaccatgcatgatagcgcgaacgcacaacgacgttcaatcgacagattgctgcaaggaccgtccccaagtgccggcacaaaaggaacgtccccaagtgccgcatctgggccatggcaacgccgatgttttggcgcgaacagacactatgacccaatccgagggcactaaaaagataggagcccccgctcgtgaaagggaagaggcgggtcatgccccgcctcttacaccacatctctgcgcgctacctgactatcttggcaacagtactcatatttggcattgtttgaccacgtggtatatagctaaccccctcaaacagcccaaaacgcctatttcgatgcgcgctccgccgcctcaatcacgtgtttggcgagaatcgcggtggtcacagctcccacgccgcccggcacaggcgtgatggtgtcaacaaccggctctgcagcatcaaaatcaacgtccccgaccaacttgccagcggcctcgtcccaattaatgccaacatcgatgattgtctggccctcgcgaaccgcgtccacaccaatcgtgtgcgcgcgcccaacggccgcaaccacaatatcagccgcacggcactcggcagcaaggtcgcgcgtatgcgtatggcacgtcgtcacggtggcattgcacgccgtaagcatggcggcaacgggacgcccgatcaccagcgagcgcccgaccacagcaaccttagctccatccagctcaacgccgtaatgatccagcaaagcaagcacagcttcggctgtgcagggggcaaaaccctcgccgcgccccgaaagcgtggtgagcagcgaagccggcgtcatggagtcaacatccttggcgggatcgagcgctgcggcgacggcgttctcgtcaaggccggcgggcagcgggcggaacatcagacagccatgaacagccgaatcggcattgatgtcctcgatagccgtcaacagctcgtcctgcgaaacatcggcagaaagcaaaacgcgacgagcctcaatccccactttttcgcagcgcttgagcgcaccgcgctcgtaggataggtcgtcctcgcgttcacctacacgcacaatagccaacgtcggaacaacgccccgctcgcgcagggctgcgcagcgagcagcaagttcctcagtcaaagcgcgagcaacgggagcacccttcagcagttcagccatggctatcctctcttccttgcagcgtcggaggcgcggcgcgccagcgcctcggcgcgcggcaaccatgtgtcgagcagctcatcacacgccgtctcgagctcctcggcacgaacgcgatccttcatagacgtggtgttcgcaaagagcgtcaaactcgcgccttgcatagcggcacggcagaacacggcgccgcacgccacatcggacagcagctgacgcgaacccttgtcggccatgtcctcgagcagcgccagcgcacgcccgcaggcatccataatgcgatacggcggcagagcggccacatgcagcgcatcctgaatcgcggtcgctcgagccggatcgtcacgcggaataccgtacgccgcggacacctgcccgtaggcacgaacgtcctcggcaaccagacccacaagttcctgcgccaactcatccgcctgggcaaacgcgcgcgtcagatcgtctgcgcgatcggcaagcgcggggtttgtcgccccatagcgggcaaccattccgcaaagcgaggcgcccagcgcacctacaaaggcgctcgcgctgccaccaccgggaaccggctcgcgcgcggccagcgcctcggcaaaaccgcgacaggttttatccatcatctcttggctcatacgcacacgcaccttcaagtcatatatatcggtcgggcggccgacgccggccgaccgcatcgatcacgtaatggtgctaagtctagcccataagtacgcgagcgtcagcgcacctggccatcgcggatttctatggcacacgataggccatgccaacgcaaacatgggacacatggcccacctttcgagactcccgagcagcacaagctggggcatatctataagtaaggaacccgttggggaacggccgcgcaacggccacaagcgatgaacggaggcataagtcgcacagtacacagagacatccgccgccagcgcaatcagtaccccaacagcatgcggcgccgtgatgtcatcagcagacaaggaggacgccaccatgatgaaaaagaccctatcaatcctttccctttgcatcgccctctttgccgcgctcgcccttgtgggctgcggcgggagcgcatcgggcggcggcagcgcccccaagagcgagagcaaggaaaaggcccccgtcgccaagaagaccgactacatctggtttaaggtcgagatgcccgagggcgtcggcgtaagcgactctgccggcaagaatgccgacagggtccagctcaccttccccgaagacgagaacgcctcggccgatcgctttatccccgtttggaaaaaagcgctgacggccgaggaatcccacgccgaccaggcggaaaagaagggggatacgttccagtggaaggatggcgggtccgtcgagtataacggcaggacgtggctcgtcggaacatacgaggacaacagcggcatctcaaccatgctttttaccgatgttgagccgggaagcgtctacgtcctcatctcgaacttcgaccagcacaagaaagaagccgaggcactcctcaactccatcgagttccccgatgacatggtagaggcagtttccgaggcacgcgaagtcgagatttcgagcatcgagatcaagtaacgggacacccgcacgcgcctacgcgcacccgcgcacatgcgccccattaaaacaacgggcgcccaacccggggagggccgacagcaccggccctcccctcttttggacccgtgcatattgccacttaacggcgcaaatccggccctcagaatgggacacatggcccaccctagcgagccgtccacgcgtacagtaaaggcaggtaatccatgggcggttacagatcgaggaggacacgaccatgaaaaagaaggcctttgcgattctcaccctctgcatcagtctctttgccgcggttgccctggtgggctgcggtggcagcggcggcgctaccggcagtggaggtggcggcggagcagaaaagccagccgtggatatgaggaccgacttcatttggtttaaggtcgaggtccccgagggcgtcgagatcaccgacgtcgcaggcgacaccgccgacagggcccagtttaagttcaccgagagcgagcacgccagcgatcgcttcatccccgtcttcgactctgacaagaacgccgatgaactgttcgactacgaggcaaagtggaatgccagctttgagtggaccgagaatgaccccgtcaagtacaacggcaagacttggcgcaacgcttcctatacacactcgggcggcgtaacgaccgaatacttcaccgacgttgacggcggcagtgtgtatgtgcgtatcgacaacgtcgaggagcacaaggacgccgtcgagaccatgatgaagtctctggaatttgccgacgacatcgccgaggccaagaccgaggccatggacgtcaagctcgacgatatcgagatcaagcgctaagcgactggcgagcgcaacgggaaacacggtcgcagtgcaaacaagcgacggtaccccagcgcttcgtacccagggagggccggtaaaccgaccctccctttcttatgcctgtagccgacgaacgcgaggatgccggacgccggaaccgccccaaatgtggcaacagtacgaaaacgacaaacaccccaacacgtccgcccaccgatttattgcgccgcgcagacaattaaaccagcatctttaaacatctgggcagtatagtgaccaaaactatcgcataaccgcactctgcgaatggagaagttatgaccgaacaccatgccatcagccgccgagcgtttacgctgggcctagggcttgcggcgttgtcaccacttgcaagcctgcccgaaaccgcagcgccgggcattcccctgcgagcggcatttgcagacaacacacccgcaccgtcggacagcctccacaatttcgtcattcgccttcgccccgcgggctattttcgcaccgcgagcgtcaaccaagacggcaacgttcgcggcaacgtctgtcacctgtttaacgacggcacgtccagcaagctcatccttgagaacgtaacgaccaagaatgacgatacaaactggtacgccatccgcaccttgctcaatttcgaagagcataaaaagacgggctacagcatttggtcggtcgacgacgactcggacaaagatggaaaggtcatccacgtatggggcggcgagtatgacaacaagcccagccgcgcttttgcgttcgagcgtcaatcaaacggaacctacatcatccgagaccgcacggtcgagaaagaaaccgagaaaaaagacattaagtacctggcaatagaatcgaacggcaaagaccaggacaacaataagatctgccataagagtaagagcattccgtgggagctcgaacttatcggttaggacatgaaaaagaacgatgccacggttagcagcctcgactggatcacgtacagcagctacgtcgacggaccatgttggatgaaatacgtcgacgacaacaagttcctcgacgagctgagcatcccgggtacgcacgattcgggcacctgcagcgtggacaacgacactgagccccaatcctcgcaagtaaaatgccagcaggattacattcccacgcagttgctcgaaggcattcgctatttcgatatccggctcggaaagggcgatgaccccggcatcgaccacgggattttctacctactcaaaaaagacgggaactatctgcatctctccgatgtcataggctacttcaaaacgtttttgaacgaaaacccgacagaagcgctcatcatgcttgtatcacgaggcaacgacgaggctaccgacgaaagtgttacgacggctttcgccaaggttttggacgacaaccccaaactgttctatacgtcgagccgcgttcccacactgggcgaggtgcgcggaaagatcgtcctgctacgtcgatttggactcgacggcgacagcgtaagcggccacacgtggggactcgacctcaccgaatgggataacaaaatcgcagtgcacaccgacagcagttccatgtgtctcgtccaagacgcgcggggctttgaagccgcgggggaaacaggcgacaaagagccctattgcaccaaggtatacgcccaggacaagtacaaactcacgggaaccgacaagctcagctgggtcgataatgcgctgaaggaaacgaccgggcgcacgcgcaacgaggtagatgtcgaggacgataacggggccaaggagaaagtcctggagcgttgctggtctatcaactacaccagctgcacgggcttgtcgcacggaggcaatccttttacctcggcacgagtagtcaacgagcatctgtataagagcccgtacatcaatcccagcggcatcgaggatacaaagtcagattacctcaagcacattggcatcatcgcatccgactttgttgatgcggcgctggcccggagcatctaccagcgcaattacaattacgatacgaagcacacgcagtcggcttcgtgctgcctcccgacccgcatgcgcatgacgtacggcgactcgctgagcgatgcctcgctccaggatggcaagaccgttggcgagggccatttccgccttgtcgacagcagcaacgtactcaacgtggcggcttcgggccatgcgtttaccatcgaatacgtggatgtcgacgccttgggcaacgagaccgttacggggctgcagggatccgtgcccatcgatatcgatccgcgcgcactgacaccccactttgaggggctcgaaggccttaaggccggcgaggatgtgcgcacaaaggtcgcggcgctgctcgagggcaaactcgaaaacgatgcctgcacggctcagctcgagtttgtgcacgacgcggacggcgctccgggcacggcaatggtcgagggcgaggcatttaccgcgggaacgtactgggtgcgcgcgaacggtcttttgggcgacgcggcgcaaaactacaagcttgctaatgacggagccgcgagctttaccgtagcggcctcgagcagtgcaggcggcaccggcaccgacggtggcacgggttccaacgcaggcagcgctgataagaacggtaagggcaacaagggcaagaactcgggcggaaaactcgccgacacgggcgacggctccggcattgccgccgggctcgctgccgccgccgtagcgacaacggtcgccggcgcggcaatgcttgccaacgaccgcgaaaacgctggggacggtagcgaataggcaagccggccttttagacacatcgactcaatggggggcgcaggacaccgttctgtgcccccgatttttaccttggcccaaacgccgccataggctacatcaccatgttcagcgcgttaacaaactcctgggccttcgcacggctgctcaggctaaaaacacaagcagtcaacagcctgttacgcagaaaaacatcgcggcccttgatcctgttgacccccgtaatgtccttaagatagacaatctcggtgtgcttgccaccaaaagtgcccttcttgagcacctcaatacggttggggtagatcttgacgtctttatacctacccgaacctttgtcctggaatagcagcgtgttattgtccatacgcgtcactcccgtgggattcgctaaaactgcctctatggtcacattttagtcaccgcaaggccccatgcgaagatgtcagacagcacagcaattcgtgtccgcgcgaggctttaaactaaatgcgataaagacgcattccacaaaaggaaagtggggcgacagtgatgggcgaactggtaaaccgtggagaatcggcaatcgtgcccgaaggtttttacaagcaggtctcctcgattctcaacgccgctcgcgacaaggcctataccgccgttaactttgcgatggttgaggcatattgggagatcggcaagagtattgttgatgaacagggcggagaggggcgcgccaagtatggcgatgcactgatcgacgaacttgccgttagattgactaaggattttggcagaggcttcaacgccagaagcttaagatacatgcgtcagttttatcttgcgttcccaatccggaacgcgctgcgttccgaattgaattggacacattaccgcaggttatcgcgtataaccgaccctgatgctcgaacatggtacatgaacgaatgcgccgattctcgttggagcacgcgtcagctcgaacgccagatcaacaccatgttccgcgagcgcctacttgccagcaaggacaaggaggccgtcacccaggaaatccaaaagagcgccccggctcgtcgccccgaggatatcatccgcgacccatatgtactggagtttttaggtttctcggacgatactgcgtttcgcgagagcgatctagagcaggcgctcatcacgcatcttcagaagttcctgctggagcttggccgtggtttcgctttcgaggcgcgccaaaagcgcatcacctttgatgggcgccatttctatattgaccttgttttttacaactatctgatgcgctgcttcgtgctcatcgaccttaagacggacgaccttacgcatcaggacctgggccagatgcaaatgtatgtgaactactacacgcgcgagctcatgaacgaaggcgacaatccgcccataggcatcgtgctctgcgcggacaaaagcgattcgattgtcgagtacacgctgcccgaagacaacgaccaagtgtttaccgccaaatacctgccgtatcttccaagcaaggaagagctggcgcgcgagctgagtgccgagtaccgcgccatcaacgaagcgactaatggcgaaacgcaagggtagcagcacgttgcgaccgaagccaccgcagccgtcgcaggcgcactcgcggttgcgacgcacgctacgaaacaataccggtcatggacgccggcaacgacattctagccgtggctggcgagcgtgacctgacaggcaaagacgcggccttcgtctgatgtgggtccattggctgccacagaaaagggccggttgcagccggccctttagacgataatacctgcgttgcccgcgcttccgaagtgtgactagctgaggagcgggttccgcggcacaacctgattttacccagtgaggaggctcttttgcagccgctccactgtttatttacatctggcaccctcaaacaatcagacggcagcccgcactcctgagagctgccccgcacccccggccatcaccttacggcaacaaccggtgctactcccctacttcccaaatagcgcacccagcagaccgcggcgtttgggcttctcctctcggtaggaaccctcgacggcggctgcaacctggcgcggttgctcgccgcctccacggcgcacgatctggtacaggaagggcgatttaacgtatttgacctcgaagggcgtggcgtgcacggtgctctcaccggacagatgcaggctcgggctgagcggcgccacgatatgcgtttcgcgcttgtcgctaaacaccaccgcggccgcgcggcccgtctggccgtttacggcaatgcgcacctgctcgccatcgcggccgtctgtcgccggacgatcgacaaagtagaccggcaccatcaccaggccgtccttatgtttgcgggccttgcgcgcccacatgcgaatgctctttttattgagccccagtacagcctcggcgtcgttgcccgcaacgtcgagcgccaacttatcaatgaccacctggtccttggtagacgcatcgactgagacaacgcgaaagtcaccttcctgcatggcgggatcgaacggaccgaccttggcaaagtcccacggctccaaaatgcccatgaggcgaacgtccaggtagtttgccctggggtatgcccagtcgagcacctcgtagtacaccaaggcctcgtttgctcaggcccttgcccgggaagctcgccatcatgcgcaagtccgccagcgccatggggaaatagaagagcatcatgtcgttttggatcgcgtcttccacgtcgtgcccggcaaaggcatccggatactggcgcaccagctgcagcgcgttggcacgtgcctgctgcggcgagatttcgcagggaataccctgctcgggcacatactccgcaccaacgcccatggtcaggcgcttgctaaacgtccccggcttgagcaggtccgcaatgccgatcttattgccgcaggacgggcactcaaacacacgctgcgttgactcgccctcaaaggacgctccgcagaaggggcaaggaatgctcacatgcgtggcctcttggaactcctgcgccgtgccgcgatcctcccacagcagatgttccaggaccgactgattgcgccagtgcgcattgaagaaataccagtccgggtcctgcgggcgctcgagttgcgacacatgcgtgagtttgagcagtccatccaccaccgtcaacggcgtatggcgaatacccaaagcgctcttgggctctccggcgtccgcctgccacggaaccaccgtgccgcaataggcgcactcaaagctgcgcttagcctggtgcgagtacatagggccgccgcagttttgacattttatggcaaacatctcgtccatggaaacgtcctcctttgcacaggggctgtcgacattaagtatgtcgagcaagcaggcacatgcccatacccatgtggcccaaaatggaccacccaggcagacgagaaggctcgttcgttagcaccggcagactattgctgcattttctgagcatcggcgcacggcgcccccgtgcgagctacactatccccttaaacatgattgtgaggacgaccgctatgctatttgtaaatcggctggtacatacgcttgttcccggcagcgagagcgagccggtcgatgcatcttgccgcaccaacgcgggcttttccgcaagcctcgtctgcattggcctcaacatcaccctgtgcctggccaagggcatcgcgggtctgctcgccggctccgtctccctcatcgccgacgctttcaacaacctctccgatgcctcgagcaacattgtgagcctgctcggtttccgccttgccagccgcccggcagacgaaggccacccctatggtcacggccgctacgagtacctagccggcctgttcgtcgccgtcctggtttgcgccgtcggcatcaacctgattctcgagtcggtcaccaagatcatcaagccctcgcccaccgcttacacgtttatttcccttgcggcactggctacgtccatgctcgttaagctctggatggcagcgttcaaccgcacgctgggcaaccgcatcgattccgagacactcatcgccacggcgcaggactccaaaaacgacgtcatcacctcgggctcggtcttagcggcggcgcttatttcgcaagcgacaggctttgacctcgacggctgggcgggcctgggcgtgggcatcttcatttgcatcagcggcatgggcctggtgcgcgacgccatcagcccgttgctggggcaagcgcccgaccccaagctcgtccaggcaatccgcgacaagatcatgtcctatccgcaggtcctgggcacacacgacctcatggtgcacgactacggccccggccgtcagtttgccagcgcacacgtggaaatgcccggcgagggcgatgcctttgagcaccacgagattctggacaccatcgaacacgatatcaagcatcagatgggcatcggtatcacgctacactgcgaccccatcgccaccaccggcgacgacctgcgcggctgggtcaagcgcggcatcatgcagatcgatcctgcgctctccatccacgacctgcacgagcacgatggctttgtgtcatttgaccttgtgcgtcccgacggctttgacatatccgacgaggagctgctggggctcgtcacgcgcatcgtgcacgagcgccgacccgatgcctcatgcgtcgttacgtttgactcgggctttagctcgcccgaccgtccggccgagcagctgtagcccacttaacagctagtttccctgcgcgcccgagatgccgttttgtagggcgttccaggcatccgtcgccatgtcgcccaagttctgcgcggtatcgcccagattttgtgccgtatcgcccagctcttgcgccttgtctcccaactcctgcgccttgttgctcaagtcctccagcgtattggagctcgagctgtcggtaccgctttggccgtcggacgagttgcccgaactgttcttgtgcgtgagttgaatttcgaggttgccgttgtcgttatagtaggcagatgtaacgacccagttggcatcgacgacgggcgttgagccatcatcagtcaggaccacggcattcgaaagatcggcgccgcgcgacttgaggatcttcttggcgttggaccagtactgccccgggatatcactcagatcgacggtgctagacgaggcggactcggtttgctcggcagcggtatcggccgttgaactccctcgcttgttgagcatgcccgacacgatggcaaacacaaccgacagcgcaaagaagatcgccagcacgatgaggatcttcttaatcacgctcgacgaacgcgacggcgtctcttcctcgtcctcgccatattgcggaatcgacttggggtactcgcgatacggctcgcgcgactcgtagcgaggctgcgccgtgcgaggcatatacgtcgtctgctgaggcagcggaatgggattctgcggcaggtcatcatagggattcggcgtcgaggcggcataagaatcctgcggcgcgtaatcaaacgggtctgccgccgcgttgccataggggctttgcaaagatgcagcgtaagggtcctgcgccgcgtcgccatagcccataactcgtgtgggctcggcagaaggctgcgtcgcggcggggtcgacataaccggggttgggaacaacgcgggtcgcatcggcgctatcgccagcctgcgcggaaccgcagccgcccatcacggttgtcttgtcctgatccatgcaacgattcctttccgtcgcctgtaagcatcaagttatccatgcattctaccagcgcaaaagcctatgatgggcagagtccgtcggtatctacaagacatgcgcgggcctaaggatcaaaaagccccgccgggccttggtaggcgcgacggggcgggcaagcggctatgagcagcgagcttagaacaggccggtgatgttgccgtcgttgtcgacgtcgatgttctcggccgcagggaccttgggcaggcccggcatggtcagaacactgccagtcagtgcgaccacaaagtgggcgccggcggaaaccttgagctcacgcaccgtgatgcggaagttctcgggagcgcccagggccttggcgttgtcgctaaagctgtactgcgtcttggccacgcataccggcaggttgccaaagccgttctcgcgcagctcggcaagctgacgcttggcggccggcgtaaagtcaacgccgtcggcgcggtaaaccttggtggcaacagcatcgagggcgtcggccacatcggcgccgtcctcataggcaaacttgagctcgctcggctgctcaatcagacgcatgacctcatcggccagctcgagcgcgccctcgccgcccttggcccagacctcggaaagcttaacgttgacgccgagcttctggcactcggactcgatgagcgcaagctcggcctcggtgtccgtcgggaagcggttgatggcgaccacgcagggcagaccataaacgttctggatgttgtcgacgtgacgcagcaggttgggcatgccagccttgagtgcctcgaggttctcctcgttgaggtcggccttggcgacgccaccgttgtacttcagcgcacgagcggtcgcaacgaccacgacggcgctggggcgaacgcccgtcatgcggcacttaatgtcgaggaacttttcggcgcccagatcggcgccgaagccggcctcggtaatggcgacatcgccaaaacgcatggccatgcgcgtagccatgatggagttgcagccgtgggcaatgttggcgaagggaccgccgtggacaaacgcgggcgtgccctcgagcgtttgcaccaggttgggcttgagcgcgtccttaagcaacgcggccatggcaccctgggccttaaggtcgcgggcacggacgggctcgccggcaaagctatagccgacgacaatctcgcccaggcgctccttgagatcgctgatgctcgtagacaggcacaggattgccatgacctcggaggcgacggtgatatcgaagccgtcctcgcgcggcacgccctgagccttaccgccaatgccgtcgatgacgtggcgcagctgacggtcgttcatatcgacgacgcgcttccaagtgatgcgcttaacgtcaataccgagctggttgccctgctggatgtggttatcgagcatggcggccagcaggttgttggcagcaccgatggcatggaagtcgccggtaaagtgcaggttgatgtcctccatgggaatgacctgggcccaaccgccgccagcggcaccgcccttgacgccaaagacgggaccgagcgaaggctcacgcagggccacggcgctcttgataccgcgacgacgcaggccatcggccagaccgatggtcgtggtggtcttgccctcgcccgcgggcgttgggttgatagcggtcacgaggacgagcttggcctggtgatcagtcggctcgttgagcagtgaatagtcgaccttagccttgtcgaagccgtacggaataaggtgcttaacgtcgacgccggcgttcttggccacctcggtaataggcagcggcgtgacagaacgtgcgatttcgatgtcagtaggcatgggcggtcctttcgttaccgaatgagaaaaagaccaattcagcatagcacgggcgcgcaacagtaaaacgcccataaccgatgaacggcgatatgtttacccgatgcccagcgatagtccaacagcccgccaaaacaaaacgccctaaacggtaggttcaatccccaggtgctcaaaggtgcggagggttgcctgacggccctgcggcgtacgaatcatcaatccgcactgcagcaaatagggctcatagacatcctcgagcgtgcctgggtcctcgcccaccgcgctggcaagggtcgtaagtcccacggcgcgaccggagaacgtcttggcgagcgtctccaaaatgcgaatatccatccagtccagaccgagctcgtcgatctcgaagaactcgagcgcctggcgacagatatcgagctcgatggggccgttgccgcgcacctgtgcgtaatcgcgcacgcgcttgagcagacggttggcaagacgtggcgtgccgcgcgaacgcgagccgatctcgagtgcactgggatggtcgatcgtcacgcccaggatagtcgccgagcgcgtcacaatctgcgcgagctcctcgaccgtgtagtaatccaggcgatatgaaatgccaaagcggtcgcgcaacgggccggtcaacatgcctgagcgggtcgttgccgccaccagcgtaaacttggggatatccaggcgaatcgagcgcgccgccggacccttgccaatcacgatatcgagggcaaagtcctccatcgcggggtacaggacctcctcgaccgaacggttgaggcggtggatctcgtcgataaacagcacatcgcccggctgcaagttagtaaggatggccgccaggtcgcccgtgcgcgcgatggcagggccactcgtggtcttgatctgagcgcccagctcgttggcgataacggtggccagcgtggtcttgcccaggcccggaggacccgagaagatcacgtggtcgagcgtctcgccacggctctgcgccgcttcgatcaacacgcgcaggccctgcttgatgtgctcctggccgcagtaatcgtccaggcgctgagggcgcaaagtgcggtcgacatcgagatcctcggccgtcagctccgagcccaccatgcgctcgccgtgcgccatggatgccgccggcgagttaccgggcgtcgcccacaagtcctgagagtcatcggcttcccacatcacgcatccattccgagtcgcttaagcgccgcgccgagcagatcctcgacacgcatattctgcccatcatacccgctcagggcaacatcggtctcctgcgggctaaagcccatggaaaggagcgccgcacgggcatcatcgatcaccgagggagcggcagcgggcacgggcatcgcaacctgtccggaaatcacgtcgaccggcacaaagcccttatccttggcaaaggtgctcttgagttccaggatcaggcgctgagctgtctttttgcccacaccgggtaccttggccatgcccttgtcgtcctcggccatcaccagcgaatacagctgccccacggtataggtggaaagcacggcgagcgccaggcgcgggccaacgcccgaaacggacacgagccggtcgaacatcgtgcgctcatcctttgaggaaaaaccgaaaagtgtcatggcgtcctcgcgcacctgcatacgcgtgtagaggcggacctcgccgccgggcgtcggcaacgtggccgcagtgctgcccgagatgccgagctcaaagccaacgcccgacacatcgacgacagccgagctcatcgtggcctcgacaagcgttccgtggagctgggagatcatcagtatccggttcctctctgttgatagaactcgccaccggtgagggcgcgggtgcggctgaggtttacgtggcagatggcgcaggccagggcatcggcggcatggtcgggatgcgggtcgtggtcgagctgtgttagagtgcgtaccatgtaggcgacctgccgcttgtccgcggcgccggtgcccaccacagcctgtttgatctgcatgggcgtgtactcgccaatctcgagcgcgcattccgaaagcgctacgagtgcagcaccgcgggcatgcgccgtggggatggccgaacgaacgttggcgccaaagtagatactctcgacagcagccgtgtcgggtcgataacgctcgacgacatccttaaggtcacgggcgatatgcgacaggcgcaccgcgagcggacttccggcactggtctcgatgcagccataggcacggcagcgaacctcgccgcgccgctcctcgataatcccccaacccgtatgggccaaaccggggtcgatgcccaagataaccaagccaacctcccctcgccacaagcacagcgcaagacaaggccccgcgcatcattcacgaacgtctgttctagaataacacaacgctagccctataagtcagccgagatcgaattgtaggttgagtatacgcaagcgagcgcccgccagagcgagcaaggtgccttgaaagaggagggcattgacctggcggtcatgtccgacgattgaaaggcagattgccgctctggcgggcgcgcagcgacctagttctgagagaagaacggaaattgtcggggatcaaccggcggatgcggcatcgggccaccctggggcccaccctgcgggccaccctggccgcccatcatcttatcgatggcgtcctgaacctcgccctcgaactttttcattccctcgtgtaaacggcgctggccgtcctcagagcgcagctcctccatctgctcgggcgaaatacccagcagctcacccaaaatgcccatcatctcaccgcgcatacggtcactcgtatcgtcgtcggcaaagcgacgcacctcggcgcgcgccagcgaatcaaccgtcatgcgctccttgccgttgagccccagatcggaccacgcaagcatgtacggccaggcgcgctcggcaaacgaacgggcagagacgatcggcaccgccggcagcatgcggcgggcggcctcgccctgacgcacgagcatcagcagcagcgagcaggcctcaggcttgccagcggccatcgggatgtcgtcgaaagatcgattgcggtccacgtgcgactcgagcgcaccatcgacctcacccggctcgagcccgccgagcagctgtgccgcgcggtcgagcatatcgaccggaccgtcgagcgtcgagagcgcctgcgccagcactcgctccatacaatcttccaccgcgttgagcgtcacgagctcttggggcaccacggcagacgtgcggttgcgcacgcgcgccacaaactcaagcgtcgacaggtacacatcgccaaagggcgcataatcgccctggtagccgccgcaaagcgccggcgccgccagcgcgtactcggttttggacagcgggctcagcgccatcgcacccaactcgagcgccgtgtcctccagcatgaggcccagcgtgcgcgagcgcagacgctcggcatcgcccgccgacacgtcgcgatcgagcacacgcgccgcatccggtgcatcgcgctcgacggtgcgaatgtgcaaacgctcggcgatggcgcggacggcggcacagcgggcagcctcggcctcttcctgcgccggcgtaaagatacggttgcgccccagcaccaggccaatcacgttgcgcgggcccagagcgtcgacggccagcgccgccagcagggacgacggcaagtcaccctcgagtgctaccacagcacgcgacgcaccgtgggatcgggcgttgtcgcgcacggcaagcaccagcgcctgccacagccactcctcggaacggaactcgggcagttcgtgatcttccagggcatcgagcatcacgccgcgctgaatctcctgaaccagcaggctctcctcaaaacacggcgcctgggccaccacgcgaccgcagtcgtcgagcacaaacgaaccgccggtatacaccgactcgtcataggcaccgaccggcgccatgcaggcaaaccacacgctgcgcttggatgcgatcttgcggtaagcgccgctgcgaacggcggcaatggcagcagtctcgcggtcggtcatgtcaaacgcgttgaattggaaatacgcaatgaggtcaacaccggtcggcaacatctcgagttcgcggtccaagtcaaaaatcacggcaatgcgcacgccgtccacgtcgaacaccggcggcgcccaacgcgtgtcgttgttctcaccacgctgcagggcaatgctcgaacgcgccggcaccacatgaccgtccttgagcatcatgtagtcgagtagcggctggccctcaaacgaaaccgccgcgggcacgatgcagatcatgtcaagctcctggatacgctcggcgacaccagtcaagccggcaagcatgtcgtgctcaaagtcggcagcgcccaccaggcccccgggtatggcgcccataaagagcggagccggaacgcacagcacgcgcgccccgcgctcgtgggccagacgagcctggtcctcgatgcggccgcaaatgccctcaatatcacccaggcgcatatcgatctgtgcaagtgcgagcttcatggctcagccctttccgtcgtaaaccatcgttgtcgtagtaaaagcgccggccgcataatgcagtcggcgcttgcatgtgcatatgctagctatgataccccgagcgggggcgcgctcctagaatgtcgcggaccacagcccgtgcaggttgcagtaggcatagacggtaccggtcctggaaccgccggcaaaaaacgtcgcgggcttcatgccgggctcaaggtaatggacctccaagcggccctcggcctcaagggcgatccactcaatgtagtgctcgggcaggctggggtgctcgaccgagccaacgcgtgcgcggatcacgtgaccgtcgcgctcagtctcgacgaccggcacgtgcttctcgtgcgccgcatcctcggtgttcgcggtcagctccgtgcagccggcaggggttgcaacgtcgttgcccagggcggcaatgagcttgccattggggtccttaaagaatttcgccatgatgttctcctttgctgatgtgccaatgttcttgatggttcttatgcccaaaggcagacaaaccatccacggcattgcaaatgaacacataacgggcggggacgatggggcagcgtgtgccatccgccttggcggccccacccgagcgggttagcgcccgtcgccgcccagcagtgccagaacatcttcgcgggtaaacagcgccgacgagatgccgtcgccgccgagcacgctgttgaccaggtcgcgtttggactcctgcatctgcataatgcgttcctcgatcgtgtccttggcgatgagcttgtacacggtcacggtatgttgctggccaatacgatgcgcgcggtcggtcgcttggtcctgcgccgccacgttccaccacgggtcatagtggatgaccacgtcggccgccgtcaggttgaggcccacgccgcccgccttgagcgaaatcaaaaagaccggaacctcgcccgcttggaactgcgcgaccatcttggcgcggctctccttagacgaagcgcccgtgagcttaaggaaggcgatgtcttccttggccaagcgcttaccgatgatatcgagcatacccgtaaactggctgaacagcaggatgtggtgtccgccgtcgagcgcgccgtgcacgagttccatgcaagcgtcgagcttggcgctgcccgccttgtagtcctcgtagtgcagatgcgggtcgcagcagatctggcgcagcttggtgagctcggcgagcaccttgagcttgtccttcttaaactcgttggcctcgcgatgctgcacctgctgggcgatgtggtcctggttggccagatagagtttgcgctgctcgccggtgagctgcgccatgacggtgtcctcgatcttctcgggcaggtcggccaccacgtcttctttaacgcggcgcagcacaaacggcgacacgagtgcctgcaggcgagcggcgctatcgccctcggcatgctcgaccgggctctcaaagcgcttggcaaacgactcgcgcgtgcccaaaagccccggcatcaaaaagtcgaagatgctccagagctcggacaggcggttttcgatgggcgtgcccgtcagggcaaagcgcacaccggccggcaggcgcttggcggcgcgcgccacctgcgtgagcgggtttttaatgtactgggcctcgtcaagcaccacgcgggcaaagtcctgctcgacgtactcgtcgatatcgcgccgcatgaggtcatacgaggtcacgaccacgttatgctcagcggcgccggctatctgcacacggcgctgcgccttggcacccacgatggcgcacacgtcgagcgaaggcgcaaagcgctccagctcggcagtccagttgtacacgagcgacgcagggcacaccacgagcgtgggcttggcgtcccccgcctccacgcgcgccaggatatgcgcgatcatctgcaacgttttgcccaggcccatgtcgtcggccaagatgccgccaaggcccaggtgttcgagcgagccgagccactggtatccgtcgacctggtagccgcgcatcgttgccttgagcgatgccggcaccgtaaagtccatcttgccgagcgtgtccagacgctcgacggtgcgacggaacgcggcatcgcgatcggcctcgagcgctggcgtgcgcgcgagcatactatcgacaaacagggtgctcgacgcgggaagagacacgccatcgagcaggtcgacggcatcgacgcccaggtcctcggcaagaccaaaggcggcgcgagcgccctcgtccaggcgcacgatgtcgccggacgtcaggcgcgcaaacgtctgatggcgcttgtacgagtccagatagatggcaaggtctgcggccgaaagcccactcgcgcccagctcgacgtcgagcaggttgctcttgacggtcgcgcgcaccgaaagcttgggcgctgggcggaccgagatctggcgcagacggtcgctgagcataacctcacccaactcggacagggcagacaggccctcggtcagcaagcagaacaggctctcgtcatcgcgttcctcaaacgccagaccgccctcgtaaaagtcgaaatatagggccgccgtgtccataacgcgaaactctgccacctcgtcgcggggcggcacgccggggcgttgctcttcgaagagactgcccggagcgcccaggctaaagagatctgccgaccagtcgccgtaggtaaccgtaattttgcaggtcacaagcccatcgtcgacaccgattgccatggcaaagctcggctcgggcgccacggtatcgagcgcggcgggcgcggtaaggtcggtgtagtcgcgcaaaatgggcagcgccatacgacagaactcccccacctggtcgacagcgatatggatcggcgtgcgacagggcagcaagcgcgataggaacggcgccgcatgctgggcaaacgctacatcggtgcggcgcgcacggcgggtgtcgaccaaataggcaacgtcgcccgaagcaaagcagtatgcatcggccggcaggcgcagatcgtagctgccaccagccgccggcgcgattttggcggcaaggagcggcggttgtttcgccgaggcctcgtcctcccctaccggcgacaactcaaccgcaacctcgtaggaacgatgcgtcgtcgttccccgcgaccaggcgggctcaaaggaaatggtccggccacgcagcaagtccagcatgtatacgatgtcatgctcggacagcggcagctggcgctcggcgacaaagccgctgcgtgcaaaatcgtacgacgccgaacgcgaactcgtgatgtcatcgagataggcaactgtcgtcacgacaaggttgagcagctttgtcgacacgtcttcgaaggcttcgggcgtatggacaaacgtgagcttcttgccgtacgagaaggtgccgccgcgcacgtaggcatcggccatgccgtcgatgtccttaaccacgtaggagaccgatccacagcgaatgcgaagctcgagcgcccagctaaagtggtcggcaaacagtggattgtaatacggcaccagcgagggctccaacaccgccttgggggcatcgggatccacactgctggcgagcttgcggcgcatgctcgccagctcatccatgcgcgcgtccgaaagatcggagagcgccttcatgaggctcgggctcgtgggaactggcgccgggaagggaaagttagggttgaccgccggtgcggcagacgcaggacgcgcggcttgcttgggcgccgccgtaaacgtgcggaccggcgtgcgcagcccctcaacaggctcaatgccgctggcgtccaggtacgctagcgccgtggcgatggcgtgcttgcacatgccggggtagcgataggcagcggggcaatcgcagtcgtagtcgatcacctcctgctcgtccatgtcgagcgccacgtgcgtcttgtacaggtcaccgcgcgagccgcgcactgagccctcaaccgtcacgtttttggagaagcgcgagccgctgtcctcgatcgacagcacggcgccgttgagcatgagcgagcggcccttcataaaggtgccgctcagcgccgcctctttccggagcgcctgcacaaacgtcccctgcgccatcacttcctccaatctcgcaccgagtacctctcagcaacgccgtccctagataaccgtcacgcggccttggttacccacaatggccttggcctcggccagcagcggaatcgagcgcgcgttgaccttggcaggcacctcggcgcgcagcacgcgcccgtccacctgctcgataaagatctccacgcggtcgccgcccgggttagcggtgagcaccgtggccaggcgcgccatattgccctggctaaagcggctgttgggcaccatgacctcaaacaccttgggcttgttgttctcctcgttgagctcaagcggcacgatctcctgcgcgatgatctggtcgccgcggtccgagcgctcgagtttgcccttgatgcgcacaaaggcgtcggacagctgcgcaccggtctcgggatcgacctcgccgtacaggtacccctcggcctctttataggtcttggggaacacgacgacggtggcctcgccttccatgtcctcgagctgcacgatgcccatggggtcgccgtttttggtcacgcgcttggacacgctcgagaccatgccggcccaccacagcgctttgccctcgggaatctcctggttgatggtgccgcccgtaggattctgaacttcgtagccggtgtcgatctgcgagaacgagaagtcgcgcgctttgctgagcgcatactcaaacgggcgcagcgggtggtccgagacatagatgcccagaacctccttctcctggctcagcttaaggtggcggtcccattcctggccgtccggatcgggcacgctgacctcgaaacccgagccctcaacatcaccaaacatgtcgaagaacgaggtctggccgctcgcgcggtccttctggcgctttatcgcggcgtcgatgatgttctcggggttgttcttgtccacaaagtgcatcatctggcggcgcggatagcccgtggagtcgaaggcacctgccttgatcagcgattcgatcacgcggcggttggcctggctcgagtccacgcgctcgacaaagtcgtgcagcgtcttaaacgggccgcccgcctcgcgctcggcgataatcgcctgcgccacgccggtgcccacgccgcggatgccggccagaccaaagcgcacgccttccttggtagccgtgaactcggtgccggactcgttgacatctggcgaaagcacggggatgccgtcgtgacggcatgccgagacgtagtgtacgatcttgtcggtcttgcccgtgtaggacgtcagaacggccgccatgtactcgtgcggatagtgcgccttgagccatgccgtctgcataaccaggatggcgtagccggcggagtgcgacttgttgaaggcgtaggacgcgaactcgagaacatcgtcccaaatcttctgggcgacctcgcgcgtgtagttgttcttgatagcgccgttcatccagtggtcgtaggtggtctcgtccgagccatcctcccagtggagcaccgtcgacgtgagcagcttgatctttttcttagccacgggcttacggatacgcgagtccgactcgcccttggagaagccgcacatctcgacggagatgagcataacctgctcctggtagaccatggtgccgtaggtttcgcccaggatgtcgtccagacggtcgtcgtaggagacggccggctccttgccgttcatacggttgatgtaggacgagaccatgccggcgcctagcgggcccggacggtacagggcgatcaatgccacgacgtgcttgtactctgtgggcttcatgttcttgatcgtggccgtcatgccggcggactcgacctggaagacgccggcggtgtggccggaacccatgagcttaaagatctcggggtcgtcaaagggaatctcttcctctttgatgtcgatgccgaagttctttttgatgtttgccttggccttggagataaccgtcagcgtgcgcaggcccaagaagtccatcttgagcaggcccatgtcggcaacggtatggccctcgtactgggtaatctcgacgccgcccttggtgtcgagcttggtgggcacgtgctcgttgacggggtcgcggcagatcagaacggcgcacgcgtgcacgccctcgccacgggtgaggccctcgatcgagagcgccgtgtcgatgatgcggcgagcgtcgtcgtcctttttataggcctcggcaaaatcggggttaaacagatcctctttgccgggttgtttgtcgagcacctgcttgagcttgaccttggggtcgctcgagaccatcttggacaggcgctggcccatgtagaccgggtagtccagaacgcgcgcggcatcattgatggcctgcttggccttgatggtcgagtaggtgatgacgtgggtgaccttctcggggccgtagagctggcgaacgtgctccacgacctcgaggcgccgctcatcgtcgaagtccatatcgatatcgggcatctcggtacgctgcggggagaggaacctctcaaacatcaggccgttctcgagcgggtcgaacgcggtgatgttcatggcgtaggcaacgatagcgccggcggcagaaccacggccggggccgacgccgatgccgttgtccttggcccattgcacgtactcggcaacgatgaggaagtaggcggcaaagcccttgtcgcagatgaccttgtattcgtactcaaagcgctctttgatgttgactccgccgatctcgcgcgtggcccagtcgtcaccgtagtgctggcgcaggcccttctcgcactcgcggcggaactggctctcgtgcgtctcgccgggatcgagcagcgggaagcgcggcaggatgatggagtcccagtcgagctccacgtagcacttgtcggcgatctcgagcgtgttgtcgcaggcctcggggcaatacgggaacattgcccgcatctcctcctcggtcttcatgtaaaactccgagccggtcatacgcatgcggttggggtcgtcgaccttggcgttcataccgatgcacatgatgacgtcctgcacgggggcgtcctcgcggcgcaggtaatggaagtcgttggtggcgatgaccttgacacccacctgcttggcgatatcgatgagcgtgcggtccatctgctcgtcggtcaggccgttatcggtggtaatgccgtgttcctggatctcgatataaaagtcgccggggtcgaaggtatcgcggaaggtctcggcccatttgatggcaccctccatgtcaccgcggtcgatgtacttgggaataatgcccgcgatacaggcgctggtgcagatcatgcccttggcatgacggcgcaggttgtcgagcgtcacgcgcggcttgtagtaaaagccctgcacggcggcctcggagaccgtctgcatcaggttgacgtagccctcctggtccttggccagaaggatcatgtggtagagctcgggcttatggtcgcgggcgagcgtctcgtccggcgtaaagtagacctcgcagccaaagatgggtttgatgaccaggggcggcttgagctcgtcgatgttgcccttctcgtcccacatggccatgtccttcacatactgggcatgctcgcgcgggttttcctcgggatcgggctccaccagctcgtcgcggcggtccttttccaagaaggccttgtcgtggctccaggttttgtactcgggcgtgttgtggttgacggcgtcgcaggccagcgccaggtcgggcacgccgtacatgtagccatggtcggtaatggcgacggcgggcatgcccagctcaacggcacggttgaccatatcctggatacgggttgcgccgtcgagcatagagaaaacagtgtgattgtgcagatggacgaatgccatgtgatgagctccgatgcgggttcgtgttctgactgaacgattttaccccacggcacggacagcacccgaacctagccaaaccaacacgggcagtctttttgggaccttcaaaaaggggaatgagggcatccagatatatcgagtattactggaaccccggcgatgcgcggaatgatttgtgacgaatagtcatgtccatcaagaaggctcgacgcttcggatagctcgtcaatcgatatatcaattcttggagacctgtattccaaccatttttaatgaaacaacggcggtaattgctatcgcgattgcaccaataataccgagcgctatctgaatgggatataaccccaacacatgtccaaatatggagaaaaacactgcagaaaagagagcccttaccagagacgcgacggaaaggatcgtcgcgcggagatcgtccgctatcgcgtcttggattaagttttccgaagtgatgtacaccacttctgggagaaaacaaagcaccatgctaaggccaaacaaacacagcggatttgaagcgaaccacggaagaatcatgaaaaggccagcctcgattagcatcgagccgagcatggtatttcttttcccgaaacgcaatgagaagaaatctgctgcaatgtaggccgtcgcatttactgcataggatgcaccgaaaaagattcctattatggagacgggagcatcaaatgcgtcgaataccaactgattcaagttgtaataactcccatagaatccatcgagcatgcttgtgccgattagaagaagcaataccgcaaaagcggattctccaacacgccaggtttcgcgtctgaacatcttggccgcgtcaaatcttcccttttcagagctttcagaacgggtcgcttccgtcctctcaatgggatacagaaggaaaagctgcaggagatagaaaacagagacacatacgtagagggcgctccaagatacttgggcaatgaaagatccgagcacaatcgccattcccgtagcgattgattgcgcggcaagcagccgagcgttgatggtgaggaaacgctctccttgaccggcattccgggcaatttcatataaaagtgcttgttcggatcccgattgaagggagtaggcgagtgcctcaacaagggaaagcacgacaagaaagggacctgagagcaacagcatgccagccgtatggaagaaaagcagcagcacgcccacttgaatcgaaaacttctttccaaagaaatcgcctatcagccctgttggcagctcgaggacgaccgttgcaatgttaaacagggcttgataaagcgcgatttccgtgacagacattcctttctccgcaaggaaaagtagaaacactccccgatttaaaacaaatcccgcgagaacgaaaaaggcggaatagatgtgcagctgcgcagcggcattcttattcatttggcacttccatcaactacttttgtcgggccgctcgctactgactcgaagcctgaagtgttcacagttgatgtgaagagcggtaaaacttttgcacagggtatcaatggaatacatccgaagcgttttcggcagtatcatcggcgaaggcgggattagcctttacgcggcgctcaccctcgatatatttgacgatttgatcaatcgtctggttggcgtggctcttgagcttgcgctcatagaagaagaggccgagcttgccgcgcgtgccagacgtgttgccacccacaccctgaaaatcctcggtataggtgagctcgcagacaccatcgccagcaggtgcagcctcatagcgcatagtattgatgcccgccgcatactgaaaacggacctcatagagacacgggtagtcaaagtgcttgattttaaccttgatcgccatgcccttggccttgccttttgcggactgggcgcgcttctcgtacttatagccgttgagcttgttgcggctgggacgcttgcccgtggcgttctcgatatcctgcatgatggaccccgccagagcgtcaaaaagctcctccggcgtcaccttaagcgttttggtgagctgcatgatggctccttattcgtttgaaccgttcgagccattgtaccgccccaggctctcccatgcgttgcggtgaaatgcggactgtttggcggcttttttggccaaaacagtccgtattccaccgcaagttattgagggctagcggctgtaggtgaccacctgaggctcgcacgggttggcgaggtcgacttgctccacgcggacgaacttgacggtcacggcctcaaagtccgccttgtgcaacacgtcggcgtagacgcgcgcctgcagggcgtgcttctcctgcagctgttctggcgtctcgtccggtgtgccgcccgtcttgtagtcgattaccagcgcgcgtgacgaatccgccgggttcgtcgccaaagcgtcgatggcgccttcggcatatgcaccgtagcgggcgatgtcctcgtcctcgcagcccagcgaaaagaacggcacctcggcgcgaacgcacggccacgcgagcaggtcggcacgaacagccgacttgagccagcggtccagggcaacgtcaaagcgttcgcgctgctccggcgtcaggcaccacaggcgcgccagcgcatcggcacgcgcggcgggcagcgcatcggcacccatctcgatcagccactggcaggcggcatggaacgccgagcccagcgccatggggttgccggcgggctcaacggcggccacgtctgcatccgtcatctcggaaccatccgactccgcatcatcgccagcctcgtccatgggcacgcgtgcctcggcggcacggtcctcggactcggcatgcagcgccgcggcaattgacgagtagctgtacgaatcgcgcgccggatacgggcagatgcccattcgcacgcccaccgcctggggatacacgagctcaaacgcatcgggctcagggtcggcaggaccgggaacggcggcgcgggcatctgcaccggcgccctccggctccgcatcgccgcggacaagcctgccctcggcatccagcgaagcgttggcctcaaacgcctgctcgccaaaggtaaagtccgcgagcgaaatgagctcgtagtcgcccggcttggagttgtcgaacgtcaaacgatcactatcgagctgtggcatgtccagagcgtcggtcggcaaaatacggcgcagcacgtcgtaggtcagatcggtctcgacgtcgaaggtcggcgccgtcaccttgccacggctcacgccggcatccatcgccaagatcaccagctcgcgcgcacgcgtcatggcgacatagagcaaacgagcccgctcttcgagcgaaagctgcaggtcgtcgttgcgcaggcgagcaaatgcctcagcgggagaacccgtcgcgcagacgtcctccatgagctccggcggcagccatagcgacgtgcccttgcccttaaacgcatgctcaaactgctttttaacgtcgtcgcccttcacaaaggttccgtcggcgagcttaacgccgtcgaagcgtgcaggcagtgccacaacctgcgccccgccctcgacacgccccatctgagccgcaccggacgatttgcgcacgccaaagcactcggcgaccgccacgaccggatattccaggcccttggatgcgtgcaccgtcatgatgcgcaccgcgccgtcgccctcctcgttgagggcacccggggcttccttgcccgctaggaagcgatcgaaggcaagcgcgatggaacgcggcgagttgccgaactcggcctccgcctcggccacagcgtcgagcgccttgagcacgttggcggcaatggccttgccctcgggaccacgctgtgccagacgcacaaaccagccggaggcgttgaccacgtcgcgcgcgatggctgcgaacgaatcgcggcccacgcgacgaagcgcacaccgcagtacctcgcgggcgcgcgtcacgagcggcaggtcttgcaggcccggcacatcggaatcgctcatgatgcccacgtcgatattcctgcgcgaggtctcccccgtctgctcgtcgagcttggtcgccagcgctaggaactcctgggcgccgagcgcaaacatcggcgaggccagcagcggcataaggccctgcgccgtatcggccggattggcgagcgcacaaaccagggcgcgcaccgtctgcacctcggcggcttgggcaaagaccgagccgcccgcgatgacgcagtcgagcccctggtcgcggaaggcctgtgcgtagacgtctgcgttggtcatgcggcccagcagcagcaccatgccgccctggggctggccggcatcggcaagcgcgcggaatcgctccgcgattgcacgggccttggcctgtgtgcgctcctgcgtgctgccgccggcaacaaagagggcctggcgacgcgaggcatctgccaccagcgtgtccttgcggccgtcgctcgcctcaagatccaaaaagccctgcatcaggccgccgtcatcgccgtcgaagacgcgtgccacgtaacgcagtacctcgtcgtgactgcggaagttgcgcacgagtttgacgagctcgccagcaggggcgtcggtcacggcagtcgcctcgggcgcggcagacgagcccaccttgcgctcctggcggcggaagacctcgacctcggcgccgcggaaacgatagatcgactgctgtgcatcgcccacggtacacagcgcgcgctcccccgcacccgtcaggtagcggatcagatcgacctgcatctggtcggtatcctggaactcgtcgatcatgaccatcttaaagcggccctcgtatgccgctcggatggccgggtaatcgcgcagggcctcgtaggccatacacagcaggtcgttgttgtcgagggcagactggccggccttcagcgcgcgatactcagcctctacagagcgggccaagcccaccagcgcatcgagtgccggaccaccgcaagccagcacgatattgataaatgcatcggcggcctcggccttgagcagctcgacctgctccttaggaaatgccttgctcgcccgtggcatggtgcacgacatcatgagtcgcgccgcatcggccatggtcttgccgctcgcctcgaacgcatcgatggcgtcgagtgccacctgtgccttctcggtcgcggccttgctcgcacccagtgctgcgcgatatgcatcggcaagcgccgaggtgtcggcctgtccgcgcgccacatgcacgtcgtccatgccgcccggcagctggctcgagagctccagcagctcgcgcaccagacccttgatggtggtgccggcaccaaacggcccgccctcgcccgccatgggataccaggcgtaaagggccttgagcgaagcggcgagctcgggggcggcatcgggcgccgtcgcgcgggccagcacatgctcaacagcctggtccatgagctcgtcggtatcggtgagcaccgtgaactcgggatcgatgcccagctccaacgcgtgtgcgcgcaggatacgcgagcacatgccgtgaatggtcgagatccacgcgtcgtcgacggtcagcgcttcctcgtccatgccctcgtcgatgagcgcgcggcgcacgcggtcacggatctcggccgcggcgtctttggtaaaggtaatggcgagcacctggtccagatgctcaacgaacggaccggattcgggcgagagcgcgtagacgatgcggcgcgtgagggtaaaggtcttgcccgaaccggcgcccgccgagacaaacagcggacggtcgagcgttttgacgatctgcagctgttgcggcatcaaagtcgaaagatccatggtctacacgtccctccttacaaacgttccttcgtggttatacgagcagcgcgcatgcgcggcctgagccgacgtcgggtcgacggcggcaacgttgcctgcctcgagctcgcgcaggcgctcggcgatgccggcctccacgcgatcgagcagggcgtcgaagtccatgttgccaccctcgccggggaaacctttcttaaggcccgggatgcgaccgtcgccgcgctcttcctcgagcagctcggcgctcgcggcgccgcgcagcgccggcttgccgcccttggtcgaaaagtagagcgccgcgcgggtgtccaaatccagcgcccggcgcatggcctgagcatagatgagcgtttgggtatgtggcggcaaccagcgcgggtcgtcgatgggcgccgcgcccgattcctcgtcgcgcaccgtagggtcggcgagcttaaactcctcaacgcccgtgcgatgcttgtagtcgatcaccacggcacgattctcggcgtccacgtccacgcggtcgatgcgcccgccaagcggccaaccggcatactcaaccttgagctcgttaaaggcgaactccaggtagcgcggggcaaagggggcaagtgcctcggactcgtaggcaagcacaccctccagctgcggcaagatctcggccacctggcgctcctccaccgcagaaagcggcaccagcgggccctccgtgccgcgcttgccggcgtgctcggccaacgtctcgtcaaagacctcgcgcaacagcccctgagcgcgcggcagattctcgggcgtcacgcgctccatgccctcctggggcaggcgggcatgcagatgctccagcacatcgtggacaaagttgcccttctccatgttgccaaagcccgcgtcgatggactggggcttcacgcgatacgacacgaaccagcacagcggacacgtcgagtacgcctcgatctgcgaggcggacgtcagacgcggcacgagcggcgcgttctcgccctcgccatcgcggcgacgcaggaccaggtacggcacggccgcctcactcaaatgctgaggagcctcgcacgcgacgcgcttgcgcccgatgccctcgccggctgcagggtcaaaatcggcgacgataccgccctcgcccacgcacgcaaccttgacggcgccagtggcctcggcgtgcgcccgcagctcggtccacacggcagccgggtagcactcgcgcgcctggcgatcgtgggtcacgcgggcgagcgcaacggggccgcgtgccgcctgcatcgcgcggccaaagcgcacgcgcagcagggccgcgggctcaagcgtcacgccgctgcgccccagctcggccgtcagcgtggccagcgggccctcctcatgcgagagcggataactgtccaagtcgacgtcggcaaacagcacggcatcgtagctgtcggggcgcagggctgccgcatcggcaagcgacgtaaagcgcacctgggcgcgcggcgcgcggtcgacctcgtaggtctcgtaatcgtatgcggtgctgcgcgtgtccaccttggtacgaacgtcgtcgagcacgggcacggtcgcggcctgcgacacgtcgagcgcgcgagcatcgttcataaggatgtcgatggcatgtcgcagcagggcggtctccgcctggcgacgagcctgaccgtcaaggcctccaagggcgcgatcgggcaacgcctcggcgacggcgagcattgccttgagcgccgtcacgggtttgtcgcgccacagcgcttggaacacgtccgagaccacgcacggcacgttcttaaaccagttatcatcactggcggccttgcgcgtgcccctgacctggccctgcacgctctgcagcaggctcttgacggccgcggtggtcttgccgcgcgacaggcgcatgttcttgtcgaaggtgcgcgcgctggcggcgtcggcacccgaaagcggactgtaaatccagtcggtaagctccggcgcgggccaccactcggtcttggaggcggtgccctcgtcggcggccttcatgcgctcgatcagattggcgagcgccgtgaactgcccgcccgcgatggattgggaaaacgccgtgaactcggttgtctcggccgcaatgtgacgcgccgccaaacgggcagcgagttcaccgaacagctggggcgcccgggcagacaccacgagcacgcgcacggggtccgcggacgccgcgacaccgccgtcgaccgcggcgtcctcacacgtttttaccagctcatcgattgcacccacataggcgtgggcgcgggcgtgagggccggcaacctctacaaaggtaggctgagtggcgggcttggaggcagtctggggcgcagcggcaccctcccccagcggcgcagcctcaaacatcacaccgcgggcatcaaaggcggcggcaagctcctcgcgcatcgccgtctgctcgcgggcaagcagcacaacgacctctcccccgttattcgccacggcagacagcagctcgagcaagccgtgcgtaaacgttgtgatgccgcgcacacataccgcgcgggcgcacgccggaaggttgtcggccagcacctcggccataaggtcagccgcctcgcagggctcgaccatgtctcgacggtccaagccgctcgcataggcactcaacagctcgaacacgcgagcctcggcgtcgctcttgggatcgtaccggcaaacgtcgccgcagcagcgctcggcacccgttcccgctacgcccggcagcacatcgcgggccatgcgcgcgagcatgcgcaccgtgccctgactgcgcgaaagcggctgcaggtcggtatcgccgcgacgggcgatcatgtccgagaacagcatctggcgctgcatgttgtcgacgaagctgcggccatcgcccataagctcccacagcgaacgaagccacgacgcgggggttttgtagtcaacgcccagcgaggcgccagcaaccgcagcatcgtgacggcacacgtcgagctcggcaaacgagggcgccagcaaaacggcacgcccgtggcgggcaaccaggtcggcgagcaacgccgcctcggcatcgctcaagtccgtcccggtattggtggtatagattcgaacaggcatggtcctccactcaaaccgttcgcaataatcaatgcatccatcctacccgcccgcgcggacagatttgccccacgccaacagatttgatcccttggggacggaggaaaacggatcaccgagggggtcagtctaacccggtgacctgttttcctccgtccccgagagatcaaaaaaccgcccccgaagggacggttctgcgcaattcgtttgttgccgccggcctactcgccatcctccagtttgatgaggatcttgcgatagccaccgtactcgccattaagcgccttggacacgcggctcaccgtggtggacgaagcgccggtgcgggcctgaacctcaacatagggctcgccctcatccagataacgcgcgacctgtaggcgctgagaaagatcgcagatctcgcgcggtgtgcagatatcggttaaaaacgcctggatatcgttctcgtcgtccaaaagactaaatgcgtggaccagctgcttgacatcaggcttgtcaaacatgttctcgatattcatcgatcaccgccaaacccgccataaggcatcgaagttgatactgacatcgggcatcgttcgcccgtaaatatgcaataaaactatgcatgggccatttgcccgtagcagtgtagcacaccaccaaactaaagtgacaagactctctgtcagcggcacgtttttcaggacgaacgccgtttagaaaccgaatgcgcacgtaagctccacgaatatttgagacaatgggcgcccaaacaccgcggcgcgcccgcgcaaccatccaagtcgccgccgcaagccgcttcacgcgacgccagcaaccccggcgcaagaaaggattcacgccatgcgctttatgcttaactggctcttcacctcgatcgccatcgcgattgccacgttcctcgtccccggtatccaacccttcggctttgccgaggcctgggtctgctttgcctttgtgggactgttcctcaacatcgtagattcgttcgtcaaaccgttcctcacggtcatctcgctgccgctcacaatcattacgctcggcattttccagctcgtgctcaacagctttatgctggagctcgccagctacctgtcggtcaacctgttgggcgtcggcatctccatcgccggctttggctcggcctttatgggcagcatcctagtgtccatcatgcgcagcatcctcgatagtattgccgaagagtagaacacccccgatacacagacgcatcgaaccaaatcaaaggccgcccatcgcaaaaaatgggcggccttcttatttgccaagtctcagagggcaagaaaatctaccatttccaccccgtccccacatggcaggcgtgggttagatgacatagtcgtagccatggttgggagcgacaagttgatcgagcgtcacaccgtcgaggtagtcgttgatgagcttgtccaggttcttccacacgtcgagcgtggggcactcatcagatcgcgagcaacccttgcagtcgccatccaggcaggcgaccggcgccaggctgccctcggtcaggcgcaggatctcgcccaccgtgtactgctcgggcggacgcgtgagcacataaccgccgcccttgccgcgcatgcccgagagcatattggcgcgcacgagcgtagccaagatgttctcgagatatttctcggaaatcccctgtcgcgccgcgatctctttgagcgggatgcgaccagccgcctggtgctcggccaggtcaaccataacgcgcagggcgtacctgcccttagtagaaaccaacatatatagtgctgcctttcggtcttttagtccgttgaaattctagccgaaaaatcggctttggaaatacccgttccggtcaagatggttaatcgactcgtaataatcttctatttcctattgcattactaggctttagtgtctactatgcttgccaacagctaaacgaacaacctataaggtttatgggtttagctgctagacacgccgtaaaaccacacggcaaccagcaacttgaacactttggaggttcaccatgagcaaggtttacacgtccatcgatcagcttatcggccacaccccgcttctggagctcactcactttgaggccgacgaggacctcaaggctcgcgtgctcgtcaaactggaatacttcaaccccgccggatccgttaaagaccgcgtcgccaagaacatgattgacgaggccgagaaggcaggcaagctcgtgcgcggcggcgactacacaatcatcgagcccacgagcggcaacaccggcgtcggcatcgcctctgtggccgccgcccgcggctacaaggtgatcatcaccatgcccgagaccatgtccgtcgagcgccgcaagctgatgcaggcatacggtgcgcagcttgtgctcaccgacggctccaagggtatgaagggcgctatcgccaaggccgaggagctgcagaaggagactcccaacagcatcatcgccggccagtttgtgaaccccgccaacccggccattcacaaggccacgaccggccccgagatctgggacgacaccgacggccaggtcgacattttcgtcgccggcgttggcaccggcggtaccgtgaccggcgtgggcgaattcctcaaggagcagaaccccgagattcaggtcgtcgccgttgagcccgccacctcaccggtgctctctaagggccaggccggcccgcacaagatccagggcatcggtgccggctttgtgcccgacgtcctcgacacccaggtctacgacgagatcatccccgtcgagaacgacgacgcctttgccaccggccgcgccgtgggccacaaggagggcgtgctcgtgggcatttcgtccggtgccgccgtgtgggccgcactgcaactggccaagcgccccgagaacgagggcaagaccatcgtggccctgcttgccgacaccggcgagcgctacctgtccacggcgctcttccaggactaagggcccgtcacttgtcgataggcccaaggcacgccggtctaccctctcttctggccgcctgagcccatctcgttagggtgtcccacacgacgcccgaacttgctacaatgtctgcggcgcggaaccagcctcccgcgccgcttttcttttttggccacatgccaccaaggagaacctccccatgcacaacaagcgcgtgctcgtcgccatgagcggcggcgtcgattccagcgtgaccgcgtacctgctcaaaagccagggctacgaatgcgtcggtgccaccatgcgcctcacctgccccgcacccgaccccgccacgggcatgagtaaggtcggccgcgacatcgccgacgcgaaggcggtcgccgagcgtctggggataccccatcatgtgctcgacctgcagcagaccttcgaccgcagtgttatcgagcgctttgtgaacgcctaccaggaggggctgacgcccaacccgtgcattatctgcaaccgccacattaagtttggcgcactgctcgatgcggcgctggacatgggctgcgactacatcgcaacgggacattacgccaaaacaagccaggcggcagacggcacctggcagctacatcgcggcgaggaccccaaaaaggaccaaagctactttttgtattcacttacgcaggagcgcctggcgcacacgatctttccgctggctggcctggacaaagagcgcgacgtgcgccgcatagccgccgagcagggctttaccaacgcccagaaggccgaaagcgaggacatctgctttatcgcggacggtgactacgcaggctatatcgagcgccgctgcggacatgccgctgcaccgggcgacattgtgtggcgcgacggcagcgtggtcgggcaccacaacggcgcgctgcgctataccatcggccagcgcaagggcctgggcgtcgcgatggcgcatcccgtgtatgtgacgggcgtcgacgccgccaacaacaccgtgcatctgggtgaggccgaggacctgaccgccgctgccctcacggccgatgagtggatctggagcgcgccggacgcacgcatggaggcggagctcgacgccggcggcattcgcgtaggtgccaagtaccgctaccgtcaaaaggaccaggcagcgacccttacgcgtgacgccgacggacaaatgctgctaacttttgacgagccgcaacgagccatcgcccccggccaagccgtcgtcgtctatcgcggcgacatcgtcctgggtggcggtacggtgaccggcgcacttaagtagccgcaggtttatcgctgcacgtgtcgaagcacctcaacagcggcactaacctcgattacgcgacgctcgaggccgcggcaaatggcctcgagtcgaccctccgccgtcgcccattcgctctgcgaaagaatctcgatcgcctcatcaacaaatccgttgagccgcgatggatcgaaccaatcgagcgagtccgcaagcgccagctggacggaagagtcgggcccaaacggcttagtggaaaacccaaactccccagctgcgagcacggcagttggtacgttgtaccacaggcagttgccgctatcgaacagcggagcaggccttatctccagggtgtcaacattgcggatgatgccgaagtttcgccaatggcggtcgctgttggccaaaagggcatcgcagacaatcatctgcgacatagaccttctcacagcagcctcatcgacaccatgcttaccaaggaagcggcagtaccggtcgtatgtcgagtttccccgctggctaccaagtgcgcctttaacgtaaacagccggaacgtattcctcgcggccgtcaagaaagtcgtcgcacagacacacagggccatcgaacatccgctcaaccgtataaggaacaaactcgccctccgacagcaagcgacgatgtagagccgttgcaaccgcctcgttaaagggccgttggtcgtccatgccgcaccccttgaccagaacgcgaacaccgttgcgaatcatccacgatttagggagctcgccctcggacgtgttgtccggatttttaagaccgatgccttccagccaacccgaacgcccctcgggcgccgatcgctcaaaatcattctcgaagtaattgaggttttgccatttgagttcgtcgcaatcggccggccgcagccaataacaatccgaaagcgataggcccaggcaccgaaccggaacctcgatgccactggcaattcccagttcacgatagcgcgagacgagtccagggcggacgtcaggcaccgaccgatggctccaccacacgttgagctcccgtttattcaccgtaggagaagagctcgagcacgtgccaaacggcatcctccgcgcatcgagtacctcggcgatttcgaagggaaactcacgcgtcggatcaaatgagacacgcgcaacctcgtaatcggcggacatcagcgtaaacttgcgccccacatcggccgcaggacggcgtccacgtttgcggaccttttgataagcgaccgcggaattgtactcgaccatcttccgtccgcccacaatatcgcacgcgagcgttcccgatgcggcaagttgagatatgcgggctttcgtaacgcccagcagacgggcagcatcacccatagacaagtactcagacgtatccatacaccgcatcacctcgttaagtaatttaaacgtttagttaatagattacatacatcatgatactaaacgacccaaagcgaaaaaaggcccgagaaatcgggccttagcgattggtcagccgagtcgcaagctactcccctagcgctgaacgtaggcgcgaaccagctcgtaggtattgcgcacgccgtcgatgtggctgcgctcgtagttgtggctcgcgtacacgccggggccgatcagaccatggcgaatgtcgtagccggccgagagcgtggcctcgacgtcggagccatagtgcgggtacacatcgatggcgtaatcgagctccagctcgcgcgcgatgttagacagcgtggttaccaggtcgtagttgtacggaccgcccgaatccttggcgcaaatcgaaaccatgcgctcggtgcagcccaggtcgtcacccacgcagcccatgtccacgctgatcatctcgcgcgtgtcggccggcacaaaggcaccgccgtggccgacctcctcgtacaccgtaaagagcaacgaaaccttgcgcgaaagcgtcacctcgccttcggcgacggcgcgggccaaacccagcagaatcgacgcggacagcttatcgtcaaggaagcgactcttgatgtagccgctctccgtcaccgtggtgcgcggatccatagcgatgatgtcgccggtttgaatacccagctcgagcacatcgtccttgctgtcaacgttctcgtcgagcaggatttccatgttcttctcgatggtcttgaccggctcatcggccacgtgcgccgaaggctcggtattgaggaccacgcccgtgtagacattgccgtcgcgcgtataaacggtgcagttctcgccatcggccgtagaccactgatgcccgccgagagtcgtggggcgcaggcgaccattgtccttaatggagcgcaccatggcgcccagggtatcgacatggctcgccaacacgagcggctcaccctcaccaccaagctcaacgagcacattgcccttattggagcgctcgggcccaaagcccatatcgcgcaacgtctccatcagataatcagtcgccgcacgggtatagcccgtaggcgaagcgatagaagtcagcgccttcaactggtcagtaatataggagagcgtagaatccatcttggacaccaaagtcaccctttcatatcgaattaaacccacagcaacgataccaccgcgaaccatctttttacctagcgagatgacccattgagttcttcagaactgcgcccgccacgataacgagccggcgggccccctgcccgttagccccacaatctttccgcaggacggaggaagcccccgccgcacgaagtgcgcagcgggggcttccgacatgtccgaggacgattgtggggctaacgggcaggggcccgccgaaccaagttaggcagccgggcagatcttcttgaagagctcgatgacgtcgtcgagcgtcgcctcgcgcgggttgcccgggaagcaggcgtcggccatggcgtccttggccaggacctcgatctcgtcagccttcatggcctcgcagacgtgcgggatgttcacgtcggcagagagctgcttgacggcggcgatggcggcgtcggcagcctcgtcggtgctcatgcccgtggtgtcaacgcccatggcgacggcgaccttggccaggcgctcggcgcaaaccggcttgttgaactccatggcgatcggcagcagcatggcgcaggcgacgccgtgcggggtgtcgtagtgagcggacagggtgtgagccatggcgtggtcgatgcccaggccaacgttggagaagcccatgccggcgacatactggccaagagccatgccctcgcggccggagccgggctgaccggacttggcctcggcgacggagtcgcgcaggttctcgctgatcagcttgatagcctcaaagtggaacatgtcggaaagctcccaagcgcccttggtggtgtagccctcgatggcgtgggtcagagcgtccatgccagtggaagcggtcagaccggcgggcatggaagccatcatgtcggggtcgacgacggcgacctcgggggcgtcgttggtgtcgacacacacgaacttgcggaccttctcggggtcggtgatgacgtagttgatggtcacctcggcagcggtaccggcggtcgtcggcacggcgatggtgaacacggcgtggttcttagtcggagcaacgccctcgaggctgcggacgtcggcgaactcggggttgttgatgataatgccgatggccttagcggtgtccatggaggagccgccaccgatggtcacgatagcgtcagcttcggcggccttgaaggcctcgacgccgtccttgacgttctggatcgtggggttgggcttaatctcggagtagaggctccaagcgatgccggcagcgtcgagctcgtcggttaccttagcggtaacgccaaacttgaccagatcggggtcggagcagacgaaaatcttcttgtagccgcgacgctggagctcgccggggatctccttgatggcgccggaaccatgataagagatggtattgagaacgaaacgattagccattgatagcctcccatcgtgtgcggggcacccattacgccccacgctatgagtcccatcctaacgcttttgaaacgaaaaacacgtgagaacgtcaaattagttaaagcgtttcaacatgataacggagtcctagaccttccctcccgacagcagcgaaggctagattatagaagcaatcgcccaaaggatacgaccactcagtctataaattgtttctgttttagcaatatatgtttgacaatacgtttataaatggttaccttatagtaaacatcttagttcactaaaataacattagtgaaatgaaaaaggcggtagagatgttagttctacccataaagaccctcttgggccactacatttatgatgccaatcgaaacgagatacttgcagtaagcaaagatctcttcaattacatctcagaagtccaagcaggcgaagtttgccccgactcctataaatcagaccaagaattccagttactacaatcatgtggctactgctgcgattcgccattgcaggatgtcgcttatccatcaattgaccttttgaaagttaagctggaaagaaatttacggatgataacccttcagctgactcaatcttgcaacttccgatgtgattactgtatctattccgaaaactccttatacaacagaacccacagtcataactctatgtctgtttcgacggccaaacatgcaatcgaattctttaagatgcactcgattgacaacccaaacccggtcgtagcattttatggaggagaacctctccttcgatttagtgaaattaagctaattactcaatatgcagaacaggaatttgaaggaaaacacatctcatttcgaattacaaccaattgctctcttttatctgaagatatggttaaattcttcttcgattctggacatgaattctatttgctaatcagtcttgacgggccgcagcaaatccatgataagtctaggcattacgctaatggtgagtcctcataccaagcagttatagacaatgttcatatgattttagacaaccatcctgaacgcaacaaatatattcattttaatgccgtagtcgacacgaacaacatctataaaacagtctcttcctttataaatgataaggatatcgaggcttgcgatgttcaattcaactacttggaacgcaacggacgtatcgccccctacaatgacaagttctcaagtcaactgaattacgccttatttaaagcaagaattatggacgagcgcaagatcgaaaaaggaaactgtagcgataggctcgcttcatatacgcttgcaagcatcaaccaaaacattaagcgatttgcaccttcgaacatcccaacaaaagctatacccggtggtccatgcgagccaggagttacgcgtctatttgtgacaacagcaggagcgcttcttccttgcgaaagggtcagcgaaacaaccaaggacatgtatatcggtacattggattcaggatttgatttaggtcaaattgaaaagatgatcaatgtttcaaagctgaccagcgattcatgtaaaaaatgttgggcatttcagctgtgcactcaatgcattaaaagcgcagattgcaaaggagtaattagccctgattacaaacgaacagcatgcgacaactcaaaacgaattgcctttgatcgacttaatcagaaaatacttcgctttgagcttcatagacacgaagtgtccattacaacggctcttaaaaggaacaagcgataataatcatgaagacaattggacttatatctttcacgggagctgactatcctcttctaattggattgctaggagttggctacaatattcgggtatcaacaccatgcggcattctgccggacggcgtagatgttgccaaccttgttaattgcaaagaaattggcataagaaatcgaattaactatgtaacgacaatcgatgaatcagacctggttgtcgttttatcgacgaaagaaagcgccacaggactcatagaatttagtaaacacgctgaaacctatgcacattctgtaaataagaaggttgtcagtcaactcgccactgaacaaattgagtctagcaaaagcgacatgcaggaattagccctgataccaaaaattgttgtcgggaatctatatacacccgccgattcaacaattacgtttagtagcatcgttagcgagatgagaaagcaccatcccaatctatgcgctttgagcttcaatcctttaaatgaaatctggggctgcaacacccttagttttgatggtggccaatccgccgtcatcaaaatgaatgagcagatcaacatcatcattgagaatgataaatccgacctagctctattagaaacgcccaatgtgcttatgaaatacgacgaccacatttacggagattacggattaggatcgattgctgcatgtcgagctttctgccctgacttggccattatcaatatcccatacacgatagccgactacgacataatgcttggactcatgcccataattgaaacgctaacgcaagcagagaaagttcaatttgaaattacaaacgaagtacttgacgccactgaagggttggagacgcataggtttcaaataagctattcatctagcgataaagcaattcaagcagcaagagaacttcgactaagaggaatgccctgtttctcagccagcttagatccagaagaatcattactatgctgcaaaacaatcgagaacgagttgtttgatttcgatattggggtgctgaaatgacagcatatcgtaaagatgaaaccatctacgcagaaatcgaaaaagcgataaacaatattagagatttggatttgactcaatttgaccaaaatctaagaaatcagcaattgaccgacccgccattcaacttgtcctcatcagatttagttcgactgcttatttatcttgaaagcaggttttctgtttacgttgagtactcgtcgattgaaaacctagggttcaacagtgttgaggaggtgaagaaggtaatagaacagtcagaaacaatcgaacaatgggaggcagatcatgagaagtattcgtccatttaacatgcatgcagtaaatagcgtcattcattttgttagaaattgcccatgcggttattgcagctgcatgtactgcaacatactgcgcaattctccgcacgaagcagaagtcggttccaattcgatcgaggcgatgacgcgtggtggctactggtcctaaatcgagcaagacggttacaaacgaatatcgaatctcaattgaaggtaacccttatccgcatgctctagctctcatcaacccagccggagacaacctcaatatcaaaagacatgggttcacgggtccactaggacagctattgagtctaaaatataccgtttatgacgatgcaaatgaaaaactctttactgtcgtcgacggtggttttagtaacatgcccagggttgcgctcatcatcgaacacaaggaagttgcggtgttcgattatggcctaaacagacttgagatgaagtgcgtaacgaacataccgaattacacaataaaaggtaacttcctatttggggattacgacatattcagccaacgggaagtgaagctatcttcagttatcgtccttcaatgtgataaacaatcgtgctttagcatacaggttttggataaagccgaattagccgccgcaattggaatacccacagccattgcccttctgagggctcggattgaagagcatctcgaataaatcgcaaaaagcagttcgtagcaacgttcaggagctagatagttttttctggctcctgaaactgtattacatagtccgcaaattgttcgaaaccatgtccatgatccgcaatgatgacgattcgctctttcatctcctgcgcaacaaccaccttcaaaaaggatatcgaagcattatctaaattgttgcaaggctcatccaaaataacaatagaataactgctcagaaaggccctacaaagtaatagagaagccagttctccgccagacaaattgtgtcccctagctccaatgatgggatttgattcaaataatttatcgaggctaaaacccctcaaaagatagatgagtttttcagagtcaatatctacaagaccatagtaaagagccttcctgaaagttccccccattatcaaatgtctttgcggcatagttgcgcagggtagctggattaaagtcgaaccatcgaaaatgacagtagactcattaacacacagtctgccagcaactggagacaataatccattcaatacttccagaaatgaagatttaccgcatgcattagggccgcttactaaaaccagacaaggtgcctgtatcgtgcaatctggaattgttatcctctcattagtttcgttcgacgaaaacgagagactgattcctttccaactaattcgatcagcgtgatcgaagcatatcaaattaggtttttcagcttccaaaagacgacgtaattccaagacacggtgcaacgatctaaacgacggctgaagctgagcccaacaattcagaacaagaggaaaaggagaatagcatagaagtacaagttgataactctgcactgcaatcccgaccgtcagcccgcgctttaacacaaggaaaataagcagcagaactgaaagcaagccagtaatgatgttgccagcgtcaactatttcagttgccaatctcgcaaagacgctctcctcaactcgagagttcctgcaggctttaagcatctttttatagtgaagtaattccaagttaattgaacgagaaatacgaatgtaaagtcgacaatttattagctgggctaaataagcagaacccctcgcctgggcctccaatgccttttcgctcttagtcgatagcttactaagagcgaacggatatagaagcgaaataaacaatgccgaaacacaaacaggaatcaaaagcaacatagagatattagatagcgccacaaacgataccaaacccgtcactaggcacggaagaaacgcagttgtaaatattccaatcatcggctgtaggttcccggcctcttcaatgcgcgataacaggtagtcactgtcttttgctaaaactaagggccgctctaaagcatggcgggcaagcaatctatagaagcagttagcaccatcggaagccaattgctccgcatattttgatctgaacagatttgtcaccagctcaactgagagcaatactagcaggcctaacccaatgcataaaacgttgcgataattagagcgaagcaggccatagtctattatcaacgattcagctttaacaacagacagctccaccagggcagataaaatgcagagcgccatcaacttgattactgtcgtcttattttgaataaaaagctctggcatatgtccatcccctcaactaataattatagctagaaagatgacatttttattctatagccttaagcagcacgctttgctgacgtcaaatcttgtcattacaaacatgcaccttaggcttaagactcaaaaaagggcggctgagatggccgtcccctccccattatcgatctatctgacaaagggacagcccctttgccgcattcggttactttcggcagccctctttccaagcctcggccgcaaccttccagcgtaagcgcaagtcgcgctcgcggtcgatgaacatgatggcaaacgcgacaaacagcagcaagctcgccacgacgatggcgtgcaggcccatgcgctcaatacaccagttgcccaacacagcgccaaacacaaaggtaaagatcacgccaaagtacagcaggccgttttccaaaaagccgcgcctgtgggtgatgatgtaatcgtccacgttttgcagcgcgttgcgcaagttgccgatgcacatggtcgtagcgatgccgtgaccgtggatcttgcggaagctctcgacctgcatgccgcaggcaaacgaggtgaggcagttggcgagcaggttgaaattgccgcccgggataaagctcacgcccagtaagatgacggcttcaaagaacaccgtcacctgacgccagtggatcacgctgccaaaccgctcgtgtaccagatcggcaagcataatacccacggcaaacgacaccacagggaagaagtagcgccccgcaagtgcccagttgccctccgagatgctcacgcccacgagcaggatgttgcctgtctgcgcgttggcgaaaacatggtcgcgcccaatgtacgaatacacgtccataaagccaccggcgagcgccaagatgatgcccagctcaatagactccgatatctgtttggcacgctgcatcgtcgtgcatcctccttgttgacgactctctcgtgcgttggcggaaacatagccgccgttcatactgtaacccattgacaacatggcgtgcgcgcgagacgaccccttcgacacagggatacacagtctggaaacaaacgacacccgcatcgacgcgccgatccgccagcccatgtactccaccagtctttttagccccgtcccaaaaagactggttacaattacgtgcagcatacaaacaccgggagggatcgtggcaaaaaagcctcagtacgctcagaacaaccagcgcagtcagcagggcaaacagggccagcagcaaaagcgcggcggcaaggcccagggcggccacgccactcataccccggcagcgcctgcccgtccctggcgcccgggccgcgacaagttcctccccgtcagccgcgccgatatggacgcgcgcggctgggaccagtgcgactttgtctacatctgcggcgacgcctacgtggaccaccccagctttggcatggccatcgtcagccgcgtactcgacgcgcacggctacaaggtgggcatcatctgccagcccgactggaccgatcctgccagcatcagcgtgctcggcgagccgcgcctgggctttttggtcagcgccggcaacatggactccatggtcaaccactattcggtgaccaagcaccgtcgccataccgacgcctatacccccggtggcgaggaggggcaccgccccaatcgtgccgtcacggtctacggcaacctcatccgtcagacgttcaaggacgctcccatcatcatcggcggcatcgaggcaagcctgcgccgcctggctcactacgactactggcaggacaagctcaagcgctcggtactgctcgactcgggcgccgacatcctcatctacggcatgggcgagcacgcgattgtcgagatcgccgacgcgctcgacgcgggactgcccgtcgatcagatcacctatatcaacggcaccgtctaccgcacgggttcgctcgacgaggtctacgactacgacctgctgcccagctgggacgaccttaccgccgacaagctcaactacgcacgcagcttcaatgtgcagcagcagaatatggaccccatcaccggacaccgcctggtagagccctaccccaacagcgtctatgtggtgcagaacccgccatcggcgacgctcaccaccgatgagatggacgaggtggccgagctcccctacgcacgcgattggcatcccgactacgacgcggcaggcggcgtgccggcctttgccgagatcaagttttccattagctccaaccgtggctgttttggcgagtgctcgttttgcgccctcaccttccaccaggggcgcgtgctgcagatgcgcagccacgattcgatcatgcgcgaggccgagctgctcacgcgcgatcccgagtttaagggctacatcaacgacgtgggcggaccgacggcaaactttagccgccctgcctgcgacaagcagctcaagcacggcgtgtgcaagaacaaacgctgcctgtggccgagcgtatgcaagaacatggtggtcgacgagagcggctacacacagctgctgcgcgacctgcgccagctgccgggcgtcaagaaggtcttcgtccgcagcggcatccgttttgactacaccatggccgatgcctcggacgagtttttgcgcgagctgctggagcaccatgtctcgggccagctgcgcgtggcacccgagcacgtgagcgacgcggtgttgtccgtgatgggcaagccgagccgagccgtctacgacgcgttctgccgtaaatttgaacgcctgaaccgcgaatacggactcaagcagtacgtggtgccatacctgatctcgagccaccccggctcgacgatgaaggaagctgtggaccttgccgaagccgtgcgcgacatgggctacatgcccgaacaggtgcaggacttctaccccacgccgtccaccatgtcgacgtgcatgtactacaccggcgtggatccgcgcaccatgcagccgatctacgtggcgcgcgacccgcacgagaaggccatgcagcgtgcgctcatccagtatcgcaagcccgagaactacaagctcgtgcgcgaggcgctggaaaaggctggccgccgcgatctgatcggctacaccaagcattgcctgattcgtcccgtgcccccgcgcccgggcgagacatctgctggcggtgggcatggaaccggcaagaagggcggcaaaccacatggcggtggcgctggcaagggacccaaaggcagcaagggccacggcggcatgtcgcgtgcgcaaaacaccgcaggtcgcaatcgcgcggcccagggacggcagggcgccaacggaggcggcaggcgcaactagggcagcggtgcgctcgctgcgtccatcccacacgcgtggcgcagcgagcgcattgcctcaacgaggatgacgccggcgatggcgaccgtgaccaccacgtcgagcgaggtgttcacaaaccagagcaacgtcatgagatacgacccggcattaaaggcaaagtgcagcaggatcgtgtagcggagctttccggtcgtcacgagcacccaaccaaagatgaggccggcggcacccgcgtagcaaccttgcacccaattcatgtgcataaagccgaagattgccgcctgcagcacaatcgccgcagcgataccccacgtgcttggggccgcccagggcaccatggcgccgtcctgcgcgctcgcacgacgccggcgcttccaaagtgggcggcactgcggattaaacgctcggagcgaaaactcaaaaataatgccgcgcaccagcagctcttcacaaaacggggcgccgagcaccgtggtcaggacggcgagatagctggtgtcgcccatgcctgtttcctcgacaagctcgctgtagtcggccgcggcatcgggcaacaacgacagcgcggcgtcggtcacgtagccaacaaccacctgcagggccaggccgatcacgataacgcaggcgatgcgtttccacgccccacgcgctcccccgccgagcgggtgctcgctttgccggcgtgccataaacgaacgcggccacagataacgccaccacagcagcgccatcaaaaacgatgctgtctgcgcgacggcctgaagcaattgaatgtcgaggtcatcgatcgaaaaacccatgaacaccgatgcgacgccaagggcggaaaacaaaacgacgctcagggcaatatcggcagcgacgacgccaaaacaggcaagcgcccaaatcatcgcattgagcatgccaacctcctcccgacgactagtcattggggacgttcttcaacgactagctgttggggacactctttgccaaaggccccgctgggcgagatgtcgaacgggaaggtgccgcagcgattgaacgcggcgataaacatgcggatggcgttggacggcgtggtgcccacgagctgggttgccgccgcgaaggctgccttctcctcgggcaagaccttcgcgactacgggggtcatgtgttctgccatggcgcttccttttttgaaacgacggtagtgcggatagatgcgggccacgcggctgggcgacgggctgtgaaggcaacccgattggcccgcatccggagtttgtttctgcggcgttggtattacttggtattcctaagtattaccccgcagatagaataccacacccgaccccatggggacggaggaaaacgaatcattttgttgctcagttagtatttagagcgtgatgatgtccgagatatcgagggcctgaacgtcgacgacatcgtgcgtggcgagcaagagcgtgcgaccgtcgagcaggtctagcacggcctcggccgtcgcatcgcgcgcggcggcgtccaggccggtaaagggctcatccagaatgacggcacagccgccacacagcagggctcgagcgatctcgacacgacggcgctgcccgcccgaaagctcagccacgcgaacatgcacgtcgattcccggcaccaaccggcgcagcaaggtcgtagcgttcgaagcatccacgcgcgcatcggcacacaccagcacgttatccaaagccgagctgccctctaccaagcgtgcatcctgaaacaccatcgagcacggcgcgcactcccccgctgccaacgaaagcagcgtcgacttgcccatccccgaagcgcccatcacgcagatacgcccacccgcaggcacgttgagcaccagaccatccagcgccggcgcccagggcgcacgatcgcccacggcaagcgcaagctccgctgcagtgccatcgctcgcagtccccgcacgcccgcacagtccatgcccatgcgcccgcacggccgcgcgccacgccacgggtcccgaaacccgcagcagccacaccagcacgcgctcacacgcccacgaggcggtaacgaccagcacggtccacgccagcaaatcagccgtctcaatcaaaagctttgcctgatagatgcgctcgcccacggtgcccaccgccatgccgatcagctcggctgccacgccggccttccagctcatgccgatcacggcgcgggcgcacgaaagcacaaacggcaggacttcgcgccaggtatgggcgcaaaacaggcgccagccgcgcacgccatgcagacggaacatctgctccagcggtttattcacctgtgccaagccctcggccagcgaaaaatacacgcccggcagcgccatcaaaaagaccgcggcgatgctcacgcgcgccgatcccaaccaaataagcagcaggaccaccacgcaggcaaccggcgtcgccttaacaaacgaaagtgccggagccaccaggcgcgcaaacgcccgcaaccgtgacgaaatcccggcaagcacgccaccacacaccgcggcaagcgccagcccgcccagtatccgcgcgcccgagcccaccaaaatcgcccaggtaccgccatcgcacaccaggcgcagcagcgccaaggcaacagcacccggccccggcaagatcagtggctgcgccaccagcaccgccgcgaagacccacacggcaagccaaaaggcggcgacggcacctgctgccgccaccgccttcatacgctctgtcatgtgtcgagcaaacgcacgcacgggctactccatgtagtagaaatcgtcagccggaagtttaccacccacggcgctcgcgtccgcgtcggccagcacctgcagatacccactaagtgccgccttcatatccttgcccgtctggcacacaagcatgcacccgggaatcgccttctcggcaatcttggcgttgtccacgatgccagcatcgaccacggcctgcgcccagtctgccggcgccgcattgacggccttaacgctcgccgcatggcagttcaagaactccgccacggcctcgggatgttcctcggcaaacgcgcggcgcaccacggtcacacccgtcagcaggcgcgaacccgtgtcacctgccagctcatcccacacatcggtcagacttaccggcgccgacagcttgccttcgctctttgcgatggcggcggtcttgaacggctccggcagcacgcccacggcagacgggtcggcaagcagggccgacagcacctcggtgggctcgctcttaaactcgagcgtcacctggccggtcaggcccgcgcgctccagcaggaagttcatgacgtactctggcgtggtgcccttgcccgtcatgtagacggtgcgacccgccagatcgccaaacgaggccacattcgcgtcgcccgtcacaacgttcagcacacccagcgtgttgatgtcgatgacctgcaccgcgccctcggtcttgttgtagagtacgctcgccacgttggcgggtaccagggcaatgtcgatatcgccctgaatgaccttgggcacaatctcatcggcggcagtattcatcgcaaagtcgaactcattgtccgtctcgccatcggccgcccggtccataaactgcaccagaccaatcgaggtcggccccttgagcgaggcgacgtgcacctcgaccggctcggcagcgaggcgctgctgctggtgtcgagcgacccggtgagtgcgcccgcgctggctggtgcgctggatatcgcccccggcgagtgcgcatcgctgctcgccgagctcaaggttgagtacgaggaggccaaccgcggctttcagctgcgcgaggtcgccggcggctggcgcctgtttacgcaccccgcctaccacgacgtggtcgaggcccacgtgttgagctgggacacgcaaaagctgtcgcaggcggcactcgagaccctggccgtcatcgcctaccaccagcccgtgacgcgcgaggtggtcaagggcatccgcggcgtcaactccgacggcgtcatcgcgtcgctcgtggacaagggcctggtgcgtgagctcggccgcgacccccagcgcggtcaggccatcatctacggcacgaccaacgccttcttggaaaagttcggtctgcgctccacccgcgacctgcccgacctggagcagtttgcccccgacgagcagtcgcgccnnnnnnnnnnatccgcgagcgtctaagcggccgcagcattcagtccacgctcgaggagcaggccgaagatctggacgaagagcgcgaactgctcgataccgatgttgaagatgttgatgcagtcgaggacttggaaaccctggacgtcgacgagacctcggaggatttgcatgacgaggactaacgaagtaggggagacgcgcgccgtgggcaacgcagtacccgtaaccgacgcccagcccgtctatccgcacaccatgcgcctgcagcgctttttggcgcgtgcgggcgtggcgagccgccgcggctcggaggacctgatgaccgccggccgcgtgaccgtcaacggccaggtcgcgaccgagctgggcaccaaggtcgatgtcgaccgcgaccacatcgaggtcgacggcatgcccgtcaagctcaaccagggcgccgtgtacctgatgctttacaagccgaccggctacctcaccaccatgagcgacccgcaggagcgcccttgcgtggccgacctggtcccccgcgaccgctttccgggactgttcccggtgggccgcctggaccgcgacaccacgggccttttgctctttaccaccgacggcgacctgtcacaggacctgctgcacccgagtaagcacgtctacaagacctatcaggcgctcgtggacggccacttgaccgatcgcgacttggaaccgctccgccgtggcatcgagctcgacgacggcctatgccagccggcgatctgccgaatcattaacgcgcgcgaggccgaggccgtagctccccagggcgtcaagcccggcaccaccgccgtggaggtcatcatccgcgaaggccgcaagaaccaggtcaagcgcatgctgagcaagattcaccacccggtgattcgtctgcaccgctgcaactttgctggcctggagctcaaggacgtggccaagggctcgtggcgcgagctcaccgatcgcgaggtgcagatcctcaaggccggcggtattccgcccaagcaggccagctccaagcgcggcgccgcgccggcgaccaacaccgcgacccgcacgcgtcaccacggcagccacggctccgcacccaagcgcaacacctaccgcgagcgctacacgggctaggcaacccgccgcgccccaacgcccgcgaaccataccagcacgtcaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatgtatcgcgccgtcaccttcgccgcgctcgaccgcggcatcgacctggatgacgaggcggccatcgacgccctcgccgagcaaatcgagatccgctttacaaacggcaccggcgaggacacgcgcctgaccattgacggccaggacgcttcggccgccatccgcaccccgcaggtcgacgccaacgtgtccaaggtctcggcctatccgggcgtgcgcgccgccatgctcatccaccagcgccgcgccgccgaggaccgcgatatcgtcgccgagggtcgcgacatcggaaccgtcgtgttccctaacgcgcaggtcaaggtcttcctgaccgccgacccgcgcgagcgcgcccgccgccgcgtgctgcagcgtcaccaaaacgatgctcagccgctcacgtccgagcagctcgaagccgaggtcgacgagaccctcgacgcccttaagaagcgcgacaagcttgacagcagccgcgaggtcgccccgctcgtgcccgccgaggacgccgtgcacgtcgactccaccgcccacaccatcgacgaggtcgtctcgataatcgaggaccttattaaccaaaggaggtagcccatgcgcctgtttcagcagacgcccgaggactattacaacgccccctacgccgagtttccagcgctcatccgcggcaccgtcgtcgtagtcatggccatcctttgggccttctccaagctcatgtggcgctggaaggtcgaggacgccgatcttctgtttgagcgccaggaaggccgcggcagcgtggtcatctgcaaccacacctcgatggccgagctcttggccgtggagacggcgctgttctttgggggccgccgcattcgtcccatctttaagtccgagttcgccaagagcaagattgtgcgctgggcctttagccgcgttggcggcatccccgtcgagcgtggtactgccgatatgaagtgcctgcgcgccgcccagcatgcgctgcagcgcggcgaggacgtcctgatcttcccagagggcacacgcatccgctcgcgcgagatcaagcccgaggtccacggcggctttgcgctcatcgcccagatgggcaaggcgcccgtcaacccgctcgccatctgcggctggtccgacatcacgcccgcaggcaaaaagctcatgcgtcccaagaagtgctggatccgcgccggcaaggccgtctcgctttccgacgcaccggctgggcttaagcgcacggagcgcctggaatggtttgagtccgaggccatgaaccgcgtctacgccatgcgagacgagctgtgcgccgagcatccgggcaggttctagccatgagcgagaacgtgacgaacaccaccgcgactgtgtccggccaggcaaccgcgcctaccatcgagatcgccgcccacgccggcacttgctacggcgtacagcgtgcgctcgatatggcgctggccgctgcgccgcaggcagaggagtgcactcaagttcacaccttggggccgctcatccataaccccatcgtggtgcgcgagcttgctgaggcaggcgtcggtctggccgacaccttggacgacgccgcaaccggcaccgtgatcatccgcgcccacggcgtggtgccgcaggtaatcggtgctgcccgcaagcgcgaccttaccgtggtcgacgccacctgcccctacgtgaagaaggtccatgtggcagccgagcgcctggtgcgcgagggctaccgcgtgatcgtcgtgggcgagccaggccaccccgaggtcgagggcattctgggccacgccggcaatgatgcgcaggtcgtgagctgtgccgccgacgccgatgccctgtcgctcaagggcaaggtgggcctcgttgtgcagaccactcagaccgcgcagaacctcgccgaagtcgtggccgctatcaccccgcgcgtgcaggagttgcgtgtgatcaacaccatctgcgccgccacgagtgagcgtcaacaggcagcagccacacttgccaaccgctgcgactgcatggtcgtcgtgggtggcaagaactcgggcaacacccgccgcctggcgcaaatttgcgcagacgcctgcgagcgcacgtatcacatcgaggaagcttccgagctccaggccgcttggtttgccgaggcgcgccacatcggcatcaccgctggagcctccaccccacaagaacacatcgaacgcgccgtcgcgcgcatcaaggagctttgccgctaaccatggaccagaccgtacccgcatacgccgccgaggtggccgattacgggcgcagccgcgaccccgagccgggtgagggcgcgctcgttaagaatgtgcgtcccgaatcgcccgcatgggatgtgggtatcgagccgggcatgcgcgtgctcacggtcaacggtgaggcgctcaccgacatgatcgtatggctttgggaggccgacgacgacaccgttgatttggaggtattcgacccgcgcgacggcaccgtcacccccgtcgagctcgaccgcttcccgggcgaggactggggtttggagttcgatggccccatcttcgacggcatgcgtacctgcgtaaacgcctgcgtgttctgctttatgaccatgctgcccaagggcggccgctccacgctctacatccgcgacgacgactatcgtctgagctttttgcagggcaactttgtcacgctcacgaacctcaccgacgaggacgtgcaaaacgtcatccagcgcaacatgagccccatgaacgtgtcggtccatgccgtaagccccgacgtccgccgtcgtatgatgggccgcaacgcccagcggggcatggacgtactcgaggccatcatggccgccggcatcgagattcacgcgcagatcgtgttgtgccccggcatgaacgacggcgaggagctggaaaagaccctgcgcttttgcgaggagcacgagcaaatcacaagcctgggcattgtaccgctcggttttaccaagcatcagaaccgttttagctggtcctacagcgacaagcccgagctggcgcgcgagaccatcgccatgatccgtccctaccaggaccgcgccttcgagcgttttggccgccacaccttccagatgagcgacgagttctacctggacgccggcatcgatccgcccgaggcggacttttacgacggctatccgcagtactacgacggtatcggcatgatccgctcatacctagacgagacggacgatgtgcttgccgccgatgccgagcgcctagcccgcgtccgcgaggccatcgccgctcgcagccagcacctgctgtgcctctcgggcgccagcgcacgcgacacggtggcgcgctttgtggagtcgccgcatggtctcggcggcaccgtcacagccatcaagaaccgctactttggcggcaacgtggacgtgaccggcctcatcgtcgcgtgtgacattctggagcagctgccgcaggacctctctggggttatgctctttgtgcctaagctcatgttcaacgctgacggcatgacgcttgacgagtatcatcgtgacgatttactcgcaagccttaccagtcgcggcgccgaggttcatgtggtgtcgaccatgccgcatgagctgctcgataccctggagcacatccttggcattgtgcctgccgactctactaattccgctgaccctacccattaaaggagagcagatgaaacctatcgtcgccgtcgtcggacgccccaacgtgggcaagtccacgctcgttaaccgcctggcccagacctcggacgccatcgtccacgagtctcgcggcgtcacgcgcgaccgctcgtatcacacggccgattggaacggccgcgagttcaccatcgtcgacacgggcggcatcgagccgctcaagagcgatgacgtctttgccacgtccatccgcgaccaggccctcgccgccgccgaggaagccgccgtcatcctgtttgtggtcgacggccgcaccggcgtcaccgaggaggacgagtcggtcgcccgcatgctcaaacgctgcgacaagccggtctttctgctggtgaacaagctcgacaaccccgatcgcgaaaacgacagcatctgggagttctattcgctcggcatcggcgagcccacgccgctctcggccctgcatggccacggtacgggcgacctgctcgatgacatcgtggccctgcttccggaggaagaggacgaggtcgccgatgagttccccgacgcgctgaacgtagccatcatcggccgccccaatgccggtaagtcatcgctgttcaatcgtatcctaggcgccgaccgctctatcgtgtccaacattgccggcacgacgcgcgacgccatcgacaccgtcgtggagcgcaacggtaagcactaccgcatggtcgataccgcgggcatccgcaagaagagcactgtgtacgagaacatcgagtactactccatggtccgcggcctgcgcgccatcgaccgcgccgacgtggcactgctcgtcgtcgacgcctccgtgggcgttacggagcaggaccagaaggtcatgggtcttgccatcgagcgcggctgcgccatcgtggtgctgctcaacaagtgggacctgctcgacgatgaccgcaagcgcgaggcctgcatggagaccgtcgaccgccgtctgggcgtcatggctccctgggcccagtacctgcgcatctcagccctgaccggccgcagcgtcgagaagatctgggcaatggtagacgccgccgagaagacgcgctcgcaaaagatcagcacctcgcgcctcaacacgttcctcaccgacctgcgcgagttcggtcataccgtggtggacggcaagcgccgcctgcgtatgcactacgtgacccagacgggcgtcaacccgccgacgttcacgttcttcgtcaaccacagtgacctggtcaacgacacctaccagcgctacgtggagaaccgcatgcgctcgaccttcgactttgccggcacgcccattcgactcttctttaggaagaaggagcaaaaggatgcataatccgattcttctgaccgccatctgcgccgtggtctcgttctttatcggggcggttccgtttggtctgatcctgggccgtgtgttcaaccacacggacattcgcaaggcgggctccggcaacatcggcaccaccaacgcactgcgtgtggccggtcccaaggtggccgcgctcaccctgctgctcgactgccttaagggcgccatctgcgtccttatcgcgcgtccgctcatcgcgagcgtgggctatggcttccccgtgagcatcatggcccccggcgccgccggcgactggatgcttggcgtcgtctgcctggcagccgtgtggggccatatcttctcgccctaccttaacttccatggcggcaagggtatcgcagttggtctgggcgtcattctcgcctggtactggcccattggtctgtcgctgctgggcatgtttatcgtggccgtcgccatcaccaagttcgtgtcggtgggctcgcttgccgcggctatcagccttcccatcgctgcctgcgcggtctttccgtacagcagcctaggacttaagttttgcatggcgatgatcggcatcaccgtggtgtgggcccatcgcgcgaacatcaaaaagctcatgaccggtaaggagtccaagctctcgtttaccaagcgcgtcaccgaacccgatgataagtaggagagagtcatgaatgttgcgctgattggctctggctcctggggaaccgccgtcgccggccttgccgccgcgcgagccgagcgcgtgaccatgtgggcccatagcgagcagacggccgccggcatcaatggcgaacaccgcaacccccgctaccttgtggactacgtgctgcccggcaactccgtcgccacgaccgagctcgtgcaggcgctcgacggcgccgaggccatcatctttgccgttccttcgacgcaccttcgcagcgtgtgccaccaggccgcgccctttatcgccgccgataccccagtgctctgcctcaccaaaggcattgagcccgagtccggcctgctcatgagcgaggtcatcgccagcgagatcggcaacgaggcgcgtgtggcggcactctcgggccccaaccatgccgaagagatctgccgcggcgggctttctgccgccgtcatcgccagcaaagacccgcagataggggagacctttaaggacctgctcctatccacggccttccgcatctacctgacgcaggacatgaccggcgtcgaggtctgcggcgccatgaaaaacgtcatcgccatcgtgtgtggcatttccgccggctccggcgcgggcgacaacacgctcgcccttatcatgacgcgaggtctggccgagatcagccgtctggtgcatgcccgcggcggccaggccatcacctgcatgggccttgccggcatgggcgacctcattgccacctgcacttcggagcattcgcgcaaccgcacctttggctacgagtttgcccacggcgtgtcgctcgacgagtatcaggagcgcacgcatatggtggtcgagggcgccgtcgcggcccgcagcgtcagcgagcttgcccgctcactgggcgtagacattccgctcacctttgccgtggagcaaacgctctacaacggtgttactttggatagggcgctcgagattctcaccgaccgcgtcccctctcaagagttctacggactcaccgactagcgcagaaaggctactaccatgggttccatcaaaatcgctccgtccgtcctttcggccgacatggccaacctcaagggcgaactcgacaagatcgccggtgccgactacgtgcacttcgacgtcatggacggccactttaccggcaacctcacctttggcgttgacatccttaaggccgtcaagcgctccaccaacgtgccggtcgacgcgcacctgatggtgtcgaaccccgacgagaccgtcgattggtacgccgatgccggtgccgacatgatcaccgtgcactacgaggcctccggatcgataacgcgcttgtcgtcgcagtcgcgcacctgcaccgcacgctcacgcatctgcagcagcgcggcatcaaggccggcgtggtgctcaaccccgccacccccgtgtgcgtactcgagagcatcatcgacgtcgtcgatatggtgctgctcatgagcgtgaaccccggctttggcggccagagctttatcccgggcaccattgccaaactgcacgagctcaaggccatgtgcgagcgtcacggcgtttcgcctctcatcgaggtcgatggcggtatctcttccaagaacatcgccgaggtcgtcaaggctggcgccaacgtgctcgtcgcaggttccgccgtatttaagtccgaagatcccgctgccgaggttgcgctgctgcagaagctgggcaacgaggccgcacaggaggcataaaaccttatgaccgcaggtcaaaaccgcatacccgtgaatcttgactatgccgcctcgacgcccatgcgcgtcgaggcgcgccttgcgcagcgcgagtacgacgacagcgagcttgccggcgtcaaccccaactcgctgcattcgctcggccgcaaggccgctgcacgcctggaagtggcgcgtcgcgagattgcccgcagctttggcgcgcgcgttcgcccgtccgagattgttttgaccaacggcggcaccgaagccaaccagctggcgctgctcggtcttgccgagggcgctcgtcagcgcgatcgcaagcgtaaccgcgtgatcgtatctgccatcgagcacgattcgattctggacaacctgccgctgctgcgtgctgccggctttaccgtcgacctggtgcagccctgccgtgcaggttatattgagcctgccgcgctgagcgacttgctcggcgacgacgtggcgctcgtgagcatcatggttgccaacaacgagaccggcgtggtgcagcccatccgcgagctgaccgcggccgcgcataccgtgggcgctctgttccacaccgatgccatccagggctatctgcacattccgctcgatgccgccgagctgggcgtcgatgctatgaccgttgccgcgcacaagatcggcggccccgtggcatccggcgcactctaccttaagaaccgcacgccgctgcgtccgcgcatctttggcggtggacaggaagccggacgtcgtgccggcacgcaggacctgcgcacgcagctggcctttgccgctgccgcccgcacgttggcgccccgcgtggcccaggagcgtacgacgctgcaagctctttccgacaagctctacgccacgcttacggctcatccgcgcattcacgccaccatgggcgactatgcgcatgccgatcgtctgcccggcatggtgtcgatctacattgacggcatggactccgaggagctcatcatcaagctcgacgccgccggctttgaggtatcggcaggctcggcgtgctcgagcggcagtatggaccccagccacgttttgagcgcgatgggcatcggtcgcgagcaagctctcggcgctcttcgcatctcgttcgatgaccgcgtgaacccagccgatctggacgactttgcccaagcgctgctgacgatcgtgggtgccgcatgatcgtcgccgagctcgagcgcgctctgctggcacgctatccaaagacggacgccgagccctgggaccacgtaggcttatccgtgggcgaccctgccaccgagattgccggcgtggcctgcgcactcgatgcgaccgaagccaatgtgcaccgtgctttcgaggccggtgtcaacgtgctgctgacgcatcatcctgtctatatcaaggcgcccgaggcgttttgtccagcggatgccactcgcccccagtgcagcgcggcactctatgaggcggcccgttgcggcgtgagcatcatatcgctccacaccaacctggaccgctcgaacgaagcccgtgtctgcctgagcaagctgctgggtgccgcactcgtgagctcactggagcacgtggacgaccccgaggcaaccggcctgggcgcgcttgcaacgctcaacgacccgtgcacgctgcgcgatcttgccacccgtgctgccacggccttcggcagcgacccgcgtgtgtggggcgaagccgatcgcccgtgccgcaccgtcgccattttgggcggctccctgggcgactttggagagctcgccatcgccgcgggcgcggacgttgtcgtgacgggcgaggcgggctatcacgtggcgcaggacctcgctctgcgcggtctgggcgtcatcttgctcggccacgaccgctccgaggagccgttcgttgatatattgatgaactctgcagttgacgccggggtcaacccccgtcatgcgattaaaatacagaacccttgccaatggtggactgtgacaaaaggagagaacttatgagcgccggcgctacgctactcaagctgcaacagatcgatttggagctcgcccgcaacaagagcgaacttgccaatatgccggagctcaaggagctcgcttccaagcgcaagacctatgtgaagctcaagtccgagatgaccaagctctacgcccagcgcaaggatctggacattgagctcgacgatctcaacaccaccgagatccagaccaataacgccatcgaggcagctaagaagcgccacgttgacggctccgactaccgcgaggtacaggacctggaaaacgagctcgccaccctggccaagcgcctggacaagattgagcacacccgcaaggatgtcgttgtcgcccataaggaggcgctcgaccgcgagacccgcgcgcaggccatcatcgccaagttcgaggagggcgtgaaggccgataccaacgccgcccgcgccaaggctgccgacctgcaggctcagatcgaagccgccactaaggagcgcaccgctcttgccgccacgctgccggccgacgtgctcaccgactacgagcgtctgctcaagcagttccgcggcttggccgtcgagaccatccagggcaacatccccacggtctgccacaccgcgctgcaggcatcgtccataagcgacctcaaccacgacggtaggtcaattacgcactgcccgtactgccaccgcctcctggtgctcccgagcaaggaagcctagcgatgacggcggcatccaacaattcaatgcaacttgagggaaaaacgatcctgctgggcattaccggcgggatcgccgcctataagtcgtgcaatatcgtgcgcctgctgcaaaagcgcggcgcacgtgtcaaagtcgttatgagcgagcatgccacggagttcgtgggcccgctcacgttccgcgcgctcaccaatgagccggtcgcggttgggctattcgacgacccgtctgaccccatccaccatatctcgcttgcgcaggagcccgatctggtggtcgtggcgcccgcgacggccaatatcatcgccaagatggccaacggcatcgccgatgaccttatttccaccacgctgcttgcgacgccgcgacccatcgtgatcgcacccgctatgaacaacggcatgtggaaggcgccggcgacgcaggccaacatggccacgctgcgcgagcgcggtgtccatgttgtgggacccggcagcggctaccttgcctgcggcgacgtggacacgggacgcatgagcgagcccgaggacatcgtcgaggctgtctgtgaggtgctcaaacccgtgcctcagtacctggcaggcaagcgcgtcgtcatcactgccggccccacgcacgaaccaatcgacccggtgcgattcattggcaaccgctcatcaggcaagatgggcatcgccctggcaggggaggccgctcgccgcggtgctgcggtcaagcttgtgctgggaccgacatcgctcgatgtcccccgcggcgtggagtgcgtgcgcgtgcagaccgccgctgaaatgctgcaggtagcgctcagcgccttccagacggccgatgcggcaatttgtgcggccgccgtcgccgactatacccccgccacccctgcggaccataagctcaaaaaggccaacgaacgcctggatcgcatcgagcttgtcgaaacggtcgatattttggccgagctctcgcgccagaagggcaagcggtgcgtaatcggatttgcggccgagaccgataacgttgtcgagtacgccgagcgcaaattggcccgcaagggctgcgatgccattatcgccaacgatgtctcgcgcgccgattcgggctttggaaccgacactaacaaggcctggattgtgagcacaacgggtacgcaagaacttcccgtgctaacaaaaccccagctcgcagatacaattttggacttgcttcaaaatttataaaaaagttcttgcacaagtctaaagtttcgggttaatatactccctgttgcaagcgagagcagagcaacaaacataagcttcgggacgtggcgcagcttggtagcgcacttgactgggggtcaaggggtcgctggttcgaatccagtcgtcccgaccagaagtttgcaggtcaggcacctagtgcctgaccttttttgttttaagcaattgcttaattttgattaagcaacagggtgccaaaaaactacctgcgcgataatcgctttttgcggttacttgcgcgttttgcacgcgcttgagccgatttattaacgcgacatgaatctacatacgcgtagctggtatacagacgagtacaggctgtatttatcgcggcgatttacgcagatatggcgactgtaacgaactagtgtgtcgctgtatttattccagcagttcacttgatctgtggacaagtgagcggttacaacaaaacgccaaccaggatggactccatacgaggatgccgcaaaggtaatggcggggaagtgcggcaggcgctctgagagccgctgtatgcccccatttctcctcaacccgattacctgtacaatgaacctcgaattgtttgagtaatcgccaaaagaaaagccctcgcaggattgcgagggctttgcgatgaaagagatcagaagcagaaagcggggaggacataaaacgagtccgtcgcgctgtagctgtagcaaataccgccgctttgaacatagcgaaaggatgtggagctgcgcggtctcacggaacgagtccagtggctatagcctgatgcaccggaatagttcgacctcgtcacgcccttggatttgtagcactcgtactggatgccgtcagattgcatatccccgtatacttcggttgccgagagcagaaaaaccttgtcggtcgtcgccgagggggcaccgcccccgttaccgccaacgttatcggttgtctttgtgacgggtttcacctttgactggagctcgctgggcaggagcaaccagaggtcaccgctgctgaggcgggtacggagctcggacttatcccaaccaccggcattggtgtccgtagcgttcattctctggctacccaaggcagagttggtcgcctcgaacgtcaagcctgccatgccgctaccatcggccaagtcgtcgtggttgatgccgatgatacggtactcgagcgtcttgccattggtcagcttcatcgagaacttggtgccggcatccatggcggccttggccttggcgtaggcgatagacgatgtaccgttcttggcaatgtctttggcaaccgcctcctgctcgtcgagggtccagtccttcgcgtccttggcgatggccacctggacggccgcggaatcggcgcctgcggagccgccaccggacgcgcctccctcgacgccgccgaccgttccattgttcaccgtgttgccgaccaggttggactggtttcggatggctccggccacgccgggtcccgcgaacacgatgaccaggccgatgacggcaatgatcaggacgtactcgataattgattgccctcggaagcgggtcgtttcaggagcgacccccccccgaaggttaattgccgctgcatgcatatacggctcccttcactcggggtttgcaatacgagccgagcgtagggctattccaagtatttgcaacggtcttgccgctgcggcaacgatgacggcaggggagaaagtcatgcgctattagcgcggctataacgtccgcttcgaatgccgaccgtattcatatcgaggcagccatttcataccttcagaaagacaactgaaagccgcaaaaaagcgggacccggctataagccgaaccccgcccaagagaagcctttagagccgagacagacaacgcgtgtggacaatcactcagcctccaccgccatgcgcacgacctcttccatcgggtagcgagtgccgccgtccccgtccaaagcctcgttgtaggcctcgatgtccgccatgtcctcagccttctcgaacgcggcccttctcacgaactcggaaaaggtcatgcccgtggcgtccgcatggccctgaatcaaggccatttcgccctcatcgaacttgaccgcgatctcgcgcatcgccatggtcgctcccgtaaacgccgtcatcgaagtgaatccattatccacccaccgtatacgccccgaactcgaaacaccaagcaggatggactctatacgaggacgcagcagaggtaatggcgggggagtgcggcaggcgctctgagagccgctgtatgaccccatttctcttcaatccgactacccgtgccatgaacctgaagccgttcgttcggtcgccaaaagaaagcacgcgcggggtaacgcgggctttgcgctagacaagctagaagcaccaggcgggggagacgcaaaaccagcccggcgcggnnnnnnnnnnacctgaagccgtccgttcggtcgccaaaagaaagcacgcgcgggggggagacgcaaaaccagcccggcgcggagttgctgtccgacggattgccgctgctgtcgacatggaggaagcccttcgaggcgttcggaaacaccgaacgctcccaccaaccgctgccaatggcaatggcagagttgggattatagttctccgtcaccttgcctttgaaggcctcgtactgggtgccctcggaggaagtccagggatagaatgcccaataggaggtggggggcgatctcagagtagctgagcaggaacagcttgtccgaggtagccgtcacggcggcgttcttgttctcatcaccgcccccgacattgttcgatagctttttgacggccttcaccttggactggaaatcggagggcatcagattccagatctagccggagttcattttctgacggagttcagacttctcccaaccgccggcgttggtgtcaatcgcgttcatgggggaccaaatgcccgtcgtggtggtgaggaacgtgaggcccgccttgccggatccgcctgcagggtcatcatgattgatgccgataatgcggtaagtcagcgtcttgccatcggtgagcttcatcgagaactcggtgtcggcatccatcgcggccttcgccttggcgtaggcgggcgacgcctcgcccttggcggcgatgtcctcggcaactgccttctgctcaccgagggtccagtccttcgcgtgtccttcgcgtccttggcgagcgccgcctggacggtcgcggaacccgcgccgttaccgctgccggaaccgctcggttcccaagtcccacctgctgtcccgtttaccaatactcccgccaccgtgttgaactggttcctgattgccgacgagacccaagggccggctatcatcacaaccaggacgataatcgcgatgaccagaacgtactcgatggctccttggcctcggaggcgggtattcctaggagatacccgccccccgaaggttaattgccgctgcatgcatatgcgacactcccttcgcatggggattgatattgcatgcagagcgtacgttaaatcgaaccgactagcccgtaacgtgtcgctgaggcaacggcggcacgggtgcccgcgccacataaactgcttgccgttttgtttcttcagacctactgccacgccttcgggaggataacgccgggggcgcagtgattgaagtcactatgattggcataggttgggacattccaatcggaacagtcgaggtttagatttttgcaatagctaaacatgccgagcatatccataacatctgaggtcttccaccctggtccaaatttcacgcttttcagcgaactgtcggtggaaaaaaggagacgtaaatcgccggctttccgcgtcgaccatccggagatgtcaatctcctcgaccttgtaaaggtttttgagcgccgagtcgaattcgacgaccgaggacgtatcccagcttgaaatactgaaggaagtcgcattgccgcaatacgcgaatgcgtgctgcagatttgtgcagttcgacatgtcgaactttgccagatcaaagctcttgcagttctccatgtactgaaagcaaaatgccaacgagtggatttctatgccatcgtcaatggcctttacggccacgatattatttctgttaggccaccagggggcagtcgtcttgccgtcgtttcccacggtcgcggtggcgtatccattttcgaaccccgtatacaccgccgtcacgcggcggctgttgagcatgtcaccgactctggggaccccgcggcgcttgtagaacatgaggctgtggtcgtcctccgagtacacggcgaacgctatcccgtgaacggggtccacgatgtcggcgtcggtcaacgacccgttgccgccgcccgtgccgcccgactcccagctcccctttgagattccgttgccgagcgtccccgccaccgtgttgaactggtttgtgatcgccgacgagacccacggtcccgcgatcagcaccaccaggacgatgatcgcgatgatcagtacgtactcgactgtcgactgccccttcgggcggcgggtaaatctgggagatacccccccccgaaaggaatttccgctgcatgcatgtgcggctcctctcggattgctttggctgatgctgcagaggatagacgcgattactaaggatgagtcaacaatgccgcagcggcattcacactaagagggtaaggcgttcggagtgacatcccgttccaaaacgtatacttgatttaaggcggagtggaatgtgggcgcgcaaggagatgcggaatcgatgagagcctcaaaaaaaactactgcagtgttatcatctttcatcctctctattcttccatttctgattctatgggcggcttggtcagtcctccctgatacaattcccgctcattggagtgggggtgtggttgatcgatggggtaataagcttgaattgctggttgttccgctgttttctctgattggttctattgcaatttctgtgtaccttattgtttccacgcggcgaagagagttcgcggatttctctgctcgaatgcgacgggactttgttgcgtgctatatttctagtcttcttttatcgacaacctgctcagtgataattgccgtttgggttcagttgattcttacgcaaagcactgcggttgatgggggacttggactatcgatcctgtatttccttcccgggctatatgtgatcttgtgcgctttgccgcctttttatgcgagcggcgagagcaaaaaggcagagcgcctgataacggttcttattggctgcgcggagattgttctttgtggaatagtgcttgaaggttcggctgcctcttatacgatgattggactgatgattctgttctgtgcgtttgagattgtgtcacaggtaagggatagccggtccttatgagttgaattacgcgcgtgcggatataaaggttggcatgttaagctggtcgttttctcgttctgggacatttgcagtaggatgagtgggactaggcgcgctgcggcgtgatggtgacggttgagacttgtatcgctgcaaatccgctgatgcacattttgctattgggcttgaaggtgggacctacaggcctttgtttgggatgttccggtcgtccaacacgtgttgcacggctttgtattgttacgctcgttcggcgctccgttggagcatttccgggtttgtcggcatcatgacttggccaagtgacacgcttgccgggacggttgtaacgccgcgccggttccgtgtgctccttcgttgttggcctgtccagccgggggcggattcggcctcatgttgtggcgcacggccttcaggggcttcccctggcgagttatgttcgtccgtatgggtaagggtcgggttgagctgacaatcccgtgtcggaaggggcttggaccatgcgcgcgatgacagagattgagtggctggacggccgtgtgacgaaggtgccgaagctcgccctgggcgatgcgttcggcgagagcgtccaggcggagctcgatttcgggttcgacgatgtgttggagggcctttgggtcgaggtgcgccatcatgagccggatgaggactcggacggcgaccnnnnnnnnnnnnnnnnnnnnnnnnnnnnnnnnnnnnnnnnnnnnnnncgacccgcgcgggaggggctgcgcactgtacgcggactgccggtacagcctggtcgaaccgtcggacctcgaccgtgtcttctgcatcctttacgaggggcagccgagggtctgccgcgtcgcgggggagctcgtgaacctttcgcgggcctgcgcgttgtcctgcctcatgctcggatctccctacccgccaggcgccctcgaggccctagccgcgtgcgctcgatacctctgcggtccggctttcacatccgacctcgccgcccgcgtccgcgcgcggatctcatccggcctcacgcgcttgaatatcgagctgagcccaaacgatgacccacaccccatcggtcttcatgatgatgcctcgatgagccagctcgcccagagctttcgatacagtcggttgagtcgaacagactttttttcgagcttgtcctgacgcatgaaaagaccttttgtaagttcttttccgttggcatccttcctattaggccctttggacgtctggaaggagcaaatcatgatcagaatcgcaagctggacgcgattcttcgcgaccgcaaataatgagtcgtaggatggcctgttgattccactcaggatctcgctctttgcaatctcatcctgtcgaacgtcaagcgccgcctccatctcgctaggcgtctcggcctgatcggcaaccgatggagcgtccgtgtctaaaggccacgggaggccacggcctttttgcggtttgtagctacttgtactcatgttgattcctctggtgcgaggctatccaacccaattgccgactgtgcccataatatggttgatttccgatctcagccgaacacattgagcggataggccgttcccgcagttagccgaacgcccccgaggccccattcaggccacggggcgtcgttttcccagttgaaggaacggtggagatgtgtttcgatgggtccggtggccatgctccgcccgccgcccggcacctcttcccagactcagccggacggtcggtccgtctattccattttcgcccttaggctaggccagcggggcatcgcccctctctgcgcgcgccctctcggcggggccggcggggccgacctgtcggtctacgacgggttcctgaagggggcggtcgccgatggcagctagcgaggagctggcagggtcgtggaggccgggcggtcgtgctcgctcaccaccgccgtcctggaggagtggtcgaggctcggcaccccgaagcaggtggagtacctggcgggctacctcgaggcggagaggtccagccgcgaggcctcgaagcgcgcgacgctgctcaggcgctgcgcgctgccggcgcccaagaccttcgacggctacgactggtcggccgtgtcgtggccggagggcatggggcgcgagtcgctgctcgcgctcgacttcgtcgagcgcagggaggacctcgtgctcatgggcgacgtcggcaccggcaagacgcacatggcgtcggccctctgcgcgctggcgtgcgagaggaggctcgaggcgcgcttcttcacggcgtcctcgctcgtgatgcgcctgaggcgcgcccgcgacgacgggaggctcgaccgggaggccgcaatcatcggcaaggcccgcctgctcgtcatcgacgagctcgggtttctcccgctcgacgcggacggggcgaggctgctcttccaggtcctcgccgacgcatacgagaggcagtcggtggtattcaccacgaacctggagttcagcaggtgtgggcggtgttcggggacgaccagatggccgccgccctgatcgaccgcatcgtccaccacgggaggctcgtccagttccgcggcgagtcctaccgcgtccgccatgccctcatgcaggagggctagccgctcaaaaagcgtgcgcgcttccgatgctgcgactgctcaatttccgatgctctttttgctcaaatcctcttgacgaaacacagaatacgtgcgggcggcgcttgcagccgatcgcacggtaccggccgcacccgttgcagcagcgcggccacgccgccaggcgcgggcaggccgccgacaggtcggccgagccgtcgacgcgctcgccgcgcctggacttcggcgccgtcacgaacctgtgcgacgccacctcggcgctcaccgccgagggcgacctgcacagctccctggcgatctccctgcacgaggccctgcgctccagcatcctctggaccgtgtcccgctcgtgcctggtgagcctgccgtaggccctcggggccgcctccgcggaacccttcttcctctttccggaccggccgtcctccgatctcccggtgccggccggtccggccctcagggtatcgggttcccgcattcatccgcacatgtgcggatgaatgtgggaggtgttcggatgaagttgataatcaaggcttcgatagcaaacgcaatttggtttttgaaatatggacgaattcctcgtcaggagggtaaaatggtgccgacggcagcccaagttgtagagagctgggcagagccgttgcttaatgaagttgggtcatcgtcttagcgacggtggcctttctttttgggcttcgaaccctgcttgagtgccttggaaaggacgacaagggccgtgaggagcgagaccatagcagtcaggagcttcacgagctcagtgaaatcggtcatgggcatcacctcccatcggatggagggctctgcccggcacgagggctgccgacagcaaggacgattctatcagagcggctgactcccgcccgattattaccatcccaccgcgcctgtgcaaaaaagagggccgccaaacagcgaccctccagcgaaagtgcatgttatttaggacagtcaaattctttgaaaaacaaatggatgctgtagaattacaaataagagtcacccagaaggagcgatcgatgaaaagcaaacgatttgtcctgaatgcacttctggtagtagcaatattgacgctcttcgtcttttcgtactcatacatgaatcagccaagatttggatatgctttatacactgttttttccggcgaaacaacttacaacactataggcttcattgacgcaatctttttctatgtagtcggccccgtatcaagcgaactggtcgcttttgttgtcagctacaacctgaatcaacaaagccaaactcactcagcgacttcggccaaacaaggaatcaatctcttcgcaataatgataattctgcaaattgcgaccgtgttgattatcgccctgaccgcaacaaacgttttgaagtatgagttcggattcatcgcgagctgtctcatggcaattgccgcgggtatagcggtttcgtatacgacaccggcaaagaagtagataaactaacagggcctatttggaatccgaatcgtccatggaaccgtcgatgccggttttggtgtcgtcatccgtattggaatcgtcatccttggggcttataggacacacattttgtcctataagccccgatcaattcatactcctcatcctcgccgaattgcgagtatggcagaatcggcactggatggcagcgcgctaggccgtgtccgcggagttaccccccccccgtttttatcgtaacagctgattctagggacgcttcaaaaagtcaaccgagggttttgtcccgtcaagacgccgaacgagaattacgtaccgccaagagcctcaaaacacgcccctcgcggaacagaatcctcactcgatttccatgcggagtaaaaacgtcaatcaatcatcctccgcaacgtctatccaccaaaaaggccgccccacgtggagcggcctttgctcgcagctttttactgatagttactcaaaaattattccaacacatccacagaagagcagcgaatcgtatttttctttcgggaatcgagaaaatagcctaccttgactttagacccaacgctcacggggctatcgcttacatagcgcgtatgttctgaatcaaccagaatggtcagacgatcagacccgtcgttatatggatcttcgctttcgaccgacatggtaaaatcgccagagctgtcaacgttcaacaccaatccgctcacgaaccacaaatgtgaatagtcacctccgctatctttttggcaacgctccacttttagaaatagcgcagagaatgcgaacacggcaactgatatagcgatgaaaaccttaacgccactccccttgccataaaatacaaatttattcgccaaagaaaaatacccctgccttatccgtgtaattagcatagtactacgttaacgtgctcatggctgtgggttggtttaacctacagtcatgctaaagttgccaaaaggggtacaaaggccaatacgtttgcgcagtgccggcacagcgacctagcatcgtatgcaccggcgggatcattgctggcctgcaaggagagcatgtccacgcgctcatggtcgccggaggcctcgtgatgcagcacgcgccgagcggcgactggaagcgcgtcgattgggatgcgcttgccgcctggctcgacagatacgggtgcaaggtcgctaaatgcgagacggagacccttccgaccgccgacgcggcgagtgggaacgcaagggtaaaaatgcatcgtcgctgaaccagtgagtcagtattctttagttggatgatggatattgaaattaattagcgagataatgtgcatatctcataatgtatgcgttgcaccatgagagaggggcctgtcatgagctggaaaccgagaaaatgcgttatcgccggtctcgtgacaaccggtcctggcggcggcttgtttgcaaccgcaatgacatcgtaccgacttttcacttacatgttctaaaaggcggttgccatgctgtcgcaaaatcactcgagatacttggtcccaatcggctttaccctgctcgcatcactctttgctagcgaccttttgctgaaaccgcccaaggaactcgttttgcttgccatagactgcatttccgccctttactttacggcaaccctattcatcggactaaaggagaggaaaaaaggcgcagtcgttgcgtccgccgtaggcgtgatcacagccattgcctcattctttatctgacacattggtgatctaggggcgatatcgtaggaatacgatcgggagagccaggaccagatcgcccgggttgcccggtcggctcgcgcgacggcgcggcggttcgacagaaagctctccggacttcacgccgtttctgatcgcattgtagacagccaactcgtcttcgcagtcggcgagcacgcggtgtgcgtcgtcgttttggatgtacagtaaatctcgaaggtcctccatgcaccagcgtccgagatctggccatgcgcgtcgcgcgagctgataagtgtcgatcgcgatgttgtagttaaagtccaggccaaagccgtcccaggcagaacggcattgtttccttgattatcaacttcatccggacacttcccgcattcatccgtgtgtgtacggatgaatgcggggttcgataccccggcggcctgatcggcagaccgccgggagttctcactcctcgataaaagccggcactcggttagtcctgcgcatcttgaaatcgccagtctcgtgggagacgtagagaatgccgtccatcccgtctcgtgatgcatacgacaggtgaactgaaccgcaatccgatccatcattgtcgagaagatcgaacgaattcgggtcgctcgttgcggccaaacgaccactcagacaagagccatcgtcattacagatttgccattccatgtcttcgcctgcaagaatcgccatagacggcctggtcgcgccatcgttgacatacatcccgtctatgccaaaaccgttttcagcgccatcgatgaacgactgctcggacctatacctcgcaaatgatgcacatagcaccattgcaagacaaagtgcagagccaacaataacgatctttacgtagctcttggccgtcatgccatccctcttttcgcttgcctaaagaaatgcggaagaagctgttagtcgcggcttgtttgtaggcccttctgccccggttcggttactaaggttacttgagggctcctataaatgattgttacccatatacgtaatatgaatttcggacatgtcgaaatcaatcaatggttgcgggagtttccgaccttagtgaaatgccaccctatacccacagaatcagtctggctgacatgtgccaatggccgctaacggcacttggtcggcaacggtcttagcccatcggccacaacagtgtctccttctgtcgcgccgagggccagacacacagcggtggcgccgtgccgcggcagctggacgaccgcgtcgtcgaccgtggcgattgcactcgcgacgacacacctcgccagtttgcctcgccctattggccccagcgcgttgcagttcaatcagctgttacaattacccacccacaaaaagcccatctagcaggtgctttgctgttatagagtcctggaaagaaagggccaaaccgaagtgtctggccggacgccaattgtctgggaactgcttcggattcgaccctcttttactttcgcccactcggtggacttcgggtttaatgcttaggggcagggatttaacaaagtgaaattttaatgaaaagaaacccagctgccacaattgccatggtgagggctcgaattggccatatagatctaaaatagtcacgataccttctcttttgctggaacgatatatctatacaaggttgtgagcggaaaacaaaaatacgtcgattgctatccgacaaacgggtctggaattgcattctccggcatttcggggagattgatacacatgtacgaaagggaaactatgtggtgcgttgggttggagctgctgcaggcccgatatggattgcggtcttgcgccccgatgtccaaataggtttctctctctagacgggaagttgctcatggacgccatatatgacggagatgactgggtcgatcattatacttggcgcctggtcggctcggatgacaatggggatgtggtgtttgatggactatgtccaaagcatctccatccttttgtctcgtcgttaattgagagttccgctcgtgttgccccctacagctcggcatcgcttcatgatacggacgttttgaagaccataagggagtcaattgacgagggcacgatgagcggcccgctgttttctcggcttgtggggctagatgagattggctcgaaacgactgcttgcgggcgaaaaggtggaactcacttatcggtcgatgatttcaatcctgcggctagccgatgttcttcgcaaataaatgaggcttccatggccatgtggcagcttgtctcaccgatgggtgggagccgagtacttttcggacgatttgcttggcctcggcgtagtcttggacgggatctgccggatcatcgaaatcctcgacgagatatttcaaagcggcaccttcttaaacggcgaacgtgacagcggtcctccctgaattctataaaatcacggcctgacttgggcggcgaattggcggagctcgtcatcgtccatatcgtcgaagtgcggcaactacgccagcgcggccctctgctccatcaggtacctaccgctcggagacctgcgaatcgtctgcaagatgtcctcgggggcgagggctgggaaatccatgccctcgggagcggccaaagagatggattcacctgcccctcccatgtgttgggacctcattcagggcatcggctgcatccggcctttcgcattcgccgcccggccctccggtcccgcccggctctccggtcccgcccggccgacgggtttcccatctacggcaaaacgatcgcacttatatatatgcattcccggattgggaatatgtttcagcccacgcgagcaaagcctcggcgtactccgtggtatctccgctgcgcggctttgcaccctgcaatgccgcgcagcggagataccacctgagacggatgtcgatgcatcgaacccgagaccgggcgctgcggcgggaagcctctcgcacggacaatctgctcgatcttgctgcacccgtcttaaaaggttagacaaacttttaatcgtacgacatccgtcgaacagtcgggggtacacaccactacagaaggcccacggaacggggggcgagatggtcggcgacgggttcaaggcactctccggccccacgctccgccagggagggcgtcgggagggaggccgtaatgggtgagaaggacgagcggccggagcgggtgttccccggcaggacagacccgtggttcatagcggccatggtgattgtggcgggcggtttatccgcggcgtgtatcgcgtgtttcctgagctcgagtcccgcgctcctatggggctggctcgcgctgctgcccgtcccggccctcgtggccctggccgcccttcccgtccgcagcaaccgcctcgagctctacggcgaccgcctcgtcgtcgtgtacgctgggacgcgttcggtgataccctacgcccacgtgcggagcgtccggcgcaccaggacgctctgggcggggacggccaactcgctcgaccgcgtctacatcgaggcgccctacgacggcgacgccatcgtctcggtgaccgacaacgatgccctcgtggcggagctggggcacaggtgcggcctcgggccatactcccatttttgagagaggtgccgtcgggccccccgaaagccgtctgcatttgcaggcctttattcgaaatcgggcggcgcggctgaaaatccccggcctgaaccgcggggcttcatctacattcgcgcaggcgtattcacaatcataaaaagataggcacgggcatccgcgttcgcggaaacccgtgccgcatttgcgtcaccgagatgaccgggtagaatatatctgaacgctattccacattcccgtacttgcgctacggatttgggaaagcgcatgtctcagcctctactcgaccacggtcgcctcggtcgggatggcccccagcactgccgcgtactcggtggggtagaggcggcttatcgtctgaacgtcgcggatgaggacgttgcggtcgtcaggctcggagatgccgtagccgaacgcctcgagcgtctcgatcgcctcgcggatcttctgctggaacatggggccggggtccaccctcaggccgaggtagcctcgccacaggctcggcaacacgcgcagcatgttctggatcttggacatcggctcgatgtcggcgtagacgttgagcgtgaccatggcgtccttgtgcccgaagatcgactgcagcgccttgatgtcgccgccgtggcggatccactgcttcgcgaaggtgtgcccttacggtataattacgacaaaccggaaaagccccgtatatcaagggttttcggttatctggcaaggtttttcatccttttccaaaccgaaaaatcgagccgcgaagtagttatatcgtagggggtgttatagtaacgacaaaaactaaatactgtttgggcgggctgtcagcccgtccaagaaatcaggacatttcctctgaaaagaagaaatgtcctttttttgtacccaaaatcagatgccgacaggaggaacacaatgcctgaaaaagccgtgcagaaggaaccgggcaaaaagcccgcgccatccaaaaagccgaaaccgcagcaggaagtagttgttcagatttcgctctccgagctgcatccgttcccggatcacccctttcaggtgcgggaggatgcgtccatgcaggaaaccgccgaaagcgttaaggaatacggcgtcctcgtccccgcgctggcgcggccacgggaggacggcggttatgagctgattgcaggccaccgccgcaaacacgcctgcgagctggctgggctggccaccatgcccgtcattgtccgcgacattgaccgggacgctgccaccatcatcatggtggacagcaaccttcagcgtgagaacattctcccctccgaacgcgccaaagcctacaagatgaagatggaggccatcaagcggcagggcgcacgaacggatctgacttcgccgaaaatttcggcgaagttccgcagcgatgatgaagttggtcaggatgccggtgtgagcggagataccatccgcaactacatcgccttgacgcagttagtcccggagcttcagcagatggtggacgagaagaaaatcgccctcagtcccgcctatcagcttgcggcgctgacacccaaggaacaagggctgcttctggaaaccatcgacagcgaacagaccaccccctcgctctcgcaggcgcagcggatgaaaaagctcagtcagagcggcgagctgaacgaggacaccatgctctccattatgatggagcagaagaaaccggagaaaaacgacatcaccctttccggtgaaaagctccgcaaatacttcccgcgttcctataccccgttccagatcgagaacaccatcttcaaattactggacgcatggcagaaaaagcgccagcgtgaccagagccgttgagcggacaagcagtttgtttgtccgctattttcatgccaaaaggaggacgccatgtatatcaacacgttcaaatacacgcccaaagatgtgagctgccagctctgtaccgagtatgtgaaaaagctgggctgtaccgccctgcgctgcccgtggctggccgagcgcattgaggccggtgtggtcggctaccgcgaggcagtcttagagacatttccccatgaacgccgcctgttccagcgcctgaacctgctgatcaagcattatcccggaagcctctggagcaacgagcagcatgagcgccgaatgcagtatcaatgtgccgtgcagggctaccgccgccgcagggataccaacgcctattatgcggccatgtacctgctgacctccaacgacgacatttaccgccgcacggcaaactgcttctgcaaggacgggattgagttcggctatgcggtgttgaaaaacacctcgccgcacaactacgcactgttcatggcagcgcgcgacctctgcgacaagacggaggccgtcacgatggcggacttggcggaaccggaggtcattgacccggaggcgctgcgcctgatcgtcaacgccactctgatcgcccgctatgggcttgccgcctttcagatcagagcgcgaggtgccgaatatgaacgctgatgattttgtcggcgggcacagcatccttgcgctggagcgctttatggacgaaacccgccacatgattatttttgatgtcctgtcatggaaatctcctgtgggtgaaaagggcgaacggctgaggttgttcctctccgacgtgggatatgccaaggcgcaggcatccgagaggcgcggagaaatcaaaatccgcaaacacgccgccgtcattgaggggcatatcctccctgaccggaaaaagcggcgtcactaaagtgattggaggaattaccatgagcagagtaacagagctggaaaaagcgctgaccacgctgttccgcaagggtacggaggtcggctacacagaaacggagatcgacgagtttctggaaaacattgactatcacgccctgctgcaagccgtttggaacaaggccgaaacggtctatgcctatcgcgcagacggcaagaatgcgctgagcttggactatcgcagcgcggagctgttcaagcagcgtgcgacgcttctctatgaggacgtaggcgacagctatatcggcgcggtgtttgccgcccggtcgatggagttgtggctgctggaggatatgggctttgccgtcgttgccaaattcagcgtgaacgccggagaaggcgaatacgtcaccgagtatcgcgtctacaagggcagcgattgggcagacagcgagatttctctggatttggaggacttggtggccgagcttgccgccctgtgcgatccctactacgaacacgagcagcccatctatgagctgtgatgtgggaaaggagtggaaacggagcggctttcctatgcgggaaaccattcagaacgcaaacggcaagcagtttcacgccgtcagcctgtccggtggcaaggacagtaccgccatgctgcttttgatgatcgaacgggatatgcccatcgacatggtgctgtcagcggacaccggcatggagttcccggaaatgtacgaacaccttgccaaactggacgagcatcttttccgggagcgcggcatccatattaccacgctgcggcatcccaagggctttgaatacctgatgttcgacgaacccaagcagaagccccgcagtctggaaaaccgcgcaaagctgggcatcccgccctacggcaacggctggccgggtatccgcgtccgctggtgtaccgggcagctcaaaacgcacctcatcaccaaggaggtcaaccggctcaaaggcgagctgggcgcgatccactatgtcggtatcgccgccgatgaagcgtggcgctgcaaggacgagcggtatccccttgtggagtggggcattacggaggtgcaggcgctccaagcctgctatgaccgtggctttgacttcggcgggctgtatgagatataccaccgtgcgtcctgctggtgctgcccgttccagcgcatcgacgagctgcggaagctgcgaaaacaccacccggagctgtgggaaaagctgatggagctggatcgccgtgcgctggcgcagttcggcaccggcccgctgggacagttcaagcagaactggagcgtggagcggctggacgagcgatttgccaaggaggacggtcaaacagcctgaccattctgcggaaaggattgaagcaatatggctgtatttcgcgttgaacggacgcgggattacacggtgatgtgcaaccatcacctgaaagacagcaatctttccctaaaagccaaggggctgctctccatgatgctctccctccccgacgagtggaattacaccacgcgggggctggctgcaatctgcaaggagggcgtggacgccatcgggaaaacgctcaaggagctggagctggcgggctacatcatccgccgtcagcttcgcggcaaggacgggcgcatttccgacacggagtacaccatcttcgagaagccccgaaagccctctccaccggatacgactttaccagatacggaaaacccgtatctggataacccggatacggaggcaccggatacggataatcccgcgcaattaaatactaagaaatctaatactcaaaaatcaaatactgatctatcaagcactcattcattctttctgcctgcggcggacggaatgacggacgggtttgagaaaaaagcggagatcagagagcaaatcgaatacgacattctctgtcagcagtatgaccggatgcagcttgatgagctggtagagatcatgctggaggtcgccataaaccgcagccccacggtcaagatcgggcgggatgcggagtatcccaccggcttcgtccaacagcgctttgaaaagatcacctccatgcatatcgaaaaggtcatggacggtatccgcgagaacaccacccgcgtttggaatacgaaagcctatctcatggcggcgctgttcaattccgtttccaccatcgacaaccactatgccatgctggtcaatcacgattttcacggtggcccctaaaggccgtcatttttcatgcccgattttgggagaaaggatttgataccgatgaaacgcccccttgcctacatcaccgctccgtggagcgagaacgagtttgagaacaccgaaaatgccgccaagtattgcagggcagtctatgacgcgggcttttcgcccatctgccccacgctgtttttgccgctgttcctgcgcgatgagattccgcaggagcataaagacggcatcgacatggcgcgggagcatctgcgccgcgctcgtgtgctggtggtttgcggcagcatcgtggatgaaagcgtgaaaaacgacatcgccgtggccgagcgcctgcggatcaccgccaccacgctggacggcatcctgaccgtcaagggacaggggcgcagaaatgaataagcatcttctgcaccggctggtggttccgccttagtgtcccggcattctccctgcaaatcgaaggaaaggagcgtgataagtcatgcaggaagaagttgaacagagaatcgtatccctgatgatctcctgtgggaagctaggtgaacaggaatttcgtaaggccgttgccaagctgctggagcagttgaaaaacgaccgccagaagcatcagtacagcaaggccaatccccacgggaaaatgaccgtcaagcagcttgccgccaaggataagggattgcagagcattgaagtcaccgatcagaatatcggctcattcaaccggattgcccggaagtatggcattgacttcgctccattcaaggtcaagggcgaaaagcgatacatggtgttcttcaaagcgccggacgccgacgccatgaccgccgcgttcaaggaatataccgccaagcaggtcagaaaggcggagcgcccctcggtgctggaaaagctgcaacacttcaagtcgctcattcaggcggctgtggtggacaggacaaagcggaaggagctggaacgatgaagcaagtcaacgtcaaaaagctcattcttcccaatattccgtatgtgttcatcgcactgctggccaccaaggtcagcgaggcggtgcggctggctcccggttcagacgcttccacgaagctcctgaacattatgaccggcctgaacacggcgtttcactcccttgtccccagctttcatcccattgacctgtgcgtgggcgttgccgccgccatcgccattcggctggcggtctatatcaagggcaaaaacgcaaagaaattccgcaaaaatctggagtacggcagcgcccgttggggaaacgcggaggacatcaagccctacgtcgatcccgcatttgagaacaacatcattctcacgcagacggagcggctgacgatgaatagccgccccaaagacccgaaaacggcgcggaacaaaaatgtcctgatcgtcggcggcagcggttcgggcaagacccgcttttggttgaagcccaatctactgcaatgcacctcaaaaacctatcccaccagcttcgtcgtcaccgatcccaaaggggacatcgtggtttcctgcggccatgcgctgcaaaagaacgggtatcagatcaagattctcaattccctgaacttcaagaagtccatgcactacaacccgttcgcctacatccactcggaaaaggacattttgaagctggtcacgacgctgatcgccaacaccaagggcgagggcaaagccggtgacgatttctgggtgaaggcggaaacgctgctctacaccgccctcatcgggtacatccactatgaagcgccggtggaggaacagaacttctccacgctcattgaatttatcaatgcgatggaggtgcgtgaggacgatgaggacttcaaaaatccggtggacttgatgttcgacgagctgaaaaagcgcaagtcagaccacttcgccgtccgccaatatgccaaattcaagctaagtgctggcaagaccgcgaaaagcatacttatttcctgcggcgcacggcttgcgccctttgacattcaggagcttcgggaactgacggcctatgacgagttgcaactggacacgctgggcgaccggaaaaccgccctgttcatcatcatgtccgacacggacgatacctttaactttctcatttccatgtgctatacccagcttttcaatctgctgtgtgaaaaggcggatgatgtgtacggcgggcgcttgccggttcacgtccgctgcctgatcgacgaggcggcaaacatcgggcagataccgaggcttgagaagctggtagcgacgatccgttccagagaaatctcctgctgccttgtcttgcaggcacagagccagctcaaagccctgtataaagacagcgcggatacgatcatcggcaacatggactgttccatctttttgggtggtaaggaacccggtacgctgaaagagctggcggcggcgctgggcaaggaaaccatcgacagctataacaccggcgagagccgtggccgcgaggtttcccattcgctgaactatcagaaattgggcaaggagctgatgagcgtggatgagcttgccgtgctggatggcggcaagtgcatcttgcagcttcgcggcgtccgcccgtttctgtccaacaaatatgatctcaccaagcatcccctctaccgctacaccgcggattatgacaagaaatacgcctttgacatagagcgttttctgtcccatcgcctcaagctcaagccggatgatgcagttgaggtgtatcaggcagacctttccggtgaacctgtcgcctgacggcggcagcctgatttgacaacgactcgatgaaacttcgtggaagaaatgtaccctccaaaatctaaaaacatatttttcggaggtactatttatggctttctttaattctgctgttggtgttcttcagaccctcgttgtggcgctgggcgctggcctcggcatttggggcgcgatcaatctgctggaaggctacggcaacgacaaccccggcgccaaatctcagggcatgaagcagctgatggccggtggcggggtggctttgattggcattaccctcgtgccgctgctgtccggtctgttcggctaatcggcagctcgtttgcttcccataaatccacggagggtgctgctttcgggcggcatcctcccgaaaggagggcaaccctatggatttcttatgggataagatcacggaatggctgaaagaaatgctcatcggcggtatcgtgagcaatctgtccgggatgttcgatgcaaccaatcaaaaggttgccgagatctccggtcaggtgggcttatcgccgcaggcatggaacggcagcattttcagcatgatacaaaatctgtcggaaaccgtgatcgtccccatcgcaggcgcaattctcgcctttgtgatgacgctggaactgatccagctcattaccgacaaaaataacctcaacgacatggacacatggatattcttcaagtgggcgttcaagtccgctgccgctgtcctgatcgtaacaaacacatggacgattgtgatgggcgtgtttgacgctgcccaaagcgtcgttgccagcgcctccgggctgattatcggcgataccagcatcgacatttcaagcgtcatggtgggcattgaggatcggctgatggagatggaattggggccgctcttcggcctatggttccagtcgctgttcgttggcattaccatgtgggcgctgaccatctgcattttcattatcacattcggaagaatgattgaaatatatctcgtcacctctgttgcccccattccgatggcgaccatgatgggcaaggaatggggcggcatgggacagaactacatccgttccctgctggcgctgggcttccaagcatttctcatcatcgtctgcgttgccatctacgccgttctggtgcagaacatcgcgcttgtggatgacatcatctacgccatctggacttgcatgggctacacggtgctgctgtgcttctgcctgttcaaaaccagcagccttgccaagtccgtgttcaatgcacattaacgggggtgataccatgctgacactcacgcccgtcgcgcttgcaacagcgaacgcatttgtcaattcgcatcaccggcaccataaggcaactgctgggcataagttttccatcggctgtgccaaggatggagagcttgtcggtgttgcaatcgtaggccgtcctgtgagccgacatctggatgatggctggacattggaggtcaatcgcctttgcaccactggtgagaagaacgcttgcagcatcctctatgccgcatccgcgcgggcggcaaaggcaatgggataccgcaagatcatcacctatacgctggatagcgagagcggcagcagtctccgcgccgctggctggagctgcgcaggtttggcaggcggcaaatgctggacaggcagccgcaagcccgcctccgctttgtacccggcgcagatgaaacttcgatatgaaaggctcttgtaaggggggatttctatggcctatgtcaacgtcccgaaggacttaaccaaagtaaaaaccaaggtgctgttcaatctcacgaaacggcagctcatttgcttcggaagcggcgcgctcatcggcgtaccgcttttcttcttgctcaagggaagcatcggcaccagccccgccgccatggtgatgatggtggtgatgatcccggccatgctgttcgccatgtatgaaaagaacggtcagccgctggaggtcgtcatccgcaacatctaccgtgtgtgcttccagcggccgaagcagcgtccgtataagaccaacaatttttatgccgttctggagcggcaaaaccagttagaccgggaggtgtatcaaattgtccgaaaagaaaaagctgacccacgccgaacgaaaacagatcgaagccgccatcgcaagagcgaaccgaacggataagaaagaaaaatcggcgcaggacagcatcccgtatcagcgtatgtggccggacggcatttgccgtgtgaccgacacgcgctacaccaaaacgatccagtatcaggacatcaactaccagctctcgcagaatgaggacaagaccgccatctttgaagcgtggtgcgattttctgaactactttgacagctccgtgcaattccagctttcctttgtgaacctctcggcttcgcaggaaacctttgcacggagcatttctatcccgccctgcggagacgaatttgacggcatccgcgccgagtacgccggtatgctgcaaaaccagcttgcccgcggcaacaacggcctgattaagaccaagtatctcacgttcggtgttgaggccgacaacctccgcgccgccaagccccgtttggagcgcatcgaaaccgaccttttgaacaacttcaagcggttgggcgttgtggctgcgccgctgaacggcttcgagcgcctgcacgttatgcacgacatcctgcggatggacgagcaggaaccgttccgcttctcgtgggactggctggctccctccgggctgtccaccaaggactttatcgcgcccagctcctttgagttcaagaccggcaggatgttccgcatgggcaaaaagctgggtgcgatcagcttcgtgcagattttggcaccggagctgaatgaccggatgctggccgattttctggatatggagagcagcgtccttgtcaatctccatgtgcagtccgtggatcaggtcaacgccatcaagaccgtcaagcgcaagatcaccgatctcgacaagtccaaaatcgaggaacagaagaaggccgtccgcgccgggtacgatatggacattatcccatccgaccttgccacctacggcgcagaagccaaaaagctgttgcaggatttgcagtcccgcaacgagcgaatgtttctgctgaccttcctcattctcaacacggcggacacaccccggcagcttgacaacaacatcttccagacctccagcatcgcgcagaaatataactgcgcgctgacccggctggacttccagcaggaggaaggactgatgagcagcctcccgctggggctgaatcagatcgagattcagcggggcttgaccacctccagcgtggcgatttttgtgcctttcaccacacaggaattgtttcagactggctccgaggcgctgtattacggcatcaacgccctttccaacaacctcatcatggtagaccggaagctgctgaaaaatcccaacggtctgattttgggtactcccggcagcggcaagtcattctcggcaaaacgtgagatcaccaatgcgtttcttatctgccccaaggatgacatcattatctgtgacccggagggcgaatatacgccgctggtggagcgtctgcacggtcaggtcattaagctgtcgcccactggcaagggctatgacggttcgccctgctacatcaatccgatggacttgaatctggattacagcgacgatgataacccgctgagcctgaaatccgacttcattctgtcgctgtgcgagctgatcgtcggcggcaaggatgggcttgcccctgtggaaaagaccatcatcgaccgctgcgttcgcatcgtctaccgggactacctcaatgacccgaaaccggagaatatgccgctgctggaggacttgtataacgccctccgtgcgcaggatgaaaaggaagcgcagtacatcgccactgctttggaaatctacgtcaccggctctctgaatgtgttcaaccatcacacgaacgtggatgtgaatagtcgcatcgtctgctacgacatcaaggagctgggcaagcagctcaagaaaattgggatgctggtggtgcaggatcaggtctggaaccgtgtgaccatcaaccgcgccgcccataaaacgacccgctattatcttgatgaattccatcttctcttaaaggaggaacagacggcctcgtacagcgtcgagatttggaagcgctatcgcaaatggggcggaatccccaccggcatcacgcaaaatgtcaaagtgcgcccagatagggcgctgtgcaaagcagtctaaggtactgccgcacacggcagtgtgcgaaacaatctgccttaccgactaaggagaaatcctttacgggaacagcgcatggcagaaaaaggaatagtcaccaaaggacttaggtgcgactgtttcctaatgttaagaagatatgaggataagattgggtttatcgaatgtaaggttccagttcctgttttttgtaggtgtgggaaaagtcctgaaacccatgtcataacgctgtcacgtcatctttcacggcgggacaactgccaacacgttatgaaacaggcgtgagaacacgtcacaacgaaccgaaagcatatccgacaatcttcactaacctatgcacagtgctaactggggattgcctaagtctggctcatttgccggatatggtaacggaggctccatagtagtccgagagggataacgacccttacatggcgaagggagccagttagtaacatctaaaatgtaagaatgaaagggaggagaaacctcaatgaaaccaacatctgaaattttagagcgtattgaaaagtgttccagcgaacacaaagacggcgtattcacaagactttacagatacttacttcgtgaagatatttactacgccgcctatcagaaactttatgcaaacaaaggtgcaacaacacagggtatcgacaacgataccgcagacggtttcagtgacttctatgtaaaagagttaatccagtcactaaaggacggaacctacaaagccaatcctgtaaggcgtgagtatattccaaagaaaaacggaaagctccgtccgctgggtatcccgtctttccgtgacaagctcctgcaagaagttgtcagaatgattttagaagctatctatgaacctgtctttgacagccgctcccacggtttcagaccgggtaaaagctgtcataccgcactccgccagatttcttctgacttcacaggcgtggtctggtttatcgagggcgatatacaaggttgttttgataacatcaatcacgaaaaattgattgagattttgagcaggaaaatcaaggacagtcgttttctgaacatcattcgccagtttttgaaagctgggtatatcgagaattggaaatacaacgccacttacagcggttccccgcagggtggtatctgttctccaatacttgcaaatatctatctgaatgagctggacaagaagtttcgggaaatcgcagaacgctttgataagccgaagtctgcatatcagacaccggaatatcatgcggcaagcaaagaattaaaaagactgtcttattggattgaccataccgctgatgaagcggcaagacaagaactgattgaccagcatagggcacagaagaaagctatgagaaatctgccctgcaaacctgccgacaacaagaagttcacttttgtccgttatgcggacgattggctggcaggtgtgtgcggcacaaaagcggaatgtgaggacttgaaagccgaaatcgctgaatttctaagcacagagctgaaattaactctaagcgaggaaaagacgctgataacgcacagctccgaaaaagtccgtttcattggatatgatatttgcgtccgcagaaatcaggaagtcaaaggtcacagaatgaaaaacggaacgtggagaaaatcccgtaccctgcacatgaaagttgccctgtctgttccccatacggaaaagattgagaaattcatgtttgcaaagaaagtcattcgccaaaaggaaaacggggagtttcagccgatacaccgagccggacttctcaaccttgcggattatgagattgtggaacagtacaatgccgaagcaagaggattatgcaactattacaatctggcttgtgattatcacacgctggactacttctgctatcttatggagtacagttgcttaaagacgattgctaataagcacaaaaccagtatccgcaaaatcattcgccagtataaagacgggaaaacatggtctgtcccttatgaaactaaagcaggaacaaaacgtgttcgccctgttaaaatcgcagattgtaagcgtgacgaagcgagtgacatcatttatcagagaaagaaattcagctggaaaaccactattagacaacggctcaatgccagagtttgtgaactatgtgggtgtaaagaagccgatttgtatgaggttcacgttatacggaacttaaacgaattgggtaattctgattgggaaaccgtgatgaaaaagaagcggcggaaaacgcttgttgtttgtagcaagtgccatgaaagaatacacagacactaatcaatacgttaattactaatggggagccggatacttcgagaggagtaagtccggttccgagggagggtgtaggaaacctaccgccaacggcggcaaggcgcctttaccctaccctacgacctgttatccagccgcgaggttgagaacatttttgagaacagcgatttcatctatatgctcaatcaggccgctggcgaccggcagattctcgcaaagcagctcaacatttcgccgcatcagctttcttatgtgacccactccggcgagggcgaggggctgctgttctacggcaacacgatcctgcccttcattgaccacttcccgaaggacaccgaactgtaccgcgtcatgaccaccaaaccgcaagaggtggcgtcggcatgaaaagagaaccgcgtttgcagttttccgacgccgatcttgccgagccgaagctggaaaagcccatcaagcgggtgaaaaaagcggaggccaaggcggataaggcgcaggcgaaaatccccaagaaaaccgtggtcaaaaaggaacgcggctttgatcctgccaccggcaaggtcaaaacgcagctccgatttgaggaggtggacaagaaaaagccgccctcaaagctgacccatgccgtgcaggatgcccccgccagctttgttctctctcaggttcaccgggaggtgcggcagagcgaggatgacaatgtaggcgtagaggccgcgcacaaggtagagcaagccgtggagagcggcgggcggctggtgcagtctgcccaccgcgcccatcagctcaagccttatcgtgctgccatccgtgcagagaaaaagctggaacgagccaatcttgacgcgctccagaagaaagcagagatcgacagccccaccagcaatcccgtttccaaatggcagcagaagcaggcaattaagaagcagtatgccgctgccaagcacaatcaggcggcgcagactacggcaaaggcggcagagaataccgccaaggccgcgaaaaaagccgctgaaaaggctgagaaagcgggcaaatatgtgtgggaacaccggcgcggctttgccattgccgccgcaattctgctgatgctggcatttctgctcaacggcctgtcctcctgctcggtgatgatggatggcgtcggctccgggatcgcggccagtacctatccgtcgcaggacgccgatatgctgggcgcggaagcgcagtattgcgtgatggaagcagagcttcagcgctacctcgacacctacgaaagcacccatgactacgatgagtaccactttgatctggacaccatcgagcatgacccctatgtactcatttccatgattacggcgctgcatcaaggggaatggacgctggatgaggtgcagggtacgctccagatgctctttgaccgccagtacattttgaccgaggatgtggtggtggaaacccgctaccgcacagaaaccgacacatggacggacgcggacggcaacacccatacggacacctatcaggtgccgtatgactactacatctgcacggtcacgctggaaaacttcaatctctctcatgttcccgtctacattatgagcgaagaacagctcggaatgtacgccacctatatggccaccctcggcaaccgtcccgacctgttccccggttcaggctacatcggcaagtatgtggagggcagctataccgactacgacattcccccggaggcgctggacgatgaggtatttgccgccatcatcaaggaagcggaaaagtatctcggctacccctacgtttggggcggcagcagtccctccacctcgtttgactgttcgggcttcgtcagttgggtcatcaatcattccggttgggatgtgggcagactgggcgcgcagggactttgcaatatctgtacgcctgtatcctctgctaacgtcaagccgggcgatctggtgtttttcaccggaacgtatgatacccccggtgtcagccatgtgggtatctatgttggcaacaatatgatgatccactgcggcgatccgatctcttatacaaacttaaattcaagctattggcagtcccatttctaccgttatgggcgcttgccgtaaaggagagtgaacgatatgaacccgaaaattatgaagctccgtggagagctggagaagaacaaaggcaaaatctctgatctgcaaggccgcaaccgcgagctggaaaagcagattcgtgagctggaggacaccgacatcatcggcatggtgcgtgagaacggcatgacgatggagcagtttgccgagctgttccgccgtatgcaggccgcgcctgcaccggccactttggaaaaggaggcgttgaaccatgactaagaacacaccgcgcatttttatcagtctgctgctgatgctcttgtgtatcgggattctccccgtttccgcttttgccagcagcggcgactatcccgatgatacgctgcctgccgtcgaaagcagcgccgcaggcacgcaggaaacaaaacagatcggcacggtcacgaccaacggcggcaacctgaacgtccgcaccggcgcgggactggacaacaccgcgtttacgcagctccccaacggcacggtggtcgatgtgattggcagggacggcgattgggtaaaaatcctgctacctgcccgtgtgggctatgtgtacggcagctatctgaccgtcaccgacgccgccgacagtaccgtgagtatcggcggcattacgcttccgtttgatgaaaaagagctggccgacctctggcagctccttgtcggcagcatgacgggcggcagcgacgcgctgacaccggacggcaatctgacgctgatcgacgatattggcaccagcaccaaggctggaaaacagttcattacgctggaaagcaagaacggcaatgtgttttacctgattattgaccgtgacgatgagggcgaagaaaccgtccacttcttgaatcaggtggatgaggccgacctgatggcgctgaccggcgaggaagaaacgcccgccacttgctcctgcaccacaaaatgcgtggccggtgccgtcaatacatcctgccccgtctgtgcggtcaacatgaccgagtgcgtgggcaaggaggcaaagatagaagtccccgctgagccgacagaacccgccgccgaggaaccggagaaaaagagcggcgtgggcggcatccttgtcgttctgctgatcgtcgcgctgggcggcggtgcagcgttctacatcttcaagcagaaaaaggccaagccgcaaaccaagggcagcgccgatctggacgattatgactacggcgaggacgaggacgaatacgagtttgagccgtatgagggcgaaccggaacaggatactacggaggatacggacacatgagatacttcaccaataatccgctggaacgcctgatgatgcagaagccgaaagcagcacgggaggacagccctcccgccgctgccaaggaacacttctgctatggctgcaagcgcttcggacagagctgcgttcgcccctgctaccgtgacgtaaagagaatggaggctgcgccatgcgccttgtgatcgccgaaaaaccctccgtggcgcagagcatctccgccgtgctgggtgcaaaatcccggcatgatgggtatctggagggcagagggtatatcgtgtcgtggtgcttcgggcatctggcagagctggccgatgccgccatttacaatgccgatgatgccaaatggacgctggcggcgctgcccatcattcctacctcgttccgcttcatcgtccgctctgaaaagcagaagcagtttgacattctgcgggagctgatgcgccgggaggatgtggcagaggtggtcaacgcctgcgacgctgggcgcgagggtgagctgatcttccgcacggtttactgccttgcgggatgctccaagccgattctgcggctttggatttcctccatggaggatgatgccatccgcagcggcttccagcagcttaaatctgggcgcgactatgacggcctgcatcaatctgccctgtgccgcgccaaggctgattggctggttggtatcaacgccacgcggtatttctccctgacgtatggccgcacattgaacatcgggcgcgtcatgtcgcccacgctggcgctgctggtacagcgcgaggcggagatctccgcatttgcggcagaaccgttctacaccgtccagctcgattgcggctttcccgccacgacaggccgaatgaaggacaggaaggacgccgacgccatcgccaacgcctgcaagggcaaggcagtaaccgtcaaaagcgtggagcgcaaggaaaagtctgagaaagcgcccgcgctctacgatttgacctccctccagcgcgacgccaaccgcgttctcggctacacctctcagcagaccctcgactatctccaagcgctctatgaaaagaagctctgtacctacccgcgcaccgacagccgcttcctgaccgacgatatggagggcagcgtccccggccttgtcgctgccgctgccgctgtctgcggcatggagaagcctccgaccatctgcgccaagcaggtatgcagcagtaaaaaagtcaccgatcaccacgccattgttcccaccatcagcgcggaaaaggtagatatggcctctctgccgctgggcgaacgcgaggtgctgaagctggcggcaaggggcttgcttcgtgcggtggatgaaccacatcgctacgcagaaacggtcattacggtggactgtgccggtcagagcttcaccgccaagggcaaaaccgttcttactcccggctggaagcgctatgagcaggagcaggtagaggcagcgcctgcgctgccggtggtaacggagaatcagacgctttccgtatctgccgcatcggtcaagaccggaaaaaccacgccgcccaagcacttcaccgaggatacgctgctggctgcaatggagaacgcgggcaaggaggatatgcctgatgatgccgagcgcaagggcattggcaccccggcgacccgttccggtatcattgaaaagctggtgtcctccggttttgtggagcgcaggaagtccaaaaagatcacaaatctgctgcccacctctaccggcacggcgcttatcaccgttctgcccgaacagctccagtctccgcagctcaccgctgaatgggaacaccgcctgaaagagattgagcgcggcgaaatcgccccggacagcttcatggatgggatcgccgccatgctacatgagctggtgcagacctacaaacccatccccggtacggaagtcctgttcccctccgggcgtgaggtagtcggcaagtgtccccgctgcggagccgaggtgacggaatcaccgaaaggctttttctgtgagaaccgtgcctgttcctttgttctctggaaaaacagccgctttttcacagccaagaaaaaggtgctgacaaaatcccttgccgctgcgcttttgaaaaatggccgcgccccgctgaaaggctgctactcggaaaaaaccgggaaaacctatgatgccagtgttcttctggaggacgatggacagcgcacgggctataagatggtgttcgacaatggctgatgcgccgcgtatggatcacaagcagctccgccgcgccaagaagctcattcggaagctctgctgtaattacgatcacggcaactgccttgctctggatgatggagagccttgcgcctgcgtacagggtatttcctactcgctgctgtgcaactggttccgaaacgcggtacttcccgccgaccatgagctgctggccgacgtgatgcgggaaaggccggggaagcgctgcgccgtctgcggtaagccggtctattcttcctccaatcgcgccaaatattgccccgcctgcgccaagcaggagcgccgaaagcaggacgccaaacgaaagcgtgaacaatactggaacctccgcaaatagagggcgtaaaagccccgtgccgcaaggctttttccatgcggaatcacaaggggctgcgtcattctatccgcaagctcaaaaacaacgtctatctgcggagaatcgcccctgtgcaggatgtgttttcttctgcgcaggggcgctattttttctgaaaggagatcatcatggctgaaaaacaaaccagcaaagaccggatgcgggagatcgttgacagcatcgaaaacggcatcaaggagctgttcgagagcgataagtaccggaagtaccttgccaccatgagccgctttcaccgctactcggtcaataataccatgctcatctatatgcagcgccccgacgccacccatgtggcgggcttcaacaagtggcgcgatcagttcggcaggaacgtcctgaaaggcgaaaaaggcattcgcatcatcgctcccactccctataagaaaaaggtcgaggaaatcaagaccgaccccgaaaccaatgcgccggtgctggatgcggacggcaaggccatcattgaggaaaaggaaatccgaatccctatgttcaaggtggtatccgtctttgatgtgtcgcagacttatggaaagcccttgccccagcttgccgccgatctgagcggcaatgtgcagcagtatgaggttttcatggaggcgctgcgccgtgcttctcccgttccgatggagataaagcccgttgcgcgggatacggacggctttttcagcattaaggcgcagagcatcaccatccgcgccggtatgagcgaggtgcagacggtatgtgccgccgtccatgagattgcacacgccaagctccacgactacgaacacatgacggagcttgcggacgatggtgagacgatccttgtccccggcgaaaagagccgcaacaccgaggaggtcgaggccgaaagcatctcctatgcggtctgccagtattacggcattgaaacgggagaaaacagcttcggctatatcgccacatggtcaaagggcaaggagctgaaagaacttcgcgccagtctggaaaccatcaacaagactgcctccgagctgattacggacattgaccggcactttgcggagatttgcaaggagcgcggcatttctgtggagaaatccgagcaagcggaaagccaattaaaagagaacagcaatatgtctgcggctgacttggcaaaaagcatttcagagctgtatctcgatgcgaatggccttgcctttctcagcgaatttgcaagtcaggaagattgcctccagcatttctacgaagatctgttgacaggagcagatgagataaaaggcttcctgtccgaaacacttgagcagagcgatgaatacgcgcacagagcgaatgagctgctgttggaagttgaggcatttcagaaaagtcacacttccttaaaggaactcgacgctaatgagcgttggtatgcggttgatggtgggagcaagcatcttcgcataacagaagatggtgcaaaatatgcctatgaactttacgacaaggacactctacaccttctggaaagcggaacagtacatgacgatgatgtaaactttcttttggcggctgcgattcgtatctgcgaaacacatggctatgataagaccgtgccgtttgaagttttgtcaaacaagtttgcagggattttgtactcactcgaattgtcatcggacgacaatcaggttgttcacgaggaggccggttctcgtgccgcaggcacacttccaacttcgccagagctggaacaggccaccccgatgcccgaccccacgctgacggtggacgatatgcgcagctatgggtatctggacggcgatatgctcccgctttccaaagaccgggcgctggagctgctggagcatgacatcacggtttatatgctccatcccgacaacgccgaggaaatggtctttgaggccgaagacatcatcaagcacgacggaatgttcggtatcacaagaccggattgggatgcggtcaaaggccatattcctccccgcgatgtggagcagcgctttttgaacagtcccaccgattctatggcgatctaccagctacgccgggatgcgccggtcgagctgcgttttgccaatctcggcagtttggccgcgccgcctgaccctgccaactatgaagccatctatacccgcgaggtgtacccggacgatgataccggcagaatccttgaaaacttctactacattttcaacgacgagcgccccggcgattttgtgggacacagcctctccgtcagcgacatcgttgcgctgaaacaggacggcaaggtatcctatcactactgtgacagcatgggatttcaggagctgcccgcctttcagaaaccggagaattacctgaaagccgccgaaatgtcgatggaggatgattacggcatgatcgacggcattatcaacaacggccccaaacagcccaccgtcgccgaccttgaagcacaggtcaaggccggtatgtccatctccctgatggatttggcagaggcggcacaccgggaaaagaaaaagtctgtgctggagcagctcaaaagccaaccgacccaagaacgtccacacaaaacagcgcccaaaaagagcgcggaaaaggagctttgatatgaacatcacctttgaagaacgccagcttatgagcctctacaacaccggtacccgcacgggcttgatcgcggcgctggaggaaatgcgcggctacctcgctgcggatgaaacggagctgcgggagctgacggacagcgccatcgcaaagctgcgcaggatgagcgacgcagaatatgacgcgctcgacctgttccccgattttgaaaaggaggatatggatgccgagtaaagtacagctctatgcgcagatggcagaccgcacggcggagcagatcacgggaagctaccagaagtggacggcatttctgaccaccgccgcaaggctgtataagtacccctacaatgaacagctcatgattttcgcccagcgcccggaagccacggcctgcgcggaatacgatctttggaataagcagatgcgccgctatgtgcggcgaggcagcaagggcatcgcccttgtggataccagcagcgaccaacccaaactccgatatgtattcgatgtttccgataccagcggcggcgagaactctcgccgcccttatctttgggaataccggcaggagcatcgtgaggtggtatctgcggcgctggaacagcgcttcgacgtttccggtgaaaacggacttgccgatcagatggagcgtgtggcggcgcagcttgtagatgaatactggcacgacaactggcgcgatattgtcggcatcgttgacggttcctttttggaggactatgatgagttcaacatcggagccgcttttcggaacgccgccgttgtcagcaccacctatgcgctgctgtcccgctgcgggatgcagccgggagattacttcgagcatgaggattttctgaatgtctttgatttcaataccccgcagaccgtcgccgctcttggaacggccatcagccagtccagcgagctggtgctgcggcagatcgaagtcaccatcaagaattatgagcgcgagaaaatcgcggaaaggagcgaaagccatgagcgaactgacctacacccgcagcggggattatctgattcccgacctgagcctgacagagcagccgcaagccccgctgggcaagtacggcaggatgcggaaggattacctgaaggagcatcgtccggtgctgtggaacagcctgctgctgtccgagaagctgtacccccatctgcgggagatcgacgaggcggcgaacaaccggctggaacagatgatgccggagctgatgaagtcggcgggcgtgacggaatcgctgaaagccagcgacccgatgaagtgggtagggctgatgaacacgctgaaagcgcaggccgaggaaacgatcctcacggaactggtgttcagctaaatatgttcgatgcccctgctggggcgcagatgtccttcttcccctcagaggcagaacaaattcaatccatcgcagaagcggagagtgtaacaccctccgctttttctatgttcatttctcaggatgatattgaccacatcctgcgcgcgggcggtaatgcggatgcagcgcggatgaaaattgctgcggaattctccaagcaaaaacctttagaggattgcgcggcatttctgaaagctctttactacggcggcaacggcctgattacggataacggcaggctttccgcatggtacggggacgatggtatccatattgcaaccggagatacctctcgctatcttcgttctgcccaagtgataggctgggcagatgcggcggagcgtattgaggagcttctggacggcggcgcatttgccaccaatcttgaggtcacggaagccccgcgctatgagcggctgggtattgctgtggatgtctggaacctttatcacgatttctcggatgaagcaaagtcgctggggtatctgtcctgcttgggtaatatccatagcaccagctttccagaggaaacggagcgtctgacggacgatctgctgaatccggcgttccgggataggctcctgtcggaatacaaggtattcatggacgcttaccgcgaaaaccgtgcgctgctgcgcttccattaccacaagtcgcaggcacttctcacacgtttggaagatttgtcccttccgcgaaaggaattccgctccgatatggaggctattccagaaaccggcaggtttatcaccgaagatgaaattgcggcttctcttgcaaacgggagcagctttgagggtggaaagacccgcatctatgcgtttttccagacttcgcacactcccaaggagaatgccgattttctgaaaaaggagtacggcatcggcgggcatacccatgccgtatccagagaaagcggcagctatgaagatcacggcagcaaaggcattgtgctgaaaaagaacggctgtgcagacattcagatgaattggaacaaggtcgcttcgcgcatctcggagctggttcggttgaatcgctaccttacgccggatgagcaggcagcctatgacaaggaaatggcgcaggacgccatgcggaacgcggtttataacgactataacgacgtaaaggcggcgcaccccgatgaaattgtgctgtatcaggttggggacttcttcgagctgtatggcgaggatgcgcgggcagttgcagatgatctcagccttgagctgacgcgccgcaatttggagggagtaggccgtgttaccatgtgcggcttccctgcaaaggatttggagaaatacgttgaaaagctgcgggaaaagcatgatgtaacaatttcgcgcattggcgattccggccatgaacacacggcatatacgcttccgtccatcgaccacgaggcagaacaggccatcaatgcttatgaagcagagttcggcgcggacggcacaagggtgatccgcgatcctgccgccgacgcgccgcagcccacggtacgggagctgtttgacgggtacaagctgaccgttggcaacgcgctttccaaagatacggcttttgtcaatgcctgccgcaattcagaccgccagaacgcttatctggagggagcggacgctatccgtcgtattgtcacggcatctgatgatctccagcttgtccgcctgtactttgatatgcccgcgttccataaccggctgcatcaggagcttttggaggaactgtatcccacgctggcagcgacggtcgcaccctctccctatcagatcacacaggaggacattgacaacgcgcttctggattggcacaacaacctaaagggcaagcaggaagtcgcactatatatgcaggcgcatgggcgagaacgcagcaccgccgcatggctggctgcaaaatatggctgggaagatagcaaaactcccatgtatatccatgtaggaaacgccgagccggtgacgctcacatgggcgcaggtacagcggcggttggcacagctcatccgcgagaataaattttacgatgagaatgagcgactgcggttattttcacctgaccgatactccattcgtctgcatcccggcgagggcggaattaccggcatttgggatgaggtgttggaacggttctgcggagatggggaacaaacgctccgctttgcagaacagaataacgccattgcttacttggatggcatcaaacgagatatgggaattgagctatcccctccggcgtttacaacaccgcttggctatacttatcatattggagatcgcatttcatccatagagttagaccacatagcagcagtcggcgttatcgcgcgtgtagatgaagatcacgtctggcacacgttaccgaacgtacccggacaggaacctgtcagcatcgaccgcaattcctttgaacgctacctcgacaccagatatttcgaggtttctgaaccggagccgcagcgcgtcattgcggcgcagcacacagaacagccaaccccggagacgccgcaagcggttcaaaaccttatggggcagcgcgtggaaattgatggtaagctctataatgttgattccgcagatgaaactgtcgcgcatctcagcgtcgtttcatcctccagcgagagcaatcacgatccggaacacagaaccgaaccggtttctgctgtcctcacacgaattgcagatcagggtcgtgagcttgcgccgaatatttcggcatatcaggcacttcgtgcagagcatcccgaaaagctcatcggtgtccgcgtcggagaacggctgcttttttatggcgcggatgcagaacgagccgccagcgctttgaatcgccgcctgctgcaacgcgatattcccggtatgggcgaaaccgctgtgaccggctatgattttggacaatgggcaagcgccgcaaagcggctgctggagcatggacacagcttcgtgtttgcgcagccaaatgaaaccgacggctatgatgttatcaacgaggccgatgccaaggagtatatccccattggcatggagctggagattgacggacggaagtttgtcattgacagcgtgaatttcggcgcagatgaagtatctctgcgcgatgtgacttttcaaaacaggcagggctttcccatcttccgcgctgaacacattgcgtttgtacgctcgtttgttgaagaacaggaacaggagcagccgcagcccatcaccaaacccgtcgcgttctatcccgccgagaaaacacacttgccctacgacatagaaatccagacgctgcacatcccggaaccggagcatgacccgccctctgtggaacccgccgagcctgaacctcccgccatgagcgaggaagaagcgctgattctggagcaggaaggccgagcggcactctcggaaatgggcgagtttgtgcctgattttgatgatgccatctctcaggctgagatcgacgagcctcccgcacaccgtcctgcggtagcttagaagatcggaagggcttgcagcgacggacctcaggacactcttacaccacgtctgcgcgcgccaccgggttaacgctcgtagattaagttacctgccaggtaggttgcctgaactttggtgtcttggagctcttgggggtcgatggtgagcgggttttggtccaggactaccaggtcggcatacttgccgggctccaagctgccgaggttttgctcgtcgcccgctgcataggcgctgcccagggtgtagttgcgcagggctgttgctgcatcgatgcgctcgctcggtaaccagccgccctcgggccagtggcttttgggatcctggcgcgtgatagccgtgtagagcacgttcatgcttgtaacagctgtgatggggctatcagtgccgaaggcttggcggatgccgcgctgcttataggtcgcaaacggccacatgatgcggctgcgttccaggcccagatcgcgctcggggccgcccgggtcgagtgtaatgtgacagggctggctcgaggcaacgacgttaagcttgcgtagacgatcgatgtcctcgggcaagaggttctccaggtgctcgagcgtgttatggccgtgctggggcaggccgtacaggtcggcggcctcctcgaagatatccagcgcggcatgaatcgcaccgtcgccgatgacgtggatgcgcacggtatggccgcgctccgcggccgccagaaccagcttgcgcatgcgctcggcaggaaccgtcaggcgaccttgatcgcccgggaagcgcgggttggtatagggctcggtgagataggccgtgtgttcgctcgacacgccgtcgaagaactgcttaaagcctggcgccgaaagcagcgcgttgttcgcgtaacgtacctgcagctcttccaagcgcgattggtcatccagcagcgtgggaaacaaatgggctcggatgcccagcttgccggtcgtctgcagcttgtcgtagacatcgtcgcggataaaatcacagcccggcatgggcatgagcgacatatcgcagatcgaggtgatgccctgctcggccatgcgcctcatttgatcggcgtaagcgcttgcgatgcgatcttcgcccagccactcaagacagcgcggcaacagctgcatggcagccgcttcgtgagcaatgcccgtgagctcgccgtttgcgtccttgtcgtagctgccgcccgccggcggctcgctgtcgcgcgtgacgccgagcgcctcgagtgcgcggctgttgagccacagcgtgtgcccgtcgcccgagtacataacgcagggacgatcggggaatgccgcatcgagcgacgccttggtaggatgctcgggcgggtcccaacggtagtcgcgccagccctgcgtcacaacccaagcgtcgtcgggcaggtcctgggaaaactcgagcgcatgttgcaccagcgccgcctcggacgtgcccatatccatgagcatgtacggcgaggaaccgaccgaggtatggaagaagtgcagatgagcgtcatggaaaccggggcagacaaactgctcgccgtagtcgataaccgacgtagcggcaggagcggcggcgatcacgtcatcgggcgcaccgactgcgacgatacggtcgcctgcgatggcaatcgccagctcgcgggtggtatcgatgccgtcttgcgcggtaaagacgttcttggagcggataatccgatcgatatgttgcatgggcatccccatctctggcaggaaattcaacacccccgagtgtactcccccgcccttgtaacaaaaccccaagcggcaaacggcaactttaccagccctagcggcaggtggcatactggagagagcctgtacgattttgcgatcaacccagcaaggagcaaatcgaccatgacgaagaccaaggcacagcagattatggcggcgaccgaggctcgcgcggctgacgacgtcaccgcggccatccaagatatcgctaccgagtttgaaccatatatcatcaagcagcgccggcacttccataagcacccggagctgagcctcgccgaggagcgcacgacctccgacatcgccaaccagctcgacgccatgaatatcccctacgagcgtccccttaagacgggcctggtggcaacgcttcgcggcaccgcgcccgacgcctatcgcgaggacggcacgccacgccgccgcatcctgctgcgcgccgatatcgacgccctgcccgttaccgagcagaccggcgaggagttcgccagcgtcaacgagggctgtatgcacgcctgcggccacgactgccatatcgccatgatgctcggcacgctgcaaatcctgcgccatatgaccgacgacatccacggcgaggtccgcatcgtcttccagcccagcgaggaaaacggccagggcgccaagctcatgatcggcacgggtgtgctcgacggcgtcgatggcgcctacgccgcgcacatctggagcgaggtcgacgccggcaccgtgagctgcgagcccggaccgcgcatggccaataccgactggttccgtatcgacgtacgcggcacctcgtgccacggcgccatgccccagcgcggtcacgacgccgttatggtggccgcagagatcgtcaacgccctgcagaccatcgtctcgcgcgagatcagcccctacgagccggctgtcatcaccgtcggcgagctgcacggcggcaccgcacgcaacgttatcgccggcacggcctacctcgccggcacggtgcgcacctacggcgattcgacccacgaggaaatgccggagctcatgcgccgcatcgtggagcataccgcggccgccttgggcgccgaggcagagctcaccgactacaccatcgccaactacaaggtcgaaaacgacgcggcctcgagcgagcgctgccgtcaggctgtaattaagtgtctgggccccgccggccaaggccattatcgcggcacgctttcgggcgaggatttttcggagtacctgcgtcgcgtaccgggcgtgctcgcctttgtaggtacgcgcaaccccaagattggcgccacgtacgcccaacattcctgcttctacaagatcgacgagaccgtgctggcaaagggctccatggtggccgcccagtatgctatcgactttttggccgagcccacgcaagaggagctcgacggccctgcgattaccgcggtcgccgaaaccaaccccgatctggccgccaagttgcgctctgccaaggcgacgaccgccgaggctcgcgacgccatccatgatgcccgaacggctcgccatgccgcgatcaagggcatccacgacgcacgcgctgctgcacgccgtgaggagaagcacgacgggtaatcgattcgctggcatctcgcagtcatagccacatcgcgatgtcaaagcgggggcggacgtttcgacacgtccgcccccgctcattcttcaagcgctatttctaccatttctaccccgtccccaaatagcaggcggcgtggctactcgtcctgaggttcctcgtcggagcttggctcgaacgccgactcaggtgcaggtgccggctcaggctcaggctcaggctcaggcgcaggctcgggcgccggttcagactcgggcgccggctcaggctcggtcgcgggagcgggtgcaggtgccggcgaagcatccggagcaccgtaacccgaaggagcggacttcttctcgaagggcaacacaaaagtcaggacgtcgtccttatcctcatcggcccactcgcttgcatagcgtgcggcccaatagccaacggcacggtgcttgagtatcttgccaaagaccgtaagaaatacggtgacaaaagcgaccagcaccaagaacagcgcgagcgtgacgccaccgccggtaacaattgcctcaatacccgtaggacgatagtagtagctatacataccgacagaggcaatggcgccaaagacgaccgtcaagatccatgtgacaacgttggcgaccaggcccgtcaaaaactcgggaaggaacgaagcacagaacagcttggtcttgttgtgcttaaacgccgcccagaccttatcgagcgaaaacgcgctctcgacgcgaccggtcaccgcaaagtgcatcacggcaatgtcggcgaacatcttaaagaagacccccaggaccgccgtggcaatcatagccagaacgagcaagccaagcgagccaaacagcgcagcctcgagcgcataagagccgtaataagaatacgagcccgcggcgccaattaccacgccctccaccagcgaaagcactacaccgataacgggaatggcagcgataacctcgagcacgaccgaaataacgctcgaaaagactccaaggccaaacgatgtggaacgcatcaacggacgatccatgccgtcatcgaccttgagcgaaagatcacggccccactcaataccaaagccggaaccgcacacgctcgcaatgcaagctgccaaaaagccgatggcagccgcaatgccgccaataacgggaataaacaacacgagcaccgacacaacgcaaatcagcgccggcaaaaacgcgatttggcatacacgctgaagcacgcccggagtcttggtcatatcttggaacgcctgagccacacagccctttggcacattcgccacgggcggctgcggaacaaactgctggggctgaggctgtccctggggagcggggccagcggcaccggcattaggagcaccacacacgccgcagaacttgtcgttatcgcccatgggggcgccacactgcgagcagaacatcgaaatcatcccttcgtatctagagcgaatcacctggatcgcaaacgatgtctttggcatcattatcacccaatgtgaggacaaatactcttagatgacgtatttgcaacgcgcgaggcgcttttcgattgtttgatgagtgtgtccgcgctagttcgtgccgcggaaacccttgccgacgatctcggagctgtcgacaatcgtgataaaggcacccggatcgacttcgcgcgcatagcggcgcagctgcacggcctcgcgacggcttagcacgctcatgatcaccgtcacgcacttgcccgagaaggcaccgtagccgcgactgatggtcgctgtgcggttgagatgcttgacgataaactcctcgaccttaaggggttcggagcaaatgaccgtgcagaccttacgaagatggatgctctcgatggctttgtcgaccacgagtgtcttggcaaacaggccaagcacgcaatacagaccgacacgcgggccatacaaaaaggccgcgatggccacgatgccgatatcgaccaacagcagggcacggccaatctcgagcgtcgtgcggcgcttgaggatcatggcaagaatgtccgtgccacccgtcgaggcgccgatatcaaagacaatagcgctgccgagcgccggcaagatgacggcaaagcacaggtcgagccacatatcgcccgtcagagagacatcggtcggaataaagaactcaaacagcgaaacataggcggacaacgcaaacgaggcgaagacgctccacaggattgccttgcgctccaaaaagataaagcccaagacgacgagaaccgcgttgataatccacataaagacgccgacgggcagggtcgggaacagcgtagacagaatgaccgacacgcccgaggtgccgccaaaagcaaagtgattaggggttttaaacgcaacgatggcgaaggccgtaagaatcaggcccagattgagctcggcaaaaaagcgcgggaagcccggctcctggctgcgcttttggccggcacgctcgccgcgctcgatatcggtgcgatcaaccacgcgctccatcggcaccacgggaggacgatgcacctcctcggcagcacgcgacgccgcctctgccgcagcggcctcgattgcccatgccttgctttctgtttcgtgctcgtcggccattacggcaactcctcgttaacaatttggaaacaatgcgcccattagggtaacgcggaacgcgacgattgcaacccctagttagacgagcggtatgcctacatcggggggcatacaaataacggccggccacgcttttgcttgcgcggtcggccgtttaacgttttcgcagataaagcctgccaaaacaaacctgtccctttttggaaggttattcgtgctggctggtacggtgctcgtactcctcgggggtgatgacgtcctcgatgcgcaggttgacacccgccacctcaaggccggtcatcgcggcaaggcgctcagtgacacgtgccttgacatcgtcgaagatcgcgggcgcataggctccgtactcgataatgacggagatgttgacgaccacgcgattgtcatcggtgacctcgaccgtcacgcccttggtcagattctcggcaccaaactgctcctgcacaaagtgcatgaggttacccttcatgcccaaaacgtgcggaacctcgcgggtggccatggcaacgatcttctcgatcacaccgttggaataggtcagcgagtcctcggactcgtctgtttcctcatcatcctcgtccgcgtcatcggcggactcggcctcgacgagcgcctcatcctcgagcgtcacatcctcggcttcggcgacggccgcctcgttctcctcgagctcggtatcggccacatcgaccttcgtattaaaagccatggttcctccttatgcctgccgcggatgcgacagtcgaatacatattagcggccgctaaacagacggccgaagaagttgacgatcccgttttcgccgtcgcgaatttggccgatcacggcgccgatcagcacgaagaatgcaatgacgagcgtgtcccacaggccgagcgtgagcaccaacacggcaagaataaagccagcgacggcaccgagcgtggtgttgggatgacgcacggcatagctccagatggcagcgcccgtacccttgatgagacccatagcctcgtcaaaatccgcggctgccgcgtcttgtaactcggttgcctctgctttggaatcaacaggttcgctcgccggcgtagcgttctggtcgatcgtcaggcgcggcgtgcgggcggtcttgtcttggttggtatcactcaccggaaacctccacggtctggacggtagtcttggacggcaaaaaacggacgcgtgcggtcgtgcccggcgtgccgagcatggtgtcgcaggcctcctcgatacgttgctgcatcgcgatagcttgagaggccacgtcccggtcgtcgagcgcgatggcctcgaccttaaaacgaacgcgcgactcgtcggagccttgaacgcgtgcctcgatatgctcaactatcacgcgatcatcgcactccgccgcggcacgggcgcacgaggaaagcgctgcgagcgtgacctcgatattgcgctcccccgccggatgcacgcaggacggctcgcgacgtgcaaacatcaggcggaaaaaaccgatgagcacgccaagtgccacgatggcggcgcacaccgcaacgacgacgcgcggcatggggtcgcgcatcagcagcataaagcgatacgtatacggcccccaaaactggcagacaagcgtacccagcgccacgatggcggcggcaagatacacgatcgctagggctcgtttgagtacgcgcacgtggcgctcccttcaaatctcggctctcgaaatgcaaaacggttcgcatcattataaaagagccgggtccggtgctctacgcacgcggatccggctcatctattccacgaggcttgcatgctcgcttcattatgcccagatatgcacggcttaacccgtgcgggcgctactcctcctcgagggcagcgatgacctcgtcggtcatgtccatggtgctgtaaacatcctggacgtcgtcgagctcctcaagacggtcgatgaggcgctgaaccttcttggcgtcggcgccggagacctcggtcggggtggtcgggaccatggtggtctcggagcccttgacctggacgccctgctcctcgagcgccttggagacagccatgacctcgttggcagtagtccagacgatccactcctcgccggcatcctcgtagtcctcgccaccggcctcggcgatggccatcatgaactcatcctcgtcaccggcagcaccgttggcgatcatggtctccttcttggcgttctcgtccaggatctccttggcgacgacgatctggcccttacgctcaaactggaaggcgacggagccggaggtgcccaggttgccaccagcgtgggagaaggcggaacggacatcagcggcggtacggttgcggttgtcggtcaggcagtcgacgtagacggcgacaccggcgggaccgtagccctcgtacacgatgttctcgtagacggcggcatcggcacccgaaccaaaagccttgtcgatagcggacttgatcttgtccttaggcatggactgagccttggccttggcaacggcagcggcgaggctggcgttgttctcgggcagcgggtcaccgccgagacgggcagcaacggtgatgttgcggctgagcttggagaagagggcggaacgcttggcgtcctgcgcgcccttacgatgcttggttgtggcccacttagagtgtccggacatacgtgtctcctatcggtttcgacctaaagcccagcgcagatgctcgggcaatataaacaaacgtcgttatgatatacctaccggcctgcaagataaaccccaaaatgaaggcgtcgtgatgatgcaagcctttggtgcaaagtaacctgaccccaatgcgccaagttaggaccagaggaagtcgctgcgggtgatcgtggcaccgatggcaaaaggcatgcaggcgatgaccgggtacaggtagcgcatgtaggtcgagccgttacatggaccgatcaggcacacggcgagcacgcccagcagcggtatccagatggccagcgcgcgccacgaatggcggcgcaacaggtaaaccaccacgacgaccatgatccacacataggtggccgagctcatggtgagcgagataaacgggatgcgctgcaccgccacgcggtacaggttaatcaggtggtcgcaccagcgcacaaccttgctatcgaccggatggaagtcaaagtacttgaggttatcgggcttcgccatgatctcggcactgcgcgccgtgctgtagacccacgcatcgcgagcgctcggatagaagtacccatagtagttattgacgagcgccgagatatagcactcggggtcctttttgaacatctgggcccacacctcaaaataggccttgatgtcctcctgcgaggcgtactcattgaagcagtttttgacggcatccgacttgtcggggttgtagcgacggcccaggttctcgtacttaagcacgcgatcgatcacagcgcgctcctcatcggtcaccaagccgtcgcagggagcttccacgatggtgccgtcctccttaaccgtggggttgacgcccgagttgaggccatcgtgcttttggacgaagcgtgccgtctgttgaaacggaatcgagaggatctcgcgcttggagcccggcgtgatatcgtgcgccggcataaataccttggtgaaatacatgttggagacaaggcagagcgcaagcactgcgagcacgccgacccagcggaagcgcgacgtggcgcatgagaccgtggtgcccatctgcttagccgcacgacgagcgacatgtacatcccaggcgcaaaacgccgccgcaatcacgcaggccgccaacggaaagaccaggccgccgttgcgcaaaaacgtggaacccatggcacccagcacgagcaacagccagtcatggcgcgcaaagagcacgggcttctgttcgcccgcacgctcggcattggcatcgcgacggggtaggccacatgccacgagcttgacggtctgaacgagcagtaccaaaaacgcatcggcaaaaagtacatctttggtcagcagcaccgcgtagttggagaacatcggcataaacgcaaagaacagcaagatgacgccgcggaccggcaggctcacgcccagcttgcgcagcgacgatatggaataggacatgcaggcggcggtgatgacgaattgggcacaagtgtagatggcaaggcccgcattggcgctgttaaatagcgaaagccccagctgcacacacgagccgatgatggccgtgtgcaccaccggatgatgtccgttgagtagcacgttggggttaagcaggcgtaggtaatcgctcgtgccgttggggtagttgaaccattggcggacctgcgcgcccgtgtctcccataaagaggccgggcagcgaggcgataagcgtgggcgcccagacaatcatgagcacaagaaacggcccgacaaagggatgaaccgagagcacgacgtggacaacacgccacacgcggccaaaatgcgcctccgaaaacggaatgcggcgggagcccaaccaatccaaaaactcaaaagccagatagaaggccacaatcgccagaagcatccagcccgcgccaccaatccaggcgcagataacgcgtgccttgtcgcccagcacaatctcagccgaatcggtgaggtcgtagctgcggccgaacaccatgcagatggcgaagaacagcgacggcagaatgatcgatggacgccaggtgtcgccacggccaaagaacacgtagcgaaacggcaaggtgagcaggcaggcaagtgcaagcagcatgaccgcgtcggtatggccggcaaacgaaaggagcacctcgtagcacacgtacagcatgcccgaggctttggggtcaatcgccaagactgcgttgctcgacaccggggagggatcgatggaaaacgccgtggtcgccaacagcgcgagcaaaaatgcgatgagcgtctgcttggcggggtagcgcttaaaccagacgatgcgggcagcgtcgcgcgcagccgttgtggagaggtcggaatccttcacagtccgaaagcctttctagaaacctatcaaactcggcaaaaccaccacaaaggtgcctgtcccctttgtggtggttttggtggttaggcgtcgaggtagatgcgctgggggcgattgcggtgtcgggcgaagatgatgagcgccagaccggcgatcacgagcggcaaactcagcagctgacccatggtgatgacgccgcccagcagataacccagctgggcatcgggcacgcgcacgaactcaacgagaaagcggacgatgccgtaccccatcacgaacacgcccataaacgtaccctggggcagcagcggctttttgcggctgagcacctgcagaatgcaaaagagcacgatgccctcaagaaatgcctcgtagagctgggaggggtgacgcggcatatcgcccgcagtcccgccaaaaaccacgccccagggcagatcggtcggcttgccccacagctctccgttgacaaagttggcacaacggcccaggcacaaggccagcggcgcgcctatgacggcaaggtctgccaaagtccatgcgtcgagcttatacatgcggcacacgagcacgccgccgatgatgccgcccaccaggccgccatggaagctcatgccgccttcattggtggcaaagatctcgagcggatgcgcccagtagtagccgtcgccgtaaaagatgacgtagaacaggcgcgcaccgataatgaggccaaagaccacgccgaccacgacactcgtcaggtcatcaatcgtgatgttaaagccccagcgacgctgtgtgcggtacatgacaaccgccgtgagcagggcgccgaccacataggccagaccataccagtaaatcgtgataggccccgccgaaatcgcgacgggatcaagcatatggtagaagtcgttgagcatgtcgaccctcctactccctacatacaaatgcggccgcgggccttacgctcgcagccgcatatttgggcgtaacgtctatgcggagcgtaccgtccgcagctttcgcatcttagaacggcgcgtactcgtcgtacaggtcgtcggtctcgccggaggcattgacctgctcgacacgggtaacgccgggcacgtgctccttcaggatacgctcgatgcccatagacaaggtcagcgagctcatggggcagccggcgcaggcgccctgcagctccagcttgacgacgccctcgtcgtcgacgcccacatactccatatcgccgccatcggcctgcaggttgggacgaatctcttcaagaaccttcttaagcagctcttcgttaacagccacaggggctcctttctcacaataacgcgggcacacccgcggacagaagctatgttactacagccatgtacccgctcacgagccgtccatgcgcgcagacgcgactttcacgagtagtcaatttgggacggggctctttgagctgcgttcgtcgtcagatagcgacaacgcatgattactgtcgagcctgtcccccggtaccaatctgaacatcgacgatgacctggcggtagctgatgccacaggagtcgaggatgcggcggctgatgcgtccgtcatcggtgtcggcgtacttgttgtccaggtagacaacctcgcccacgcccacctgagccaaaatcttggcgcagtcgtggcacgggaacagcgtgacgtagaccgtggaaccctcgaggtccttgagcgagccacggtagttgagcacggcgttggcctcggcatggaccacgtagttgtgcttgtcctgcagcgggtcgtcgctcgtaccccacggaaaaaagtcgtcgttgagcgccgagggtgtaccgttgtagcccaccgaaaggatgcggtggttggtgttggcgatgcacgcacccacctgcgtgttggggtccttgctgcggcgctgcgcggcgatggccacgctcataaagaactcgtcccagctaatgacgtccaggcgcttgcctgacgaagtttgatgaagatcgtccgacatggcagacacctccgtaatcgcaatagtttgacccattgtagcaggtgaaaggtgagggcgtttgtcccgccggcgccctcacttttacacgcggcggggcttttggttgatgtggtagagctcggcgagtcctcgcaacgtcagcgcgtcgtcgaccgtcaggctatggccgacaagggccgcgagcgcctcggcgtcgtcgccggtaatgacgatgggcacatcgccctcccccgcagccttggtcgcgcgcatctcggcgagcaccatgtcgagcatgccgtcgatgcgtgccacctcgcccaagaccacgcccgagcgcatggcctcgcgcgtgttgcggccgatcacatgcgtgggcgccgaaggctcgacctgcggcagacgcgccgcagcggccgagagcgagcgggcgccgagcgccagacccggcgcgatgacgccgcccacaaaggtaccgcacgcgtcgatgacctcgatattggtcgtagtgcccaggtcgatcacgatgcacggagagccgtaaacggcccgggccgccacggcgtcggcgatgcggtcggggccgatctcggccgggtcgtcgtagtggacgggcatgccggtcttaagtcccggccccaccgtgagcacgcgccccgtgcagatgcgggaaagcgccgtcttccacgggcgctcgagcgccggcaccacgcagctcagcactgcggccgcgggaacgagtgcacccggcatgcccgcatcggccgctagcgcggccatgacttgagcgagacgcatgcgcgcctcgtctgctgtgatgctcgacggcgtggtgatctcgcacgtcgcaagcgggcattcctgcgccgcggccgaatcctcggcaaacaggccaaagcgaatgaacgtgttgcccacgtcgaccgtcaatatatatgcgcacccattaagcatcgtcggcgctcctttcgtctgcccagcagtatatcgcctacctaaaccagtcatcccgaaatgactagcttgcggttatactggtgcgcggtcgcgcgcgagctcacgcggcggcccttggtaacccgacttcccgcgccgtatccgtagcggcgctcccgggggaagcggatatacgcaaaggagttctatatgagcaatccctcgaaccgcgcttcgatgcgcgggcaactcacgctgcgcggcgtcgtcatcggcgtccttggctgcgtgattatcacggcaagctcggcctacaccgccctcaagatgggcgctctcccctggccgatcgtcttcgctgccgtcatttcgctgttcttccttaagctcatgggcaatgccagcctcaacgaggccaacgtcacccacaccatcatgtccgcgggcgccatggtcgccggcggcctggcgtttaccatcccgggcgcctggatgctgggatatgccgaccagatcagctggctcgacatgtttatcgtggcactcgccggcaccatcctgggcctgctggccaccgcgctcatccaccgtcactttatcgtggacgccgcgcttgagttccccaccggcaacgccgcagctcagaccctgcgcgcaaccgaggccggcggcaaaaccggcaagcagctctttggctccatggccatcgccggcatctacagcgtgctgcgcgacgctctgggcgtggtgcccagcatgctgtgcacgctcaatatccccggcgtgacctttgccatctacaactcgcccatgttgctgtccatcggctttttggtgggcttcgcccccgtcgcgttctggtttgccggcgcgctgctgggcaactttggcatcatcgtgggcggcaccgctgccggtctgttcgatgttgtgaccgcacagggcattgttaagtccctgggtatgggcctcatgatgggctttggcgtcgccgtcgtcctcaaggacatcctgccgcaggtcgccggtatcgtccgcggcctcgccgccgacagctccaccgacaccgacgagcagtcgctcatctcgggctcccttaaactcgacgccggtatcatcggcctgggcgctgccgccatcgccgtgatcatcgccatcgtgctcgaccttggccccgtcccggccgtcatcgtcacgctgttcacctttgtcaccaccatcatgagcgcgcagagctgcggccagacgggcatcgaccccatggagatcttcggcctcatcgtcatgctcatcgttgccgccttcgcgcagctcgctcaggtcaagctgttctttatcgccggcatcgtggccgtagcgtgcggccttgcgggcgacgtcatgaacgacttcaaggccggcgccgtgctgggcaccaacccgcgtgcacagtgggtcggccaggccatcggcggcatcgtgggcgccctggtcgctgccgccgtcatggtcgcgctcgtcaccgcctatggtccggacgccttcggccccgacaagagctttgtggccgcgcaggcaagcgtggtcgccaccatggtctcgggcatcccgagcgtgccgtggtttgcgggcggttttatcgccggcatcgtcatgtactggctcggcattccggccatgatgatcggtctgggcgtgtacctgccgttctacatgtcgctcacggccttcttgggctcctgcgtcaagctcgcctacgacaagtgggctgcacaccgcgacgccgccgccggtctttcggacgaggagaaggccgccaaggatgccgccttccaggagcagggtctggttgtcgccagcggcctgctcggtggcgagtctatcgtcggcgttatcctggcgtttgtctccgtgggtctgagcctgctgggctaagctgagcagctgctcgacagcaaccatattgtctacgatttgctcggtcggcagctttcgcggctaccgaccgagctttttgataccaccgcaaagaaaggccggcgcgccgcgtatgacagcgcgccggccttatcggttgagttatcgagtcggcctcgcgacgaattgcggtatgtcgcgaggccagcgctcaatacgctacatctgcttgcgacgacgatcgctcagcgtcacgcccgcggcaacgagcgtaatgccgccgatgacgaacacctcgcccgcaagcgcggagttgtcgccggtctgggcaagcgcgcccgacgcagccttcttcttagcggcaggggcctttgcagcagcctgcgtaacctgaggcttagcctgcggctcggccttgggatgatacttgtcgtactcggcctgtgcagcagccagggcgtccttggcatcgccgagttctgccaatgcggcggcataagcgtcgttggcatcggacagcttggcatcggcatcgctcagggcagtcttgaggcccgcagcggcatcgacggcggacttgtatcgagcgtaggcggcattcagcttggtcagcttatcgttgcccgtcgtgcccgtggcaagggaggccttgtggtcgacggcctcaagatcggccttgagcgcctcgtcgccggcaagctcggccttggccttgatgatatcgaagttcgcatcgacaacggccttgttggcggcctcgagctgcttttgggcatcggcgacaccggcaacggcggcatcataggcggccgtggcgtcatcgaccgccttctgggcgccggcgaagcgctcgaaggccttgtttgcgcgggccagctcgccctcggcggccttgaccttcgcctgtgcgtcggacacggcctgcgtcttggcggcaactgcctgcttggcatccgaaagagcggtcgcggcgtgtgcgcctgcggcttgagccttatctacgccagcctgagcggcgtcgtcggccttcttggccccgtcaagcgcgccctgcttgctcgcaaggttcgcattagcggcatcgcgcttggcagtaaggtccttgaccgaagccgtggcattgtcatacgcctcgttggccttatcggactttgtcttggcggtatcgtaatcgccctgtgccttcgccttgcgggcggaagccttggaggcgttcgtctggcattcggtgagcttggagttagcgtcgtcaagtgcggcctgcgcgacggtcgcctcgtccttggcggcgttgagatttgccctaggagtttcgatgtcaacattcttcaaattgacatcggcagcgccatatgccgccttcgcgatagcggtggcctcttgcgcagcttcatagtcgctcttggcagcagcaacgttaccgttcgcttcattcgcggcactcttggcagcatcgagggatgactccgcagagccaagcgcatcgtttttcacatcgagcgccttccgtgctgccgcaagttgatcttgcagctgcgccagctgcgccttctgcgcggcggtaccaccggcatgataaacggagtctacgtacgtgtttaccaggttcttgaactcgtcaaccgtaaaatcgccttcggcccagtttccctgataaattgaaacaggactgggtgcaccgtcatcctcgggcgttgagcggttgccatccttaccgtagccgacggcgaacccaaaggaattagcacctgaatcaataaagttctcatagtggccggtgttgctatagtcacccctgtcatagtcacgcttttccgcagtataccaaccgataaacggccaatcatcgccgtacttgtcgccgttatcgaaggatatttcccaatctttaggattatctgaccccttgtaggcgccagcacgtccggcaaggttttcgttataggacatataaaagccctcgccgctgttccccgcgtggtcccaaacattcgacgaatagcaaacatcgagcgccgactgcgccatagagacaatgctgaccttcatgtcactcaagccatttgcgcgacgaattccattgacggcattcatgtaggtcaaggtattctgcagattcacgagcgaaaaagcattgtcagcgtcagatgcatccaagttgacatagtcgtcataccatgccgccttgctagcagacccatcaagtaacttcgccgcatcgctcgcgttggcacgctgagcagcagtaaacgacgtactacttgcgatgtgattcataaagccaagcaggccagccttgacagcatccgtatccaccgtcatgtttgcttttagctcagaaatctgctgctcaagagctttgacgtttgcgctggccgtgttgtattcatcattcgctttgttgtagtcgctggtagcattctcaagagcgcttttcttctgctttgcgacctctgctagacggtcgtactctgtcttcttgtcggcctcggtctgctgagcttgctcgtaagcagccttggcggtgttgtatttgctggtcaaatcaccgagtttgccgttggcttcgtcgtatgcagtctgcgctgacgaaacggcagcgttggcggcgttgaccttttcctgcgcggcgctggcatcagtctgtgcggcctggaggttcgtttgtgcggtggcgtcggcagccttcgcggcatcaagctcggtctgcgcgtccttgagctcaccggcagcagcttccttggcggcctcaagcgcttttagatcgatgcccgtgcccgagatggcggcatcgagcgctttctgggcgtcgttcagcttatcctgggcgttgccgcacgcggtggtcgcagcggcaagggcattggcggtctcctgcttcttggcctgggcagtcgtcagagcagactcggcatcactctttgcctgctcagcattgtcggcggcggtcttagcggcatcgagctcaccctcggccgtcttcacatcggcattcgccgcattgagcttggcctgcgcgtcctcgacggccttcttggcggcctcgtactcgtccatacccatggcctcgagcttggcctgcgcatcgtcgagggccttcttggcctcatcctgctttgccttggcgtccttgagcgcctgggtcttatcctcgacactcttgttggcctgatcgagctgatcgttcaggtcgcccagcttcttctgctgctgctcggccttgtcaacagccgccttaagctcgtcgatcttctcctgaagcgcggctgcctcggcctcgttctgctcggcggcgttatcggtcacggcctgcgaggcctgattcttttgctgctgtgcctgcttttgagactggcccgccgcgtcggccttcttctgggcggcatcgtaggcggcctgagcgtccttgagctgctttgccgactcctcggccagctgggcagccgtctttacgaccgcttggttaccggcggcaacggtgttctctacagaactacccccccctgaacagaatcgccgttatcggttgacggtgcagcgattgccgccagcggcgacatgagcggctgagcgatgaggcccgccgtcaaaacggttgcgacggcgcggttggcaacgcccttgacgttgacggccttggcccgaggctcaaagtgttgtggactgtagtttgccatggctttctccctttgacacggatgtatccatacgtatcaaacggtagctgtcgatttttgaattctgttgcgcaacattggcgaccagcgtattttttgaaattcacgctctcgtgcttcacagtttcgtcacatttgaaggagctggtgcatcatattctcgcgggatggaattgagcctgtgatttgcatttgctcccgcgtcatccgccctatcggattccgcatccaacagacaccccgcccgccacggtgtagagttatgacaacgggcgcgttgcgcggaccgcgctggaacgaggtggacatggaactcgacaaacaacagatcaagcgactacgcgaacgccaccaccggcgccacggcatccgccctgcccatagcgaagccatggaaaacatcacccgcttcctcaagcgcgcattcaacattcgcgagggtcgcgcgccctaccacgtgatccgcaagcgttttgtaaacggggcgcgtctgactggctcccacctatgcatcctcatcatcgccatgctgatcgcaagcatcggcctcgatatcgattcggacatcgccatcgtgggcgccatgctcatctgcccgctcatgggctcggtccttgccatggcatacggtattgccacgctcgaccgcgagattaccgtcgaagccgtcgccagccttgcgctgcagatggccttttgcctggtcacgtccacgctgtactttaagctctcgccccttggcaccaccacggccgccatcatcgacaactcgacacccaccgtctgggaccttaccgtcgcactcgcaggcggctttgcaggcgggctgggcaactcgcgcgaccaggaacccgccacgctcatcgccggcgtggccgtggcgaccgcgctcatgccgcccctgtgcgcggcgggctacggcatcgccatcgcaagcgggtcactgtttctctcggcgctttatgagtttggcatcaacgtggtctttatcgcgctggcggccgaagccgtattgcttcttttacgtgtaccgctcagtcatagctcacgtggtactgagcagagacctcgaggccgatggtcnnnnnnnnnnctggcggccgaagccgtattgcttcttttacgtgtaccgctcaagcgcgacctcaacggcgacggcattgtgacagccgaggaaaatgccgaggtcgatgagctgtcacgcaaggtgcgccgccgcattattgtgggcacggtggtctttgccatcccctgcatcgtcatgacggcgggttccattggctcggcgcaggccggcgtgcaggacggctacggtgtcaccgaaaccacgcgcgagcttgccgcggtgctgccgggctttaaggattacaccgtcgccgtcgagacctcggccaccgaaggcgacgaggagggcatcgtcgagcgcgagattgtcgcccatgtgacgacaagcgaggcacttggggcacacgaccgtcacgtcgcccgcaagctcattgacctcaacgtgcccgaactcgatcgcgtggagtttgatgtggagtaatgcggagcatgggatggctcccgcgcacaggcgcaagtcgcggcgaggctcagacgcgacgcaggcacaagcaaaaagcgggacgtagttcacgtccgcgccccgctcgctgttttattgccgtgaatcagacgtccgcatcgacatcgccagaccccaccgtaaacgctggatcggtgctcacaagataaaatcgggtcaccttagtatttctaattaggtaaatctgcccctgattgcgtcggcgcgatatatacgcaacgtgaaccgtgccgaattcttcgccgttttccttctttaatatcaggatgttggggtcatccgtacgcttaaactgcccgtcaacgcagctgccgtctttgtcgaccagttgccatcgacagccatcctcctcaagaaaggccaggatttcccgactcgttttgtcatcccggtagtaaccatcaatggcaaacccttcggaagcgcattcctgcatataggacgtttctcggcttatagcaaacagccctgtagcgcccaggagcacagtcagacagaccactgcaagggttaccgaaatagcacggcggtccatgttagcccaatcgatagttgtttaacggagcgcgaaacatacctggagcctctgatatcagggggaacgtcgccagcaggctggcgacaactatatgtttctgatatcaaaacatatggctgccactcgcggagggggcatcggcgaacggcgtgttttcatactccattggtcaaacctaagcgcggccctacagctcgtacttgtacacgcggtagatgtacttttcggcttccatctcgtaggtggtgatggccagaccgtagcggtcgtctcgtcgtttggcagataggtcacactgtgctggcctgcgttgagcgaaaaatcgccttgggcctgcagcaacttgtcctctaagcccgagccggcccaaaaatcgggcaagtccacggaaggctgtagcaaggtcatttacgcaacatatgtccagcaaaaacgggtggtagccggtacggctaccacccgtttgtctcatatctagcccatagcagaccagctacttcttaatgccgcgccccaggcgcttggcgaccgatgcaacggcctcctcactggcagatccgcagctcgcacagccgtcgtgggcacgcatctgaccggtgacctcgtccatcgcgagcggcgccaccttctcgagcttaaagcctttaccggcgcgcatgttttccttggccacgctaatcatgagcttaatgcggttgagctggttgacctcggacgcaccgggatcatagtccaccgcgacgatgttgctctcggggtgctggcggcgtagctccttaatcacggccttgcccaccacgtggttgggcaggcacgcgaagggctgcgtgcagatgatgttgggcgcaccgtgatcgatcaggtcgagcatctcggccgtgagcagccagccctcgcccatgttgttgcacaccgaaagcaccgtgcgggccttgtcggccatggtgccgatgcgctcgggcgcctcaaagcggcgagacttttcgagcatctcctccaccggcgtgcgcatccagtccacgagcttaataagcgcttgcatgcccgcgcgtgtagtggcagagcttcccagctcgtccttctgcagctcggcgttgctcatggagtacaggaagaagtcgagcaggcccggcactacggcctcgcagccctcgcgctcgatgacatcgaccacgtggttgttggccgtagggtggaacttgaccaggatctcgccaaccacgcccacgcgcggcttggtaccctcgcccacgagcggcatggtgtcgaacgcgcggatggcctcgcggcacagcttggtgtagttgtgacggttgaacttgggcgccagcttgcgggcgcgcgccatgnnnnnnnncattcctgctgaaccgctcttccgatcttctaagctaacttgggcgccagcttgcgggcgcgcgccatgtactcctcgtagagcgcattggcggcaccggacgttgcctcgtacgggcgacagcggtagagcatctgcatcatcacgtcgccaaagagcaccgcgtagaccgcctgcttgagcagagccggcgtaatcttaaagccagggttgtcctcgccgagcgccacgaccgaaagcgagatcaccggaatctcggggtggccgctctcacgcagagccttgcggatgagtgcgatgtagttggtggcacggcagccgccgccggtctggctgataaccacggccgtcttggacaggtcgtaccgaccgctctcgatggcctccataatctggcccgtcaccaggatcgacgggtagcaaatgtcattgttcacgtagcgcaggccggcctcgacggcatcgtggtcagtcgagggcagcagctccaagttgtagcctgcaccacggaacacctctttgaccagatcaaagtggatcggcgccatctgcgggcacaggatggtgtagccctcctcgcgcatctgctcggtaaagggcaccttgggccacgcggtcgaagcactctcgcgctgcgcctcgaacgtgtacttgcggctcgcgaacgcgggggcatccgtggagggcgccaccggcgcggcatcgccctgctcgtaggcctcgcccgcggccgttgcctcagccaagcgctcagcctcctggtccttaagcgcagccatgagcgagcggatgcggatgcgcgcggcacccaggttggacacctcgtcaatcttgagcacggtatagatcttgccgctggcttccagaatctcctgcacctggtcggtggtcagggcgtccaagccgcagccgaaggagttgagctgaatcaggtccaggtcgttgcgcatcgtcacaaaacgggcgacggcgtacaggcggctgtggtacatccactggtcgacgacgcggatgggacgctcgggcttcaccaggtgcgcaagcgaatcctcggtaaagaccgcaaagccaaagctcgagataagctcgggcagggcgtggttgatctcggggtcgttatggtaggggcggccggcgagtacgatgccgtggccgccgtggtcctcgacccacttaagagcctcctcgcccatggtctggatatcctcgtggaagcgcgcatcggcctcaaaggcagcgttgacggcggcatcgacctcggagcgcgtgatcttgggtccacgcacgcgaccgcgaccggcctcagcatcggccacacggtcgacggcgagcacctggtacagacggcgcttaagctcggtcttatcgtgatacggcacaaacgggtacaggaactcgatgttctgctcgcgaatctcgtcgatattgagcgccagcgccgtggggtagctcatgacgatggggcagttatagcagttgccagccgtcggatcctccttgcgctcccagcgcacgcacggcatccaaatgaagtcgacgtcacggtcgatgaggttcatcacgtggccgtggctcatcttggccggatagcacacgctctcggacggcatggactcgatgcccgcctggtaggtcttcttgctcgactggtcggacagctgcacgctaaagcccaggcgtgtaaagaacgcgtgccagaaggggtagttctcgtacatgttgagtgcgcgcgggatacccacggtgccgcgcggggcctcgtcgggactcaggacctcgcggttaaagagcagctcgtttttctttttgaagaggttgggggcctcggtcttctgctttttgtggccggcgcccttctcgcagcggttgccggtaatgaagcgtctgccgccgccaaagtcgttgacggtgagctggcagttgttggagcaacggccgcagcggacatgcttttgcgtcacggtgaggtgcgcgatgtcctcggctgaaaggatggtcgaggtgccatcggcgccggcgcgatcgcgagcgagcagggccgcaccataggctcccatgcagccggcgatgtcgggacgcacggcatgaacgccggtgagctgctcaaatgcgcgaagcgtggcgtcggacataaaggtgccgccctggacgatcacctggctgccgatctccttggggtcgcgcagcttaatgaccttgaacagggcattcttgatgacggaataggacaggccggccgcgatgtcgcccaccgtggcgccttccttttgcgcctgcttgacgcgcgagttcataaagaccgtgcagcggctacccaggtcgacgggggccttggcatggatagcggcatcggcgaacgcgcgcacgtccatgttcatagagacggcaaaactctcgataaagctgccgcagcccgacgagcaggcctcgttgagcatgatgtgctcgataacaccgtccttgacgcgcaggcacttcatgtcctgaccgccgatgtccaggatgaactcgacgccgggcaggaatgccttggcgccgcgcaggtgcgcgacggtctcaatctcgccggagtcggccttgagggcctcgatgagcagcgcctcgccgtagcccgtggtggtcacgtggccgatggtgcagccggcggggatgtggttgtagaaatcggccatgatgaccttggccgtgccaaggatgtcgccgttgttgttaccgtaccaggtgtgcagcagctggccgtcctcgcccacgagcgcggccttcatggtggtggaaccggcgtcgatgccaatgaacacgcggccggtgtagccgtcgagcttgcccttgggaacgacttcctggtcgtggcgggtcttgaactcggcaaagtcctcgtcggtggcaaagagcgggtccagacgctcgacctcggcaccctgtgtgtcacccagggcatcgatagcctcgatgagctgcgggaacgtgctgagcttgttggactcatgcgccatggcggcgccgctcgccacaaacaggtgggcgttttggggcacaatgcggtgctcctcgtccaggttgagcgtgaggtagaagcgatggcgcagctcggagagatactgcagcgggccgcccaagaaggcgacgttaccgcggatgggacggccgcacgccagacccgagatggtctgggtcacgacggcctggaagatggaagcggcgacgtcctcgggacgggcgccttcgttgagcagcggctggacgtcggtcttggcaaagacgccgcagcggctagcgatgggatagatggtggtggcgttggccgcgagttcgttaaggccgctggcatcggtgtgcagcagggttgccatctggtcgatgaacgcgcctgtaccgccggcgcaggtaccgttcatgcgctgctcgatgccgttgtcaaagtagatgatcttggcgtcctcgccgcccagctcgatggcgacatcggtggccgggatgagggtctcgacggcacgcttgctggcgatgacctcctggacaaactccaggtcgagccactgggacagcagcaggccgcccgagccggtaatggcgcaggtcatctgggccgtcggcagcacggtcgcggcaccctcgaacaggtcgcgggcgcaggcgcggacgtcggtgtggtggcgctggtacttggcgtagacgatctggttgtcgtcgttgagcacagcgagcttgacggtagtggagcccacgtcgatgcccaggtgcaggttgccacgagcgttctcggggttgaagatcgcgccttcgggggcgtgggcggcggccacggactcagcggcggtggcgagctcgctagcgacggacgtctcccctgctgcgttcttggcatcggcaactgcctcggcaactttctcggcagccgcggtcgcggccttctgcgcggcgtccaccacggcgggcgcggcctcgcgtgcggcagcaaccatacggtccttaatgccctcgacgagtttgctcatctgtctctcctcttagttgttggactcgacggttgcgacggtgtcggccgcgtcctcgagctgcaagttcaatagcttcatgccatattccggcacgttgatatcgatgggttggccatacaggtcaccagggcgcacaaaagcgagcaccgtcataatgcgcgccatggcctcgggcgattcggtgagcccacgctcaaaccagcgctgaatcatgccgacctcggcactcacgacgtaggtgacgtagtagtcaaagaacgtacccagcgccaggcccaaaatgcccgtctgcgcacgcggcaccacagcctcacgagcggtgtcgatgatccttttaatgaaggcctggtcgccgcccggacccagcagcgcaccgattaagtcgcggttggccgcaagataacgcagcagctcaaccgaaccgggcgccggctcgagctcatcgatattgtgatagagatcaggcagctgagctgcagtgatgagctcaatgcgctcacggatctcggccagcaagccgtcctcgatttgattgataaagtcgggaatatcgcggtagtgcgaatagaacgtgcggcgtgtaagaccggcgcgctcggtgagcgacgcgacgttaatgcgcgaaaagtcgccgctttcggcaagctcgctggcaagcgcctggcgaagggcacgctgcgagcgaagggaccggcgatcgcatttctcgagctgggacaagcgtcctccttgttactcagcctgtgcgctattgcacagtgcgagtattattgcacaccgtgtgcatcaacacgtaaaggcaatatttaggatgtgacgaagggcagtccctttgtcacattattcgatgacggtgcgggagttttgcttgcgcatggtggcgagcatatgcttgggaacggcgtggaccatgcaactgccgatggtcacgctcgcggcggccttggccgcgtcactgccgtttttggtcgcgtagctgtgacggaaacgcttgagcatggcgatatcgttgccgccgtcgccgtagaccgcgacctcgtcctcggcaataccgtagtagcccgccagccacgccacgctctcgcccttgttgcacgccacgtccgtgatctcgaacatcaccggatcgaacggcgcgttgaccacgcggtccgatcgctcagccaaatatgccttaaggtcgcgctccagctcgggcgaggtcacgcggcagttgattttgcacacgtcatgacgcaggatgtcaccgatcgactggtcgaaatactgttcctcgtgatacccgccacgtgcacgcatgccgcgcatcacgatgcgcttgataggactgtcctttttaaagcccgcctggtgcatctcgaacgaaccgctcgagaacatgccgtcgggcgtggagcagtcgaagcaaatgtccgggaacgctttgagcagctcctcggtaacctgcgggtcgatggtccaggtcttgagcacctcaccatggctgtcgcgcacgatggatccgttggagcagcaggcgtcgagtgccagacctgtgaagccatgctcgccgatcggcagcgtcgagcgtccggtcgcgggaaccacatgcagcccggcttcggtcagctcgcgaatggcgcggcggatggttccgtcggcctcgtgtagggcattcagcagcgttccgtctaagtcactcgcaaacatcttgatcatgggcatgcctctccttcgtctgcacgatattgtagacgagaacgggcgcgccccaagagaggcacgcccgtcaggcgaaagattgtcctacaccgcggcggggccgtgttcgccggtacgaatgcggataacttcttcgaccggctcgacccagatcttgccgtcgccgacggctccggtgcgagcagcgttgcagatgatgtcgacaattccgtcgacatgttcatcggcgcagatgagggtgaactgtaccttagggatcgtgttgacaagcaactcgttgccgcgcacgtattccttccagccatgttgcgcaccgcagccctgcacctggttgatagtcataccgcgaacatcagcagcaaacagcgcgtccttaagaacctcaagcttctcggcacgaacgatcgccgtaatcttcttcatagtgaattcctctctttaataaagaaatgaattgtcattcaatgacgcgggttttccaggtgcccgagattgccccgaaagaggagcgccgcgtacttcggtacgcaagcgacggtttgaggggcaaggtcgggtgcctggggaagccgcgcgacgattgaacggcaaggtgcggagcttggggaagctgctaatcgagtccggagaacgaagggtaggcgctctcgccgtgctgactcgcatccaggcccagcgcctcgtcggcctcgtccacgcgcaggctgccgtggaacagcgccttgaccaccgcggcgatcaccaagtcgagcaccagtacaatagcgaccgtcaccacaatgcccaaaatctgcgagatgagcagcgagacatcgcccgtgtagaacaggccgcccttaccggtccacgagagctccggcacgcagaacagccccgtgagcacgccgcccaggatgccgccgatgccgtggcagccaaacgcgtcgagcgcatcgtcgtagccaaatttggtcttaagatggctgatggccaggtagcagacgggagatacgatcaggcccatgaccagcgccgcccacggctcgacaaagcccgcgcccggcgtgaccaccacaaggcccgcaaccagaccggtgctggcgcccaccagcgtggggcgacctgtgtgcacgcgctcgacggcaagccacgagaccatgcccgtcgcgctggccgtcacggtattgaggatggcaagtgccgccacggcgtcggccttgaactcgctgccgccgttaaagccaaaccagccaaaccaaagcaggccggctcccagcgccacaaacggcacgttatgcggacggtagctcaccatgccaaagccgcgacgacggccgagcattaagcagagaatcaggcccgtaagaccagacgagatgtgcaccacgtcgccgccggcaaagtcgagcgcgccgatgatatcgccaataaaggagccctcgccgccccaagccatgtgagcgagcggcgcatagaccacgagcagccaaatacccaggaaggccgtcgtggcaccgaacttaacgcggccggccaggctgcccgtgacgatagcagccgtgatcatggcaaatgccatctggaaggcgatgttgatgatctgagggtagacgacaccgtccgcagcattgccctcagccgcctgcagcacctggttgagcaccggcaggcacagcagctggtcaaggcctccaataaacggactcgaaccgtcgccgccataggccagagaccagccggcaacaatccacagcacaccaaccagaccaatggcgccaaagcacatgagcatggtgttgatgacatttttgcgcctggacaggccgccatagaaaaacgccagacccggtgtcattaaaaacacgagcatggtgcagatgagcataaacgttgtcgatcccgtatcgtacattcgctctcccttggtcgcatgaacgttgtcggcgcccataatgcggccgaggggcaactggtgtagaccagatacggcattgttaaacgcggcgttgtcgaatggaaacggcgccgcaatcttggaaacggcgcggcaacggacgcgaaacgaacgggaaatacgcgagcaaggaagccgtgagcgcgcccgtctcggctagtggcggaacagctcgcgggctcggtcgcggagattagttgctcgaatgacgccttcgtagcgattgatgcgcagacgcgggaaggcgttaaagaagcgtaggtcgcggcggctgagcgacacgcttggcaccggacggctcatgcgcttgccggcaaggcgacgactgagcgacggacgcggcatgctcggcgcggcatcggccacacggcgggcagcaagtgccaggccgcgagcaccatccgcgataaacgtcggcattgaagccttctcgcgcagggcatcgagcgcggcgtcacccagctcggccagccacgcgttaacggcacggctacggatgtgcgtttgtgccaccgagtcaatcgtcgattcgggaatgcgctcgagcattgagtccgaggcatcggcaagcgactcgttgatgcggtcggcaagatcggcgcgcacgcgctccagctgatcggacagacgccgccagctcgccagcgagcacaacgcgtcgaccatcatcgcgaccgcgacgataaaggcggacaaccgcacaatcagcaccggcagacggccaagcagccccagcaatgccggctccactaaacggcaaatacacaacgcacccaagccaaacgcgcaagcccagtacagacagatgcgtccgtgcaagttaaacggcaggtgcgagtaatcccaaaagcgagcgcccgttgttttttccaacagcacgcctacgctgtactcaatcacgctgcatacgagcgctgcagcgacaaactggctcgaggcatccggaatcccgcgcaacagcagccagcaggcaatgccgcccacaccatagataggacaacacggccccagcaaaaagccactgttggcaaatcgtccgtgattgagcatggcgcatactgtcgactcccatgcccaaccgcaaaacccgtaaaaggcaaacgagagcaccagtgccgagagtgggcaggcggcaagcgtcgcgccgcaaaacgcagtatcaatcgcggtccccaccgtctaccctctcctcttttcgctcgatgctttactcgcgctatcgtccgtctcgtccttgcgcggcaggcggccggcgaccgtctcacgcagagcacaccatttatccgctaggcacacaatccatgcctcacgacacgtcggcggcaccagcaccagcggaaacatatgccgcacgataatattccgctcgcgcggcgtcagctcaaaatcttcttccgcacgcgccagggcaaaaaacgggtggcgaaagccatgcagccgatggcttgggtcggaatcgtgccaatcgtagagaaagtaatcgtgcaacagggccccgcgcagcagcgaggcacggtcgaccgaaatgccagcacggcccaagtgctcggcaaaggacagactcgcgcgcgctaccgaagtcacatgtgcatacaccgtcacatcgccatgctggataaactcgcgcgtcaggtccagacggcccgcctgcgccagttgacgggcagcatggtctacttcgcacgcgattttctcggcacgaacggcatcggacatgctgcctccttccagcggctcacggcggcaagccacggcctgtgcacaatcgataaaaacatcatggaacacatcagtatggcatcggacaaaacgttttgccccaccagttggcgaattaccgcgccgccgtcacatatcaaacgccaaaatgtgcgagactgtcttgtgcaattgtgtcggccgagggagcgccgacgctcgattcgcatggagtaacccacaacgatgctgcttacgcaaacgacaacgcccgaagacgtcaaggctctcgaccgcgccgagcttccgctgctctgcggcgagatccgccaggcaatcctcgaaagctccgccgccgtcggcgggcacgttgcccccaacctgggcgtcgttgagcttacggttgcgctccatcgcgtgtttaactcccctatcgacaagattgtctttgacgtttcgcaccagacctacgcccacaaggcgctgactgggcgcgcgtacacttatatcgatccggagcgttatggtgaggcttctggctttgccaatcccgacgagtccgagcacgacctgttcgccatgggccatacctccacgtcagtgagcctgggctgcggcctggcgcacgctcgtgacctgacgggcgatgcgtacaacgtcatcaccatcattggcgacggctcgctttcgggcggcctggcgtttgagggctttaacaatgccgccgagctcgacagcaacttgatcatcatcgtcaacgataacgaccagtccatcgccgaaaaccacggtggcctctatcgcaatctggccgagctgcgcgccagcaacggcacctgtgagcgcaacgttttccgcgcgctgggcctcgactatcgctatctggacgccggcaacgacgtgttggccctggtcgacgcgctgcaggaactgcgcaatatcgatcatcccatcgtgctgcacgtctccaccgccaagggcaagggctttgagccggcccagagcgaccccgaacgctggcaccacgtgggtccgtttgacatggcgaccgggcgcaagctttgcccgggccatccgagcgagcccgcgccgcgcacctatgctgacattacgggcgaggcgctcagcgccgccatcgagcgcgatccacaggtcgttggcatcacggccgccacgccctacattatgggctttacacccgagcttcgcgctgccgccggcaaacagttcgtcgatgtgggcattgccgaggagcacgccgtgacctttgccaccgcgcttgcgcgctcgggcgccaagccagtctttggtgtgtacggcacgtttttgcagcgcgcctacgacgagctgtggcacgacctgtgcctcaacgacgcccccgcaaccattttggtgtttggtgcgtcaatctttggcaccacgtccgagacgcacctttcgttctttgatatttccatgctgggcggacttcccaacatgcgctaccttgcacctgcctgcatggaggaatatctgtccatgctgagctggtcgctcgaccaccgcgagcatcccgtggcgattcgtgtacctggtattggcctggtgagccgtcccgaccttgcgcccgccgaaggcaccgactacagcgccgttcgctacaacgtggtgcgccagggtcgcgacgttgccgtgctcgcgcttggcgatttctttgagccgggcgagcgcgtggcaaaccgtttggccgccgagtacggtatcgaggccacgctcgtcaacccacgctttgcaaccgagctcgaccgtgagttcctcgacagccttgccgccgagcatcgtgttgtcgtcaccctcgaggacggcatcttggacggcggctggggcgagcgcgtggcatgttatctggcatgcacgccgttgcgcacgcgcaccttcggcatcgccaagggcttccccgaccgctacgaccccaacgaactgctcgcacagaacggcatgacggtcgaggatatggccgccgaagccgcaaggctactgaacgagtaagaaaacctccgcaagggaagcacccccgcggaggtttttattttcgcggcgcgattatctcgattcgtaacatctagggctcgacttcccgtctaactgttacagatctagacaagacgtcttagttcctgacctttgtctcaatctgtaacagatagagaccttttgtccgtccagatgttacagattgagataaagcagcgagacatgccgctgcatcggtcagaaccaccacaaaggtgcctgtccctttttggtaggtaaaattacccataaggtaagtatgtttctgagttatttcgtgttgacccgtctgagcgctatagggtataactctactcaaccgctagggattttattgagaaaggtgttctaccatgagcaagaacctctcccagcaggtcgttctcgaccgccgcggcttcgttgccgccaccttcgcaaccgtcgccggccttggtcttgccggctgctccgacaccagcgccgaggccgacaagggttccgccgccggctcctccaagagctccgaggataccgaagtttccgccacgctcgacgctaaggcattcgacaagctcgtcgacaacggccccaaggccgatgacgacgtcatcgccgccagcacctgggccacggccgtcaaggacgccggcgtctttaagatcggtggcgttcagacctctacgcttttctccctcctcaacgagaaagacggtcagacccgcggcttcgatgccggtatcgcgcagctcctgtccaactacattctgggcgagaacaatgtcgagatcacccaggtgacctcggacacgcgcgagtccgtcctgcagaacggccaggtcgacgccgtctttgccacctacaccatcactgacgagcgcaagaaactcgtctcctttgccggcccctactactacacccagcaggccatcctggtactcgccgataacgacgacatcaagggcgtcgacgacctggccgataagaacgtcgccgtccagtccggctccaacggccccgccatcctggaggagttcgctcccaaggccagccagcaggagttcaagaccgacgaggaggcccgccaggcactccagcagggccgcgttgacgcctacgtcatcgacaacaacatgcagcagagcgccctggtccgcgagcccggtaagtgcaagatcgccggcaagcccttcggcaacaaggagccctatggcatcggcctgccgctcgattccgacggcgtcgcctttgtcaacgacttccttaagaagattgaggacgatggcacctggaccgagctgtggcagatctgcattggcgaccgtacgggcgacaccaatgttcccgagctgcccgaggtcggcgcctagacagcgagcctagtaacggccgttgcgaaaccatacggaaacgcacgatgcgctttattgcgctaaactgtttcctcactgagttgtcggggcttccgtacacacgggagcccctttccttatcggcaggaggtccgcatgagtctctccgaactctggtcgctctatggccagaactatatcgacgcgctgttagcaacctggggcatgacgcttgagtcgtttgtcatcgccatggtgctggccgtcgccgtcaccgtgatgcgcgtgtcgccgctcaagccgctgcgcgtctttggcgacctgtatgttcaggtcttccgtaacatccccggcatcgcactgctcatcatcgtcgtctatgcgctgccgccgctcaaggtcgtcctaccctaccgcacctgcgttatcgtcgccacggtccttttgggctcggcctttggttccgagaactttatgagcggcatcaacaccgtcggcgtcggccaggtggaagccgcccgctcgctcggcatgagctttaaccgtatcctcgctaaaatcgtgattccgcaggcactgcgctcaagcgtattgcccatgacgaacctctttatcgccgtcatgctcactaccgccttgggcagccaggtgccgcttaagccgcaagagctcaccggcgtggtgagctatatcaacacgcgctcacttggcggcgtcgccgcgttctttatctcggcgctcggctatctgggcacggcctttgtggtgagccacattggcaactacatcgataagaaggtgaggattctccgatgagcaagcattcctcccctacgctcaccatgcgcgatgcgctctacgaggctcccggccccaagatgcgcgctaagattcgcatcggcaccgccatctcgcttgttgccgtcgccgcactcgccgtcctggtgctgcagcgcttttatgtgaccggtcagctttcggtccactattggtatttctttacgcacctcaccacctggaagttcttacttgccggctttgagggcaccgttaaagtcgcactcaccgccggcgccatcgcactcgtgctgggtctaggccttatgctcggccgcaccagcgacattaagccgctgcagctggtctgccgtgtgctcaccgatttcttccgcggcgtgccgagcctgctgttcatttacttcttctttttggtgctgcctcagtacaagattgcgctgccgtcgttttggatgctcacgcttcccgtcgcgctcgctgcagctggcgtactcgccgagatcttccgcgccggcgtcaacgccgtgccgcgcggccaggttgaggccgcccaggcactcggtctctccaaggccaaaatcacctttaaaatcgtgttgccgcaggctattcggtttatcattccgtcgttgatttcgcagcttgtggtcgtagtcaaagacaccaccgtcgcctatgtggtgagctaccccgacctcatgcaaaatgcccgcgtgctcattaccaactacgacgccctcgtgtcggtctacctggttatcgcggtcatctatatcctcatcaacgtcgcgatcaacaaggccgctgtctacgtttcgcacaagaccggcgcgaccatcatccgctaacgctttaccatttcgagtcataaggagccgagcaccatggcacagagcacctcttccaccggcaatcagccgctgatcgagctcagacacgtcgataagcactacggcgatctacacgtcctcaacgacatcaatctgtcggtcgaccgcggcgaagtcgtcgtggtgattggcccctcgggctcgggcaagtcgaccatgtgccgaaccatcaaccgcttggagaccatcgactcgggcgagatcctcatcgagggcgagcccctgccgcaagaaggcaaggatcttgcccgcatgcgcgccgagctgggcatggtgtttcagcagttcaacctgttcgcacatatgacggtgctgcagaacgtcatgctggggccggtcgacgtactgggcgtctccaaggaggaggctcgtgggcgtgccatggacctgctgagccgcgtgggcgtggccgagcaggccgacaaggtacccgcacagctttcgggcggccagcagcagcgcgtggccatcgcccgttcactcgccatgcagcccaaggccatgctttttgacgagcccacaagcgccctcgatcccgaaatgatcaacgaggtgctcgaggtcatggtccgtctggcccagcagggcatgacgatgatcgtcatcacgcacgagatgaactttgcccgccgcgttgccgatcgcgtcgtgtttatggccgacggccagatcgtggaaaccggcacgcccgacgagttcttcgaccacccccagaccaagcgcgcccaggacttcctcaactccatcaagggccactaaccagccaccccgtgggacaaatccattgaaagtgttgtcccacgtctctcatgcgccctgtcaccttcagattcgaaagccgcacccatgatcggaacccgtacttcctcgtcctacacccagcacgtcgacgttgcccccgctgaccgtccactcatcctggtagcgccgcgttgggaagaagcgaagccgtttttgagcgagacgctctcccccaacgaggagattgcgagcgtctttgtcgatgccatccttgccgccggcggcctgccgctgcagatgtccatcaccgaggacattgaggtcatccgtcattacgtcgatatcgccgacggcatcgccattcccggcggccccgatgtcaatcccaaacgttggggcgatgatcgaccctacgaccccaccctctgctgcgagatccgcgatagctttgagtttaagctggtcggcgaggtgctccgcgccaaaaagccgctctttaccacctgccgcggcacgcagttgctcaatgtcgccaccggcggcaccctgtgcatggacgtgccaagcctgggtgcgcgcgagggccgcacgcagtggcgccacacccacgtgctcaacgaccccgtgcatcccgtcgaggtcgtgccgggctcgttgctggagcgcgcgcttggcgggcacaggcttatccagaccaactccgcacaccactgctgcgtcgatcgtctgggtaaaagcacgcgcttggtcgccaaggcaaccgatggcgtgcccgagtgcatcgaagtcgaaggccaacccttctgcctgggcgtgcaatggcatcccgagtacacctggcagacgctcgagaccgactttaacctctggaagtcgtttgtcgaggcggcagccaaggtcaagcaggcccgctagcacgcgaaccacaaaacagataagggcgccccgccggccacatggtccggcggggcgccctttcacctatatgtggccggcaagcagcccaaggctcgcaagctcttattcagccgcctcgcgcagagccgacatcgttgccgcatattgttgctgcagcgcatgcattccctcgcgagcgccgtcaacggcatcggcgccgcgcagtgcctcggtcaccacaaccgccggctcgtacagattatcgaatcccagattctggctcacgcccttgagcgtgtgcgctgccataaacgcacctttggcgtctcccgccgccatggcggcctccagcttgtccatgctctcgtcatccaaaaacttgagggcaaagcgggcaagcatttccccgcccatcagccgagcgcacgcgtcatcataattggcgccgatcttctcatacgcctcacgcatggaaatcatggattaaaactcctttggtcaaactagatcgtgggaaacgcgacgacgtcggcggggcgtgccaacgtctcggcaatacggtcttgcacctcgagcaggcagtcgagcaacagcgggttaaaggtgccgcacttaccgttcaggatcatctggatcgcctccttgtgcgggatagcgtccttgtacacgcgcacgctcgtcagagcatcgtacacgtcggccaccgaaaccacctgtgcggcaatgggaatatcgtcgcccttaaggccatcgggataacccttgccgtcccagcgctcgtggtgccaacgcgcaatctggtacgcatattccataagcgcattgccgacgtgatgtcggcccagctcaagcaacatgtcggcgccaatcgtagtatgcgtcttcataatctcgaactcctcggacgtaagacgtccgggtttgttgagaatcgcatcgtcaatcgccatcttgccgatatcgtgcagcgccgaagccagggcaatcgtggagcgttcctcgttgtcgagggaaatggtgtcgctacgctggaccagacagccaagcagcagctcggtcagcttttcgatattcgtaacgtgcctgccgctctcgccattgcgaagttccatgacaccggccatgatgtcgatgagcatgcgactgttcttgacgcgctcgttgtactgctgggacagcaggctcgtcaggcggcgctgtttggcgtacagacggatagtgttgcttacacgacggcgcacgacacgggcgtcaaacgggcggctgatatagtccgaggcgcccagctcgtacgcacgcagaaccacatcgtcggattcttcgctcgaaatcatgatgacaggcagattgtcaacaaccgatcggcgcgacagatcggccagcacctcaaagccgctcacgcccggcatgacaatgtccagcagcacgagcgacaactcatcgccatagcggtcgaccatatcgagcgccgtacgaccgttttcggcctcgaggatgcaatactcgtccttgagcatctcgttgagaatggctcggttcatctcggagtcatcgacgataagcaccaaaggcttttcgctttggaaggcctcgatgaaatcgccatcggtcacgaccgtaccggcttttgccttagcacggctcagtaactggacagcgcggccaacgccctcatcaaccgtctcgccatgaatgcgaacgccaccaacacatgccgtcaagctcacgtgctcatggcccggaacaatcgtggcatgaacggcatcggacacctgatgcaggcgacgggtgaagtcatcggagggaatattgggcatgacgaccacaaacttgtcgcagccatagcgtacaagctcgtcagtcgaacgaattccgctgcgtatggctgtcgccacagcaccgagcgcaaggtcgccggcatgacggccacacgtatcgttgaagaccctaaaatcatcaaggtcgatcaccgcaacgccggcattcatgcgggcgctacggagcttttcctcgtaatatcggcgattgcgcacactcgtcagcacgtcggtgtagacgaggtcctcttctgcagcctcttgctcatcgatcggacgcaccatcagcaggacgtgaggctcgccctcgaccttcagagggcgcaggcgagcgcggtactcggtaccatcattgagcagctgctccgatacatcatcggaacctgccaaggcctcaagactcgactgacgcagacaagggcagcgatcgccggcgagcaagcagttaggctcgctcttaatctgatcggccgacaacaaacgcaccacggggtaggtcttcgcgacgcgggcgacctcggcggcagcctcctcgtcggttagattgacctcgtgattattgagcatatggggcccttcctatcgttacgcacggcaacggtgcatatcaattggtacaagggtagcatctaacagctgaaggcaaacgcgcgattatcgttacatttttatgacctggcaaacggcggtaatggagccgcgggcgcgcggttatgggcgcattcgttaacaatgacgaaacgctaacagcccctctccccgcaggtcatcgagcgtgctaacgctccaagacatcgcgaacggcgtttgccgccgtaacggggcgatcgcgcagaccgttatgcgcgcccgggatcgtcacaagggggcaatcgagatattcggcagccgctcgcgtgccagcctcgcggggtgtaccgaccgaaagctcgcccaaaaacacagccgacaccgcctttgattctcgggcgcgctcccagtcgggagcatatgtcatatttgttccgtattcattggccataaagcaacgaccattgcgcagggcatgcttggcttccgcttcggtcgtcccaggagcctcggggtccaagtcgccgagagctcccaagaaaagccgaagcgcccttgaaacctttccagccgcaatcatatcgagcaaaatcggagccgcgcccatgccgacgccttcggccgacacagccggctcatgcagaatcgcacgggcgacgagatggggttcgatgcgaagaagctccagcgccaccaacgtaccggcgctgtgcgcaagcacatttgtcggagcgccaacgtgttcgatcacggcctgcaggtcggcggcctgagcggcaagatcatagctgccgtctgccgcttcgctgctgccgccacagccgcggcggtcgtaggcaattacgcggtagttgtgactgagctcacatgcaatgccgtcgaaaaatgtgccgtcgacacaagcgccgtgcacgcacaccaaggcaggagtatcaggcgacacatccgggccggcatattcgcgacaggcaatcgtggtgcccgcattctcgaccgtaaaatccatgttgtgcccccatcatcaacgcccatccagttgcgcgtcagtacggctggatagacccgcatttctttacgccttgttaacagattaactttacccgacccgaggcttttcatgacacggcataatgagcgacgtgaaaaaacgaaacttgtaaagcaagagcccgcaccctgctttggagccgatgctatgcttaggcacaattgtcttgaggagcatatgcctatgtctacgtttttgaatgccagccccatctttgggcccgttcgcagccgtcgccttggtctctcgctcggcgtcaacatgatgccggccagcggcaaaatctgcacgttcgactgcatttactgcgaaaacggcctcaacgccgagcgcccctgtcacgagccgtacaacacagctgccgtggtactcgacgcgctcgaggcaaagctgcgcgatatggcagccgagggcgagctccccgatgtgatcaccttcgcaggcaacggcgagcccaccgtcgcaccggagtttccgcaggccatcgccggtgccgtcgcgcttcgcgaccagctggccccaaactccaagattgccgtgctctccaacggcacgcgcgccgaccgccccgaggtacacaatgcgctcatgatggtcgacgacaacatcctcaagctcgatacggtcgacccggcgtttatccagctgctcgaccagcctgttggcccctacgacgtcgagcaccagatcgagacgttcgcaagctttgacggtcacgttattatccagacgatgtttttgagcggtgagtaccggggcaagtctctcgataacaccggcgaggagtacgttgccccctggctcgcggcacttgagcgcattcgcccacaagaagcgaccatctacacggtggctcgcgagacgccggtcgccggccttgccaaagcagcgcccgaggccctcgacgccatcgccgcgcgcgtgcgcgccctcggcattccctgccaggtgagctactagcgcgcagctgccctgtgagtgggctatactagctgcgaatgaaaggaagttagccatgtttgacaatggacccgtgcccggccgcaacgacgcttgctggtgcggcagcggcaaaaaatataagaaatgccatagcgcctttgatgagcgccttgagcgcctgtgggaagagggctgggaggttttgccccgcacgctctacaaggcgcccgccgatatcgagggcatcaagcgctcggccgccatcaacgtgggcgtgctcgattacgcaggcgaacacatcgccgcgggcatgaccaccaaccagatcgaccagatgatctacgactacaccgtcgagcacggcggcacgccggccgacctcaactatgagggctaccccaagagcgtttgcacctcgatcaacgacgtggtctgtcacggcatcccctgcgatacggacgtgctgcacgagggcgacatcatcaacgtcgactgctccacgattcttgacggctactttagtgattcgagccgcatgttctgcatcggcgaggtctctgccgagcgccagcgcctggtcgacgtcacccgcgccagcgtggaggcgggtctggctgccgtcaagccgtggctgccgctgtccgtgatggccgaggccgtgcaaaagacggtcgaggacgccggctttagtgtggtacgcgagtacggcggacacggcatcggtaaggagttccacgaggacccgtttgtgggctttaccaccgaggcacccgatgtggacaccatcatggctccgggcatggtctttaccatcgagcccatggtcaacgccggagcgcccgacatcaagatcagcaagggtgacggctggtgcgtgcgcaccaaggacggcagcgattcggcccagtgcgaggtacagctcgtggtgaccgaggacggctacgagctgctgagctggtagccgtggatgcgccggatgctgacgggcacgctcgtcttgcatccggcgttttatttaaacgttttgcctgataaaacctgccaaaataaacctgtccctttttggcaggtcgagcggagaggactgcttgtgaacatcctggttttgctgcccgtcaatgaccgccatcgcgcaattcttgagtcgagcgctccgggcgaggactttatctacacgagctccgacgccgccacgcgcgagcagatcgccgatgccgacgtgatcttgggcaacatcgaccctggcatgctcacggcatgcgagcatctccagctgttacaattgcagaccgccggctatgacgactacttggccgccggcaccgtgccagccgacgctaagctttcctgctcggtgggcgcctacggccaggccgtaagcgagcatatgtttgccatggtcctttctatgatgaagcgcctgcccggctatcacgacttgcagcgcgagcatcgctgggaggatttggggccggtcacctcgctcaagaacgccaatgtgctggtgctaggcgcgggcgatatcggcggccacttcgccacactctgccgcaacatgggcgcgcacgtccgcggcatcaagcgccatccactcgtctaccccattgtgtttgaggacatggacggcatggacgccctccccgagcgcctggccgaggctgacatcgtcacgtcctttatgcccagcacgcccgagacgcgcggtctggcgaacgccgagttcttcgccgcgatgaaaccgggcgccttctttgccaacggcggccgcggcgatcttgtggttgccgacgatttggttgccgctctggagtcgggacatctcgccggcgccgcggtcgacgtcaccgaccccgaaccgctgcctgagacaagcccactgtggaatgcgcccaacatgctcatcacgccacacgtctccggctggttccacctggcagccacgctcaacaatgtggtcgacatcgccgcggagaacctgcgtcacctgcaagccggcgaaactttacgttgttggatcgaacattagggttccgccgttctaacgaacggcggaccggtcgacgctgcgcgccgcccagagcgacaatttgtcattcaaaaggcaaggcatgaccagaaggtctatgccttgcctttttcatgccaacttgttcgctctggacatcgctcgctgacgcttgctcaacctgcggtgtcataacaattctgtccagctgttggctttgcggcatttgcccagataaaacctgcataataaacctgtcccttttagcaggttttagagctccacgctttcggcaccgttgatggttaggtttcgctcgtagaaggctgtgagggcgcggatggcgtacatgacgtcgcgcacgccgccggtctcgtagctcgagtgcatggccagctgcggcaggcccacgtccacggcatgcatgctcgcctgcatattggacagattgccgagcgtggatccgccggccatatcgctcttgttggcgaaggcctgcgtgggcacgtcggcgtcatcgcaaatagcttggaacaccgcgcggctaaaggcatcggtacaatagtgctggttggctgcctccttgatgacgataccgccgttgagcaccacctggctgcgggcgtcgcacttctcggcgtggttggggtgcacggcatgcgcgttgtcgcagctcacgagcatcgatgcggcaagggcgcgatgatacgactcgtcgtcaaagcccagcgatccgttaatgcggcgcagcgcgtcggccaagaacgtcgacatggcgccctgcttggtctcggagccaacctcctcattatcaaagcagcaaaagaccgaaacgtcgtgcgcgttctcggcacccaaaaatgcctgcagcgaggtataggcgcaggccaggtcgtcgagcttgggcgtcgagataaactcgtcggcccagccccaaatgcgcgcatcctggcggttgaccaggaacaaatcgcggcccagaatttgctcgggctcaacgtccagctcttcggcaatcagggcatcaaaatctccctgcttgagttcgccggcgctgataagcgggcacaggtcgacggctcggttgggagcaaagccctcgttaacgccgcggttcatgtggatggcaaggctcgggataatagcgacctcgcgctcggtggcaagcaggcggctctcaatacggtcgccctcgcgtaccagcacgcggcccgcgagtgccagcggacggtcgaaccaggtgtagtcgatcatgccgccgtaggcctcggtgttcaggcgcagcgtctcgcccgcgccgtcgagctcgggcacggccttaaccttaaacgtcggcgagtcgctgtgcgacgccgtcagctgaaaatggtagtcgccggcaacgccgtcctcgccccacgtagcagccaggtcctcgcccaccttaaaggcgataacgctcgaggtgttgcgctgcgtgtaataacgcccgcccggctcgatgtcccacgccgcgttctcggacaggtaggtaaagcccgcctcgtcgagctcggccataatggtcgccgccgtatggaacatgctggggcatgcctcgataaagtcgataaggtcgttggcggcctcgatatcatcggccgtcacatgcgcgcgctcgggcgtttcctgatccgtcatgctctcccctttcgctgggttgatggtcccttccagcataccccgccgcgccagcgctgcactcttcattccgtgtttaatcccgcaccgttcaccaagttgagccatcatgcccgtgcaccttttgcgacaattacgctaacaggacgagaggagccgccatgaagccacgtaacattgccatcgcctgcggtgtcgcgggagtcgccgtcggccttgccgctgccaccggtatcgtttatcacaagcaaatcaagtccgccgcgtcgctcaaacgcttgaccggctacgcggatggctatgacctgtacgcaatcgacatcgcctacgactacgatcttgatcgcatcatcgccgctggcgtgcgcgacgaccaggcctacatcgatgccgtggtggcgcaggtgctgcccggtgtgccggtacatgtccaggcgccccagtttgcctgcagcgcttttgtcgccgtagatgccgaaggccgcgtgcgcaccggtcgcaattacgactttaaggacgacacctcagcgctgctggtgcgcaatcacccacgcggcggctatgcctccatcgggtttgccgcccttaacaacctgggcgataacactccgcttgactccgtcgccggacgggccgccgcactcatgggcccatttgcccagctcgacggtgttaacgaatgcggcgtgtccattgccgtactcaccctggattcccagccctgtgaccaggacacgcaacgccccgtcatcaatacctcgctcgccatccgcctggtgctcgaccgtgccgccaccacgcaagaagctgtcgatctgctttccgcctacgacatgcacgccatggcaggacgcgattaccacttctttatcaacgacgccgccggtgacgcgcgcgtagtagagtgggatccgcgcgatccggaccgcgctttcaaagcgactcctgtacgccaggttacgaacttctacgcctgctatggcgacgaagtgctgcccaaccaaaagaatggcgagctgggccatggtaaagagcgcgccgtcgcaatcgccgatgtccttgacgcccatgtcggtgcccaggacgagacagtcgtttggaaggccctgcgcgctgcggcgcaagagcccaatccggaagacatcaccagcaacacgcagtggtcggtcgtctttgacaataccgagcccgctgccgccatcacgctgcgccgtcactggggcaacgtcgatgccttcgcactgtaaggagccaggcccgtcgaccttacgctcgcctgacgttgcttacatttccatacgcttgagctaacacgttttacccccgcatcaacagtgtgcgggggtaaacttatgcgcatgttataacttgcccggaaggattcaccatgcttaggatcggtcttcttactagtggcggcgactgccaggcgctcaacgccaccatgcgcggcattgtcaaaacgcttatgaccaatagcaaagagcctatcgagatttatggctttgaggacggatatcagggccttatctacagcaggttccgtgtcatgacacccgccgattttagcggcatcctcacccgcggcggcactattctgggcacgagccgcacgccgtttaagcgcctgaacattcccgaggccgacggcgtcgagaaggtgcccgcgatggtccacacctatcacaagttgcagctcgactgcctgtttatgctgggcggcaacggctccaccaagaccgccaaccgcctgcgcgaagagggcctcaacgttatcgccctgcccaagaccatcgataacgacacctggggcaccgagatgacgtttggctttacgagcgccatcgacgtcgccaccaagtgcatcgacgacatccacactaccgcctcgagccacggccgcgtgttcgtcatcgagatcatgggccataaggtcggctggatcccgctgtatgccggcgtcgcgggcggtgcggatgtcatcttgattcccgagatcccctacgacatggaccaggtcatcaagaccatcgagcatcgcatggagaccggcagccgctttaccatcgtggccgtcgccgagggcgctatctccaaggaggacgcggcgctgtccaagaaggagtacaagaagaaactcgccgagcgcacgagcccgtcaatcgtgtacgacatcgccaaggagatcgaggccaagaccggtcgcgagacccgcgtcgccatccccggtcacacgcagcgcggcggtcagcccgacgcccaggaccgcatctttgcgacccagtgcggcgtcgaggcggctctcggctgcctacgcggcgagtttggctacatgattgccctgcgcgacggcaagatgtgccacatgccgctcgaggatgtcgccggcaagctcaagtttgtcgacccccagagcgacctggtacgcgaggccaaggcgctgggcatcagcttcggcgacgaatagtctcggctggaaccgccccatcggaggccccagggcttacctcccaaatcgtcctcggacatgtcaggaccccgccgtgcgcttcgcgcggcggggtccttccgtcctgcggaaagatttgggaggtaagccctggggcctcctgcggtaactagggaggccgaggctattcgtcttcttgctacgggtgcctggggtaggatgcggcgtgcatttttgggagtattcagcagccgagggtgcctgcatactggattttgggcgaaaggcaggcaccatgggccgcatcctgtaaaaaacgagcggctctagaggcgttgggactcagaatcggggctttcagcgcagttttgcaccccccgcccccgcgcccgcggaccccgggacgctgaatactccgaaatttgcacggcgcccccgggggtacctgtgggcaaaaagcaaccgccctgtcaaagtatgcatttggcggggcagtttatgcaaaaatgctgctgcgggcgcgtcggcagctcgctagaacttgaatcccaggacaggttactcggcgctcttgagggcgccgaccatgtcgatcttgttgagcgttcggttggtggcgaggttgacgataatcgtaaagccgaaggacagcaccacggcaagcacatagctcagcggctcgacctcaacgtcaaagtacagcgacggcatctgcaggatgtacgtaaagctctcggcaagcaggccacccagcggcacgcccagtgcggtgccaatcgccgtgaggatcaacgtctccttgttgacgtagtggtgcacctcgccacggcggaagcccagcaccttgatggtcgccagctcgcgctcgcgctcggagatattcgtgttggacagcgtaaacaccaccacaaacgacaggcacgccgccataaaggtcacgagcaccacgacggaattgatgatagtaaagttcgcctcatagttttcccaatgttcggccgtgctcgagatggtgagccaaccgtcgcttttaagcttcttgctaaacgcaatctggtcagaagatgaacccttaagcagcacaaagatgccgttaagacgcgcgcttcggccgaacgcgcgctcataggtgccctgcgtcatgtaaagcgtgttgcccagatagttgagcgaaatgtcgctgactttgaccttggctacgttgagcgacgaatcctggacgtgcgccgtatcgcccggttgaatccccagcaccagctgtgaactcttgctcaggtacacatctccgtcacgcaaggatagcggctctttggactcgtcctcgaggcacacgtagtcgtccagatcgttcatgcggtcatcgggcaccacgatcagctgcacggtctcgctcttgccgccaaacgtaaaggtaacgttgtcagtcatgatcggcagcgtcgaagttacggtcacgttggaatcattggccgcgctgcgctcatccaacgccgcgcacgtctgcgtaaagtcatcggggttggcgaccgccagcaagtcatagcgcgtgatatgcccatactgcttgggcgaaagcgcgaccgacgtgtcgcgaatacccataccgcagatcacaagcgcggtgcaacccgcgatgccaaagatggtcataaaggcgcgctttttatagcggaaaaggttgcgtgcagcgaccttgttcaaaaagcccatgcggcgccagataaagccgatgcgctcgagcaagatgcgcgagccagcgcgcggggccttgggacgcataagcgaggccggggtctcggccatctcgtggcggcaggcgataatcgtggcgcccaccacgcccacggcaaacagcgccaccgacacgagcgacgacacgatgtcgtacgaaagcagcatctggggcagtgagtacatgtcgtcgaacaccgtaaacaggaacagcggcaggcccacaaatccgatgatgttgccgagcacgccgccgatcagacaagcccacagcgcatagtccacgtatttggacagaatacgcccgcgcgaatagccgagcgctttgtacaggccaataagcgtgcgctcctcctcgaccatacgcgtggcggtggtgaggctgatgagcacggcgacgataaagaagatgaacggaaacaccgtggcgatggcctcaattgacgagctatcgctctccacgctcgagtagcttgcgatattgccgcggtcctggatgtaccaggtgcattcgcccaggtcagagagctcggcgcgggcatcggcaaactgctggtcggcggcggcacggcgctggtccaggtcggcttgcgcctgcgcacgctcgtcgctgccctctgccatgcggttgatgttgccctgttcaatcccaaagagcatattcgtctggcgctcagccgcatctaagcttgccggcgtgtcgactgtcagctcctgagcgcgcgccttctcacgctcctcgcggatcttctcgatattgcccttggccttgttgatctttgccgcgtaggcatccgaataggagttgaggctcttggctccctcgacgatcacgtggaccgcagagtaggaagaagatgtcgcggcgtcctcgctcacatagaacttgtagtccgcggccgaagcagcgcgaaaggcgttgactgtcgagtcggagctcacatcagtgggatcgagaacctcggccgtgatggtgtactcgcctgcggcaaactgatccttggcgctttggttcgacgagctcgcatcgttggcagcaaagctcaccgtatcgccgagctttttacccgaagccttcaggaacttcgaagtcaccgcgacctcatcggcgctctcgggcaaatcgccgttcacgagcactggctgatcgatgttctccttggagaggctctgtacgacgacacgctcgcgcgttgtacccacggcggtgtaggcggtctcggtgtagatgccctcggccgtctcgacaccatcgacctcttggatggcggcgagatcatcgtcggtcaggccataggtcgactgcacgttaatgtcatagacattttgctggtcgaagtaggcgtcaaccgaatcgcacaggtcctcgcaacccgccttaaggccgcacatcacgctcacgccaagcgcggtgatgaccacgattgacaagaagcgcttaagactgcctcggattgtgcggtagatgccacggcgaaaaaccgtcggcaccatatcgtttgagctttgggcagtgcggtaggtcgtaaaatcctgctcgcgctccgtgttctgtgcgtcgcggcgtaggctgttttggcggtcctggtccatgggcgctaccactcgatcgtctcgataggcacgggattttgctggaccgtctcgctctccacgcgaccactcttaaagcgaatcaggcgatcggccatgggcgcgagcgcggaattgtgcgtgatgatgatgaccgtaatgccctgcttgcggcaggtatcctgcagcagctgcaagatctgcttaccggttttatagtcgagcgcgcccgtgggctcgtcgcacagaagcagcttggggttctttgccagtgcgcgggcgatggacacgcgctgctgctcgccgcccgaaagttgcgcgggaaagttgcccaggcgctcgcccaggccaacctgacgaagcgtttgctcggcatcgagcgaatcggggcagatttgcgccgcaagctcaacattttcgagcgccgtcaggttggggaccagattgtagaactggaagacaaagccaacgtcggcgcggcggtattccacgagctgcgcctcgttagcggagctcacatcgcgcccgtccaccgtcacggtaccggaagtcgccgtatccatgccgcccagaatgttgagcgccgtggtcttgccggcacccgaagcacccaaaatgatggcgagctcgccgcgctcgaccgtaaaactcgcgccgtcgagtgcgtgaatgcgggcgtcgccctcgccgtatgccttgatgacgtctttgaattcgatataagccatcgatcggttcccatctggtcggataactctttagtattacccatttcgcaccgaccaaaaagggacaggttcattttggcaggttttatatggagaaacggcagctatagatgaggcgccggggaggcagagaaatcatcgattgggtcaggccgaccgccaaacacaacgcacgcatctctatctgtcagcaaaatcattcgaacagctgttcgtttctatgatatgattccgttatctaagcaggccaatacgcagaaaggcggccaacatggcgttcgactttaagaaggaatgcaaggagctctacaaacctgcaagcaagccgagcatcgtaactgtcccgcctatgagctacgttgccgttcgcggaaagggcgacccaaataccgaaggtggcgagtatcaaaacgccctgccgctgctttacggcatcgcctataccgtcaagatgtcgaagaaaggctcaaggagtatcgagggctatttcgactttgtggtaccgccgctcgagggcttctggtggcaagactccccgagcggcgacatcgattatgtacgcaaggacgatttcaactttatctcgtgcatccgcctgcccgatttcgtcactcaggatgactttgactgggcggtcgcggaagccacggccaaaaagaaactggacttttctgccgtcgagctgcttaaagttgacgagggtctctgcgttcaatgcatgcataccggaccctacgacagcgagccggcaaccgtagacgccatgcatgaatatgcgaccgagcagggctatgtccccgacttctcagacacccgtttacatcacgaaatctatctttccgatccacgcaagtgtgcgccggagaaacttaagactgtggttcgtcatcctatcaagcgcgctgaatagcgtggagcgtcatttcacgcgctgggttttaagccagccaaccagccgcctcctaggctgtcaagcaattatcttgacgcggcccgtcgcatcttataagtttgttttgctaaagctggaaagcctctcaacgatgcgcaactccagctctttttctatcaagaggcttaatgaaataccagaagtcgcggatatccatcaacgaacaaatagcactattgacagaaaacaagggtcttaagtgctctgatcaaagcgaactcgagcgagctttggtcgaagtcggctactacaggcaaagcactcgaacgctactcctcgtacgcgccctcaagccggagcagccactccttacggtcgaggccgccggcatatccgttgagcgacccgtcggcggcaaccacgcgatggcacggcacaataatcgaaacagggttacgcgcgaccgcagcccccacggcacggggggacacaacgggcgcctcgtttcccggtacacgatgtcgagccgcaacacgctgggcgatctcgccatacgtggcaacctcgccgcgcggaatggaaagcagctcgtaccaaacttcacgctgaaacgccgtaccgatcatatgcaacggcggcgtaaaccgaggttcctgccctgcaaaataagcattcagccaagcccaggaacgctcaagcaccgaagacgccgcaccatttgcaggactcaccgacgacatgccgccagcaccagaaactgcatcggcgccttcaacatgttcaggatcttctttgagaagcgtggagccaaaatgctcctgtccctcaaaccaaagccccgtcagaccgcggccatcagcggcaagcaagatttcgcccaaaggcgaagcaaacgtcgtcgtgaccaccagcggctcctttcaaaactccgcaacataataccgcgaattgtgcagacaaccccaatcgaccccaaagtccccgcaggcagcaggcgcaaagcgccgaggccaccgccgggaccagggcccgcagcggccacgtgccctcacatcagcccagcggccccaaccaacaacggccccatcgcagatcgcttgcagcagcgtcaccgcaggcgggggccgggcttagttttcagaacactccgcactgatattttctgtattgaagacgtcgatgatgcacccgtataccattgacgtcgacaccatcggcggaatcggctaaagtgcgatggcgaaattggttgtttttacagtagcgctaacagcacctgaggaaggcgctggtcgaggccgcgtggcactacctgacgtgctccgcgcggccgaaggagcccgccaggggccaggccccggacccgggcgcccgcaggcatgccgccaagggcgtgcggaggctggtcgagaggcgcggggccctgctcgcgcgcggggtccacaacaacaaggcgaacgtcgccacggcgcgcgagctcgcctgctgggtgtgggcggtcggtctcatggccgaggaggcgtagggggaggctcccccgcacataagccgatcaccccggaagcggttggatccgaagccgttgaggcgaacctcaggtcccttttctgcgagcgcccagggcgccacacgcgtgcacagactgtcggttcgacgaagaagcctcagccgtagcaacggattgcccagcgagagatcgccacgggcggatattaaactgcaaagacgagcgtcgggaagacacgccgaggtcgccgcggacgggttgatatagggagagggcctgaccccatatcgttggggccaggcccgattttgcctcttgacaatgtcctgctcatattaaaaggaacgtccccaagtgccggcacgagaaagacagcgctgcgggaaacgatccgcagtgctgtctttctttatgcaaatacgatcaagttatccctgtgtatcgccggcttctcggccaggttagcgagcaggcggttgctggcgatctggtcctggcggcgaccggcagcaagttccagcacgtccgaatcggcctcggcgataccgcgggcgacgaccataccgctcggatcgcacacatcgagcacatcgccctcggcaaactggccatcgacctcgcgaatacccaccgcaagcaaggaagagccacggctaaccagcgccttcgcagcaccatcatcaaccgtcaccgacccatgtgccttgtcgcccagcgcgatccacagcttgcggggcgcgatgtccagacgctccgccggcggatcgaacagcgtgcccacgctctcgccgcgggcgaggcgcacgagcgcatcgggctcctcgcccgagcaaatcacgctctgaatgcccgccgtcatcaggatgcgactcgcgcggatcttggtaatcatgccgcccgtgcccaccgatgtggaagaatcgcccgccgaggcaataatcttggcatcgatcttatgcacgacaggaacaaactcggccgtggggtcctcatgcggattggcagtatagagaccatcgatgtccgagagcgtcacgcacagatcggcagataccaggcagctcacgagcgccgccagtgtgtcgttgtcgccaaacttgatctcgtcgacggtaacggtgtcgttctcgttgacgaccggcaccacgcccagctccaccagacgcagcagggcgtcgcgcgcgtgcaggtaggacgtgcgacgcgccgtgtcgtgacgcgtgagcagcacgagcgaggtgagcaggtcgcgcgcatggaactcctcgtcgtaggccgacgagatgatgcactgaccagccgaggcgcaggcctgcaggctcggaaggtcgccgaccggcttgcggtcgaagcccaacacgggatagccacaggcaatagcgcccgagctcaccacgaccagacgccagccgagcttgcgcagcgctgcggcttgatcggcaagtccgccgataaaggcgcggttgaccttgccatcggcgcccaccaccgtggacgaaccgatctttaccaccatcgttttataagaagtcgtcatacgtcaaaccaatcaactgttcagcgaacggccgagctggcggccaagggagcgtgactcgcccctaccgcccaaggaatcattttgcccaggggaaagccgaggccgcggccatattcttgcgcacgagctcgtcgcgcacctgggccaggccctgttccatacccaccacgtaggtctgcggatacaggaagcgcttgaaagccgcatccagatgatcgagcgcccaaacacagcgctcgcgcgcgtcctggatgctctcacgcggagccaccgcactgccgtcgcgcacgatcggcaccaacagctcacgatactcaagttcggacacgtcggtcaccagggcggcatcattcacggccacgagggtattgccgcgcgcggcgccctcccccgccagatggtcctcgtcgtagatcatgtcgcagaccgggccgccaaagccgtcgtaataacggcgcacgcgctgtacgcccgggatcgtgcgcttgtagggctgctcggagagcttgaccaccggcgtccatggatctgcctcgctcgcacggcgggcggaaagcttgtacacgccacccagcgccggctggtcatagcaggtcgcgagcttggtacccacgccaaagctatcgatgggcgcgccctggtccagcagcgactgaatcgtgtactcgtcaagatcgttggaaaccgagatccccacatagggcaggccctcggcatcaaaacggccgcgaacatacttggagagcttggcgaggtcgccggagtcgatgcgaatagccgacagacgctcgcccaccgcctccatctccttggcaaccgtaatggcatgctcgcagccctcgcgcacgtcataggtgtcgatgagcagcgtacagttcttggggctcgacttggcaaaggcgcggaaggcctcgagctcggaatcgaagctcatcacccagctgtgcgcatgcgtgccaaagacgggaataccatagcggcggccggcgagcacattggacgtagaggagcagccggcaacgtagctcgcgcgcgcaacggccaggccgccatcgggaccctgggcgcggcgcaggccaaactccgccacggggcgaccgtcggcggcgagcaccacgcgcgccgtcttggtggcgacaagcgtctggaacccgacgatgttgagcagcgccgtctcaagcagctggcactcgagcgcaggaccggtgacgcgcaccatgggctcgcgcggaaagacgagctcgccctcggggacggcgtcgatatttacatgcgcacgaaaatcgcgcaggtagtcgaggaatgcggacttgaacatcgcgccgccggcaggggcctcaagcgaggcgaggtagtcgatatcctcgggcgtaaagcgcaggttctcgacgagctcgggcagctcggcggtgccgcacatgacggcataggcgctgccaaagggatggtcgcggtaaaacgcggtaaaacaaccctgctcattggccttgccgctctcccacaggccctgggccatagtgagctcgtaaagatcggtgagcattgcaatgtcggtgggatgcgagatgtcggtcaaagccatggggcgacctttcggatgtgtggtgcagaatttgagggttggacgagagcagagcatgcggacatgacgcccgatgcgagtcggttagagcaggcccatgctggtcaggatcgtgtagcccataaagatgacaaacgcgatgagggcaaggacaatgatgattttttgagccggcgccatgccagggatctcgttctcgcccataggctccttggaggtaaccatgcgctgggcaaaggtcatctcgtcacggctcggcttgggctcgacggacttgggacgggcggcctttttaggctgaggtttgggcgcggcaggtgcagaattcgtatccggagatgcggcctagctatccnnnnnnnnntgaggtttgggcgcggcaggtgcaggcttcgcagcagcgggcttgggtgcgggcgcgggcgccgatgcggatgcggcgttcgcggcggcctcctcggccttcgcacgctcggcacgcagggcagccagctcctcacgctcgcgacgggcctcttcccaagcctcgcggcgggccttctcagcgcggagctcttccaactcggcgcgctcctcgtcggacaatggttgggactcaagctcggccatggtatagccctttcttttaaaaaaagccgccgacacaatgtcagcggcttatcaaatccatgggtggagacgaagggagtcgaaccctcggcctctgccatgcgacggcagcgctctcccaactgagctacgtccccaggacaagtcgatattttacctacggctcgccaactgtcaacgcccaataaccagtctttttgggacgcggctattttgacaacttttcgaacaggcgatcctctcgatgattttttaatccccgtcccagaaaaatcatcagcgtgcgctctactttgcgctggtgaggacgccggtggtgtcgaaggcgggggtgaagctctcgtctaccgcgccgccctcttgccagaacattgtcgtaaagcccaggtcgtcggcatggtcgagcacctgctcgtactcctcgcgcgtcacggcgcgcgccaactcgccgccctgctcgcgcatgagcgcattgggcgtgtactggttcatgaccgagatcggcacgtcgcccaccgtctgccacaccaggtctaacacgcggcacgagtcatccgcatgccccggcagcaccaggtggcgtacgatgatgccgcgcttcatgagcccgtcgtcatccaccagctctcccccgcggcgatcgatctcgcgcgccatctgggccagacccgacacggccacacgcgggtaatcctttatatgggagagcgactgcgcaagcgccgcatcggcatatttaaagtcggtgagccacacatcgaccaggtcgcccagcgccgccacggcactcgcgcgctcgtaaccactcgtgttgtagacgattgggataaccagtccgcgcgcccgtgccgcggcaatcgcggcaggcaacaggtgcgcatagtgcgtcgccgtcaccaaattgatgttgttggcaccctggtcctgcagttccagcataatctcgaccaggcgctcaggcgaaatctcaaggccaaaattgccggtcgagatctcgtggttctggcagtagatacatttgagcgagcagccgctaaagaagatcgtgcccgaaccggcctcgcccgagataggcggctcctcccacatatgaagcgcggcgcgggccaccttgagcgtgtcgttagcaccgcagacgccgtgcgcgccctcatcgcgcgccgcaccgcaacggcgcggacacaaatggcaggcgggcgaaaaaagttcggtcaacgacgtcggcataaaaccatgctccaaaacaacgattcagcagctcaaacgtaaagggatcaaccccacagacggctcgagcccaaggcgccgtaatcgtccgacacgatttttgtaatgtcaagactggaatcgataaagtgccgctttatgatgtaggtattccgccccccgcggagcaactgggtgaaccgtcgcgtttatttagggagcccacacagtcgtacctagtacaggtatccttcgttgttaaggacgctggaacagtcgatgagggcacccacctgttttaggtgggttcattttcgtaacgtggggggtggttttcttttgccgaaaatcaccattacagtccatatggatccccgccggcatcccgacaagccatcgacaacatcccaatatctggtaagcgcgtgattatcgctgcgtgcaattccatgtaccccccttggtcgagtattatggttcggctatgccctttgcgcatggcgttcttctgaccttttccttcgacgcttggcggtttttagattcatggcttcatccccgagctacataccgtacctatgcgtggcagcggcggcctttatcacgaccttcctcgcggtgcccctggtcaagcgcttggcaattaagctcgatgccgtcgactatccttctaagcgccgcatcaacaccaagcccatcccgcgtttgggcggaacggcggtgtttttgggcctggtcgtcgcctgcactgtgcaaatcctaggcacctggtacctgggttggccgcccgttttggtgccccacccccgtctgcacatcagctaccccatgctggcgctctcctttaccgtcatctttgcgaccggcgctatcgacgacgtcttccagctcacgcccaagcaaaagctggccggacaagtcctcgccgcgcttatcgcctgtatcggcggcctaaaaatcggcgtcatcgtcaacccgtttgcccccggcgagatcatgctcggatggctcgcctaccccatcaccgtaatctatctggtggcattcaccaacatcattaacctcatcgacggcctcgacggcttggccacgggcatctgcggcatcgcgtcgttcaccatgttttcgatggccgttctctcgggccgcatcgacgccgccgcgctctccattgcgctctttggcgcctgtctggcctttttgcgttacaacttcaaccccgcaagcatcttcttgggcgactcggggtcgctgcttctgggctttgcgctgggctccatctcgctgctcaacgtgagccgcaccgccgcactcacctcgcttatcatcccgctcatcgttgccggcgtgcccatcatcgacacgtttagcgccattgtgcgccgcaagcgcgcccacattagcatcgggcaggccgacaagggccacatccaccaccgcctgatccaagaaggctacaaccaaaaacaggccgtgctgctcatctatgcctggtgcatcatgctttcggccggcgccgccgcgattaaccaggtcgaggtgcccatgcgtgtgctcatctttaccgtgctcgccattggctcggcggcctttgccaagcatctgcatctgttggagcccgtgctgcgccaccattacaacaagcgcacgcacgaggacgagctcgtcacccccgacgaccccgcttttaagcaggaggagcaggcagccgaggagcgcaaagaagagcgccaccacaagctctagggcaagctgccgaggatgtgccaaggcaccgttggccaagcgcggccgcgccgcacccaccgcacaagccacccctctcccgcccctcgcctacttacgtcccgcccctccaataaacgcgttatcatcttgacccatgaacatacgttaggagcaatcatgccaaacgagaacagctacgaagtcgcgctgcaaaagagcaacgccattcgcgagggcctggccaatacgcccgagaagttcaccatgctcaccggtgatcgccccaccggccgtctgcacctgggccactacttcggtaccctcaagggccgtgttgagctgcaggacatgggcgccaagaccaacgtgctcatcgccgactaccaggtcatcactgaccgcgacaccaccgagcacatccaggacaacgtgtacaacatggtcatggactaccttgcctgcggcatcgaccccgacaagaccatgatctacgcgcactccgccgtgcccgccgccaaccagctcatgctgccgttcctgtcgctggtgtccgaggccgagctggcgcgcaaccccacggtcaaggccgagatggaggcctcgggccacgagcttaccggcctcctgctcacctacccggtgcaccaggcctgcgacatcctgttctgcaagggcaacgtggtgccggtcggtcgcgaccagctgccgcacatcgagctcacccgcaccatcgcccgccgctttaacaaccgctacggcaaggtgttccccgaggtcgaggcgctgctgtccgagaccccgctgctgcccggcctggacggccgcaagatgagcaagagctacggcaacgccatcaatatttcgatgaccgccgaggagacggccaaacgcatcaagaagagccagaccgactccgagcgcatgatcacgttcgatcccgagaaccgccccggcgtgtccggcctgctttcgaccgccgccatctgcaccggtcgctccgaggtcgagattgccgaggagatcggcatgggcggctccggccagctcaagaagtacgtgaccgaggccgtcaacgagtacttcgcgccgatccgcgagcgccgtcagcgctacgagaacgatctggactatgtaaaggacgtcctgcacgagggcaaccgtcgcgccaacgagatcgccgatcagaccctggccgaggttcaggacgccatgggcatggtgtactaggcaaagcgctttcgcacaacatagacggtgagattagatttctccccgaaacaggaacaggcccgctggcagttagttgccagcgggcctgttcccgaagtacaccgttgaatcgcacagaggggaggaatgcgaatcaaactcaacagggcaggctttttcatcgcctattgcctgctccgttgctgaaaccaatatagttcaccatggtttactttctagcgtcaatatgcaccgccatagcttctccataagttaaccccggtaaacctgcaacggaaaaccaccacaaaggggacaggcacctttgtggtggttttggccacggtagagccgctagagccctactggccagcgacaggcggccaagtcgacgtgcatgggatcggtaaacgtcacgccctcccccattaagagctcacgctgggcatcggggccgccaaacgcaaagccctcgcaaatgcgaccatcggcaaacaccacacgatggcagggaatctgaccagggcgcggattgctatgcagggcataccccacgtaccgcgcacttcgtggacgaccggcaagcagcgccacctgaccatacgtggcgaccatcccctcgggaatctgctcgaccacctcgtacacacgctcaaaaaagccctcagacgccaacatgcgctcctttcaaccggaaccagcataaaccaccacaaaggtgcctgtcccctttgtggtggttttgaccggatagttagttggcggggcggaagaaggctacggctacggcgccgggacccacgtgggtgccgatggtggcgccaatggtgtggatgggcagctcgttctcggcatggccggcccacagcgcggcgctgtcctcgatatacttcttgagcaccgcgtccgaaagacccgtataaccaagcgccagcggcatggagaagtcgacgccgccagcctgctcaaccttctggttcaacaggtttcgaccgttcttggaaccgcgcgccttgcccaactgcacgatgaggccgtcctcggcggccacgaccggcttcacgttgagcagcgtacccacagcgcccgccgcagcagacaggcggccgccgcgcaccaggtattccagcgtctcgagcaggccgatgacgaccacgcggtcacgaacggcctcgacggccgccgcaatctgggccgcactacggccctcgtccaccaggcgcagcgcatactcaaccagcacgcgctcgcccaaggtcacgttattgctgtccacaacgaacacgtcgccgcccggcgcctcggcaagtgcggtacgggcgctctgattggtgcccgaaagcttggcgcccacggtaataatcacggcctcgtcgccggcctcacgcgcttcggcaattgcctgtgaaaaggcatacgggttgacctgaccggtcttgggcagctcatcgcgctccacgagcatctcgtaaaagcgctggtgatcgatgtcgacgccatccatatacacgtcggagccaaaggtgacggacagcggcagaacacgtagagcggggtgctccgccggagacatatcgctggcggaatcggtaataatgcggacggacatagcgaatcctttcttgcgcagatctcgcgcagggaattttgacaacaatgtcccgacacggcgtgcgcgctcaaacgggacgatgcagttgttaattggaagcaaatgccttggcggccttagatctcgcgcagggtgttgagaatcgtacgcagcgacgcgtacatctgctcgcgttgctccacgcccatggccttaccggtggtgtcgagcacttcgcgaatgatgcgatcggcctcgctcatgctctcgccgcccagggcagtcaggcgcaccggggcacggtacttgacggccgcatcacccgaatcatcgacctcgacgtagccgccctcctccagatgtgccagcgtgcgcgaaacggcggcacgggtaacgccggccatgcgggcgaggtcggcgccggtcaggccgtccttgctgcgctcaagatagtacaggcacatgacgtcggagcccttaaggccgagccttgcgccttcggacgtcttgatgcgctgaatctccttgtagagcccgctgatcagtccgacaaaatcctcaaaacgtgtctcgtcgttctgctgcatgggagacgaccgcctttcgcttgcataatgctaacgggtaaacatcttagtcgcataaggcgacactcgtacccaaataccccatttgttaacccatcaacataaaaaccaccacaaaggggacaggcacctttgtggtggtttggggcatcaataggttctaggcgccgctacagctccacgcaaggattgtcgcgggtcacaagcgtcttaatgacaaccgtcgctcccagatagcgctcgagcagctcggctaggcgatcgatcgcggcctggcaatcccccatccgctcgggctccacgcactcaatcgccaagaatgcatcggccgaatcgtcggacagcgccgtgcgaacgccgtcgcgccagttccagcagcggcacacggcgcccgcatcatcgatgtaggcgagctcgccgggcagcgtcggatcgtccgcctcctcgccaagcggcaagaatgcatcgccaccgtcggtcaccttcaggcgaaggtctccctcgatcgcatgtaggtcctcgcctccgacgggcagcgcgtaggtcaacgacaccgtgttgtagatgtccaccgcgggcgtaatgtggcccaccggcttgcctttgagcacgcgtttgagcaggttctcgattgagcaacgcgcgccctttttggtcttgaacagacgataggcctcgcgccatgccttgaccggtgcgttctcgctgatagtatcgctggtcagatgacgctccgcatcgatattggcgcggtcgagcaacgccgcaatcgcatccacgtcctcttgaggaatctgagccgtgggcttcatgccctccacgaccacaacaccgaccgctgcctgcggaaacagctcccagaatgaatcctcggcaataaagctcttcatacgctctcccttcattgtgcgcgcccgagtgagggcgcctaaacaaaaagcgcccttacaacggccaccttcaaagtcctacggtgccgtcacaagaacgcttgcgctgtccccatccggagaaggggacgatatgtcagacgtattgtaacccgagtcatccacacgagcaaaaccaccacaaaggtgccccctttatgatggttttgagtctgaggcgacgctagcggcggagccccagcaggccgcggccgcgatgacgggcctcggcggacacctgggcgtgcgggccggcggctttgacggactcgggcaggtgagagtacttcttctcgaagttctcctcgaacatcaccgccaggttgtgcgcggcctcgtcgtagcgcgcggtgctctgccaatattggcgcggcaccaggatgccatcgggcacgccgtggcacgtcgtgggaatgtcgacgttaaagatgtcgtcgtgcacgaactcgctgtcctcgatggtgccgtcgagggcgcgcgcgaccagcgagcgcgtgtaggcaagctcgatgcgatggcccacgccgtagccgccgccgatccagccggtgttgaccaggtacacgcgcgtgcggccgtcggcaatgcgctcgccaagcatcttggcgtaaaccatggggtcgagcggcataaacggctcgccgaacagcgaagagaacgtgggcgtgggctcggtgacgccgacctcggtgccgggaatcttagccgtaaagcccgtcacaaagtggtacatggcggcgtcggccgtcaggcgcgagatgggcggcagcacgccaaaagcgtcgcaagtcaggaacagcacgacactcggagtggtgcccatgcccttagtccacgcgttaggaatgtgctccacgggataggccacgcgcgtgttgtgcgtgatcgagatgtcgtcgtagttgggcttgcggttctcgtcgagcaccacgttttcgcaaatggcgccaaaacggacggcgttgaagatctcgggctcgtggaaggcgtccaggccctcgcattttgcgtagcagccaccctcgatgttgaagatgcccatgtcggaccagccgtgctcgtcgtcgccgatcagcaggcgcgtggggttggcagaaagcgtggtcttgcccgtgccggacaggccaaagaacacggcagtctcgtgcgtgacgggatccatgctggccgagcagtgcatgggcagcacgtcatcctcgacgggcagcagatagttcatgacactgaagatggactttttgatttcgccggagtagccggtacccgcgaccaaaatcacgcgctcctggaagttgatgaccacggcggcgctggagttgaggcccttgatggcggggtcgcactggtaaccgggcgctgcgagcacgcagaagtcgggttcgccggtgcgcgcgatttcgcgggcaagcgggcgggcgagcatctgcttaataaagagtgcctggctggcacgctcgcaggcaacgagcaggcgacgcgtgtggttgcggtcggcgcccgccatgccgcgggtgacgaacacgtcgcgctcgttgagatagtcgacgatgccggccttgatggcctcatagctctcgacggacagcgggcggttgaccgcgccccaggcgattttgtcgtgcacgtcgggcgtgtcgacgataaagcggtcgttgggcgaacggccagtgtgctcccctgtctcgatcaccagcgcgccattggatgccatgcggccttcttcgcggcggatagcgtgttcgacgagctcggctgccggcaggtcgaccagcagacggggctgattctcggcgggatcttcaacgagcgtaataccaaagttggacaaaacttctgcaggggtaacaccaggcatggggcctcctttaaaaacgcgacacgtggacgcgacgcgcactttactcacgtaaagcccgttgtacccgatatgcaaaaacgtttttgcggcaagggcggcaagcccgcccaacggtcaaaaatcgcaggcaagcggcctagtcattggggacgtttttaaacgactagtcattggggacactcttgaacaggcaatattcaaggagtgtcctcggatgccggcacttagggacgttcccaaagtgccggcacataaggaacgtccctaagtgccgactacagtggcaggccttggccgagcatggctatggcgctcatcaggaccagcatgccggcagcgtagggcagcaccgcgcccaggagctcggcatccttaccgcgcacgtgcacggcggcaagaccaatggcgaaggtctgcggcgagatcatcttaccggcggcgacgcccaaggcattcaacgcgaccatccagtagtcgctcacacccagcgcagtggcagcctggctctgaatggggccaaacagcatgcccgaagacgtgcccgaaccggtcacgaacgcaccgaccgcaccgatccacggagccagaatcgggtacagaccgccggcgaccgcaatgcaaaacgcgctgatcgacgaaatcatgccggcatagcccatcaccttggcgcagcccagcaccgaaagcatggtgatcaccgtcggcgtcatctgcttcacagccgcggccagcacctcgcccatcatgcgcggcgaagcgccctgaatggcaccgccgacaaacgccgccaggaaaatccagacgcccggcgtattgatccatgaaaacgtaagcgtaccgggattctcaccgcaatacacctgcacatggctcgcaaacggcgcgagcgcagcatgtacagcgggcaccagattagacgtgcccagcagcaacacaaagatcaggatgaagcacgaccaggccgaaagcgccgacttaacggtgagcttctccccggcctcgatattcatatggaagcgagcgtccaggtgaccggatttctcggcgcgcatggcaagcgcagctgtcagcgcgagcgaaacgatggatcctacgaccacggccagctcggggcccacaaacatggcaacgaccagagccgcgccgacaaacgacacgccggagagcaacgccacgccggcaacaccgtgcagacgctcgcccacactcgcggcattgccctggtcatcggcaacacggcccgcaaccagcacaataaatagcggcatcaccacaaagaacggtgcgagctgcaccagctgaacggtcgctaggtgaagggaatccaaacccaccaggtcggcaacggacaccgtggggatgccgatggagccgtagggcgtgggcacgccgttggccagcagacagatgagcacggcaggcacggcctcaaagcccaggcccgcgagcatgccggcgggaatggcgacagcggtaccgaagccggccatgccctccataaagccaccgaagcaccaagccacgagcagcgccagcagacggcggtcgctgctgatggaggtgatcatgctgccgatcacgtccatggcgcccgtacgaacgcacaggttatacgtgaacaccgcggcgatgatcaccaggacgatgggccacagagccatcaaaaaaccttcgagcgaggcggtcgcgatctgcgctgccggcaggtgccaccatgcgaaggcaagcaagcacgaaaggacaaacgatccgatagcggccttccaagctggccatttaaagcacagcagcatcacgaccagccaaataatcggcacaagagccagtaagaatgcggcgacgtccataggtagaagctccttggtaccgcgtgggcggcatcggggggtgtcacaaaacttcaacaggataccgcacgtttaccgacaaattacagccgcccgccgaaattattgaacaatccgttcaaaaacacgaacgaacaccgtcgcgtctatactaaagcgcagcaatagaaaggactccgctttgagcatcacgcccctcgatagcattcgccgcgccatcgcccgccgcaacggcgtctccaaccccgctgcatcgagagacggcgccgcgaaggcccagggcggccgcatcgagaacggcctcttccctgcctcgcacactgccgaggaactcgcacgcatccaagagctgagtcagcgcaacgccggcgggcccgatagcagccaagccacacgtcgccggcgcgaacgcgatcgcaagcccggccccgtccgccgcatggtcaacgcttggtggaaccgtctgctcggtgccgtctacggcggcggcttctccatgcaggaagcggaatacgaggagcacgccacccgccgcgattacctttggaacgctctcggcaccgccgtgtggggcttggcgtttccgctgctcaccatcgtgtccacacagctcgtgggcgccgaagaagccggcaagttctccatcgcctttgtcaccggcacgctcatcatgatcgcatgcaactacggcgtgcgcaatttccaggtctcggacatcgacgaaaagacgtccttcgcctcctaccagctcaatcgttggatctgcggagcgctcgccctaggctgcggcctcatgtatagcagcgcccgcggctatgacgcgcagatggcgacgatcggcctgggcgtctacctgtataaggtcatcgacggcgtcgccgacgtgtacgaaggccgcctgcagcaggccgacaagctctacttggctggaatgagtcaaacgctacgctccgtcggcgtcatcgcggtcttcagcgtggcgctgttcttcacgcgtagcatgcccatcgcggccatggccatgggcatcgccgcgatcgcctcgctcgtgctggtcaccgcgccgctcgccctgctcgagaccgaaaaatcgcgccgcgtaagcctgcgcgaggtcggccacctgtttgtccagtgcgccccactctttggcgcgctattcctgttcaatcttatcgagagcatgcccaagtttgtgatggaaggaacactggcctacaaataccagttgtactttaatgccctgttttttccagctcaggctattctgttgagcattggatttgtctataaaccgcagctcctgcgcttgtcgagcatttgggctaatcctcgcaagcgtcgtcgctttgacctgattattgttgccgttatggcgctgatcgtggtcatcaccggcgtgtgcgccgcatttatggccggtcccggtattcccctcatgagctatatgtacggcctcaactttgagcgctaccgcacattggcgctgctgatggtcgtcgccggcggcgtcaccgcggccatcgactttatctacgccatcatcacggtgctgcgccatgccggcgacgtcaccaagatctacctgatctgctttgccgtgagcgtggtgctcccggtgattctgatcaatctgctcggcctgatgggcgccgtcgtgagctacctgaccatcatggccctactgctggtactgttgattatcgagtacgcccacatccgccaacgcatagagagggaccggaatccgtacggcgcctaattgcggcgatgggagaagctaatttgcggtggaatcaccccggctggagtctcnnnnnnnnnnnnnnacgtaaaactaagtgagtagatttttaccgaatccccgaccacaccgacagagcacaagtctgtgacctgcggttttattgaggcaaatatgttgggtgctcggcatttccaaaaaagtctactcacttagccggcgggcagccaaatgattatttaatcccgtcccagagaaatcaatttgcgggcagaagggcaaaagtagtcaaaaaacccttcccatattagctaccccttgcaccgattattcgcccgggttgatgttcgcgtagaactccgccccatcatcgagccgcaggatgcccacgcgaccgaactcggagccggtggcggcagcgcagtcgatgtcgatgcgatcgggcacaccggcggcatcctcgccgcccaggcgcacgatctgcccgcggcccgactcctcgtcgagccccgcaagaccaccgacctcgcaataacgcccgagcgacaccgtcggcgtgtgaccgctcacaacgaccgggcccttaccctcggtagaaagcagcccggtcggcacatcccaatagccgtgacgaatccacagcaggtcatcggacgactgtaccgcgagcatctgctgcagcagctcgcgatcggcacccaccgctccaacgccatcggcacaatcgacgccatgctcaagcaaaaacgcgcgcgccgccttcatctcgattccagcatgcaccagcagatacgggcgctcctcggtctcgaccaccgcgtagagcggcagcgcggccatccatcgcacgagctcctcgtatgcctcaaattccatgtcgttgagctgctcgcgcgtcgtccagccaccgttgatatcccaggtctcggcatcgagcggatcctgaccaatgatggcatcgagcatgatctgctcgtgattacccttgagcacgcgggcgttgggcagcgagcgcacgagcttaataacgccgaccggatcgggcccgcgatcgatcatgtcgcccagcacgtacagcgtgtcgtcggacgtcaacgagatcttagacagggcctcgtcaagcgcacgcacgtgcccgtgagcatcagatgtcacatagatcgccatggtacgcctctccttgcattgcggccgaagcccggctccgcaactaaaacttcaagttgaacttaaacgttacccattgtactccgttgcaataaagctggaaagggtttccgagcagaggcaaagacggcagtcgtctatgacgatatcgcgcacgcccgcaatccaaccccataaacccaccatctttgggtacaaataaccgcaggcaactgaccgtgccacgccaaccacccaggagcggacaccatctatgaaccagatccttctttttatcggcctcgtcatcattttgtgcctgaccatcaaacccgtcggcaaaaagctccccttccccaccctgcttatctttatcgcgctcggcatgctgttgggcgtcaacggcccggcgcatatcgactttagcgactacgcgcttaccgaaaccgtctgcagcacggcgctgctgttcatcatgttctacggcggctttaacaccaatatcgaccgcgccaagcccgtcgctgcgccggcggtgctgctgagcacgctcggcgtcgtcatcactgccggcatcaccggcgtgttcgcccactctgtgctgggcttcgactggatcggcggcctgctgctgggatcggtcgtggcgtcgaccgacgcggcaagcgtctttagcgtgctgcgcgagcacaacctttcgctgaggggcggcacagactcgctgctcgaggtcgaatcgggctccaacgaccccgtcgcctacctgctcaccgccgtgctcgccacactcgcggccggcggcgacatcaacattcccgcactgctggccaagcagatcatcctgggcgcgggtttgggtcttgccatcggctgggcggcgggccgcctgattgaacgcgcgcacgcaacggccgagggcgcgcagaccatctttttgttcgccgtggccatcgtcgcctacgcgctgccgagctacctgggcggcaacggctttttagccgtgtacctggccggcattgtgctgggcgccagcgacatcaccggcaaagtcgagatggcgcacttctttgacaccctcaccgagatggccgagatgacgatcttcttcttgctcggcctgctcgtaacgcccgcacgcctgccgcagatgctgctgccgggcctggcactcatggcgttcatgctcttcgtgagccgccccatcgccgtcggcgtgctcctagcgccctttaagacgaatccccgccaggtcgcgctcgtaagctgggcgggcctacgcggagcagcttcggtcgtctttagtctctttgccgtagtggccggcgttcccggcggacacgacctatttgacctggtgtttgcgattgccgtgtcgagcattgtggtgcagggctcgctgctgccggcggtggcgaagaagctcgatatgatcgatgcgaccggcgacgtgcgtcgcacctttaacgactaccgcgacgaagacggcatgtcgttcgtcaagctcaaagtaggcgctggacatccgtttgccggacgctcgctcgccgacattggcagcgcaacggacatgctggtggtcttggtgctgcgtgacggcgcccatccggtgctgcccaacggcgataccgtgatccaggaaggcgatctgctggtgatggccgccccaacgttcgaagagcgtgccgaggttacgctgcgcgaggtcaccgtgacgccccacggtcgcctggccggccagcgcctgcgcgatgtgccacaaggcaagcatccgtttattgtggtgatgctcaagcgcgaaggccaaacgatcatccccgacggcaacaccctaatatacgccggcgacgaagtcgtcatcgccacgctagcatcgtactaactaggaggtagctaatttaggacgaagagatcaagcgcctagagaacctcatgtcttcgctcgcagatttggatttgcctgaggagtaaggtcgcccctctcccatgtaaccatactgtaaatcatagcggcgcagtcgagttttaccgtgatgcggtcgcgcctggcgctccactgtgctaaagtatcccgaacgttcaaacgactacgagggagactagaagatggcacgtgtgcacaacttctcagctggcccggccgcactgcccacaagcgtgctcgccgagatcgccgacgagatgatggactaccgcggttgcggcatgtccgtgctcgagatgagccatcgatctagcatgtaccagcagatcatcgacgacgccgaggcaaccctgcgtcgcctgctgagcatcccgaacaactaccacgtcctatttttgcagggcggcgccacgctacagtttgcgggcatcccgatgaacctcatgcgccgcggccgcgccggctacgtcgtgaccggcaactttgccaacaaggcatacaaagaagccgacaagtacggcgaggccgtgctgctcgcgagttccgaggacaccaacttcgaccgcatccccgacatggccgacatcaacgcgcgcattgccgccgaggccgcgggcgacgggctcgactacgtttacatctgccagaacaacaccatctttggcaccatgtaccacgagctgcccgcttgcggcgacgtaccgctggtcgcagatgtctcgagctgctttctgtcgcagccgctcgacgtcgagcgctacgggctcatctacgccggcgctcagaaaaacgccggcgccgcgggcgtgaccgtggttatcgtgcgcgacgacctcatcgccgacggccccgcctttgcgcagacaccgcagtacatggaccttaaggcccaggccgccaagggctccatgctcaacacgcccaacacctttggcatctacgtgtgcggcaaggtgttccattgggtcgaggagaccggcggacttgccgccatggccgagcgcaactgggccaaggccaacctgctctacgacctgctcgagcacagcgagctgttccatggcaccacgcaggccgacagccgctccatcgccaatgtcaccttccgcaccggcgacgccgaactcgacgcggcctttgtcgcaggcgcggccgagcaccagattcaaaacgtcaagggccatcgcctggtgggcggcatgcgcgccagcgtctacaacgccgtaaccatggaagacgtgcaggcactggcctcgtacatgaaggacttcgaaacgcagcgtagtttgagcccgcgatctaactagcccgcaacgcgcgggccgaccagccacttcaaaccacctgtttaaaccaaacctgctaaggagtttttcatgcgcaagattaagaccatcgacgacatcaccaaggacggcaaagtcgagtttggcgagggctacgaatttgtgagcaccgccgaggaggccgacgccatcctgatgcgctcgactgacctgcacggctacgagctgcccgagggcatccgcgccatcgcccgctgcggcgccggcgtcaacaacatccccgtcgaggagtacgccaagaagggcgtcgtcgtctttaactcccccggtgccaacagcaacgccgttaaggagctcgtcctaggcatgctggtgctctcgagccgcggcgtggtgcaatcgatgaactgggtgcgcgacaacgccgacgaccccgagatccaggtcgatgccgaaaaagccaagaaggcctttgtgggccgcgagctcaagggcaagcgcatcggcgtcatcggtctgggcaacgtgggatccaaggtcgccaacgcctgcgtcgatctgggcatggacgtctacggctacgatccgttcatttccgtcgagcacgcatgggtgctgagccgcgaggtgcagcgcgtgggcacgctcgaggacctctgccgcggctgcgactatctcaccgtgcacgtgcccagcaaggccgacaccatcggtatgatcagcaccgagcagatcaacctgctggccccgggcgccgtgctcatcaactacgcgcgcgaaaccatcattgacgaggacgccgtcgacgctgccctgcgcgagggcaagctgagctggtttagctgcgacttcgccacgcccaagaccgtcaagatgcccaacacgtttatcaccacgcactcgggcgccggcactggcgaggccgaggccaactgcgccgacatggccatcagcgagctcaaggattacctggagaacggcaacatcgcgcacagcgtcaactaccccgcctgcagcatgggcaaggcgcgcgccgcgagccgcatcgcctgcctgcacgccaacgtgcccaacatgatcggccagatcacggccatcctggccaaggacaacgccaacgtgcagcgtatgaccaacgagtccgccggcgagaacgcctacaccatgttcgacaccgacgagcacctggacagcagcaccatcgaggcactcaagcagattccgtcgatgtatcgcgtgcgcgtaatcaaatagcgccggctgatctgacgggcagttccccatgtggcctgcccgtcactgacattgaatgcccgcggggacgcctttcgcacgagaggcgcccccgtttttgtgagcactccattaaatacaccgagccgcttcttgacatacaatctgtatgttgacctaactatctgtgaggtgcctatggttgatacagattttgcttggcggcttacgcaaggactcgtgcggatcgacagctcagacccgggtgcgtatgaggacgagattgagcgctatatcaaagcgttggttgaggaacgggtggcacagctgagccatccggtgctccatgccgtgcaggttgaggaactcgaggtgctgcccgggcgccgcaaccttatggtcaccgtgccgggactgagcgacgagccacggctcgtctatatctgccatatggataccgttacgctgggcgatggctgggacgcggacattccgccgctcggagcgatcgtgcgcaacgataaactctatggccgcggtgcctgcgatatgaagggtggtctggcctgcgccattgccgcactggtccatacgctcgagcgcgtggcggcagaaggcgagctgccccgccgtggcttctcactcatttgctcggtcgacgaggaggactttatgcgcggctcagaggccgcgatcgatgccggctgggtcggctcgcgcgaatgggtgctggacaccgaacccaccgacggacagatccaggtggcgcacaaggggcgcacgtggctcgagattgaaatggctggcgtaacggcgcatgcgagccagccgtggaagggcgcggatgccgtcgccgccatggccgaggtcgtgtgttcgctccgtcgcgcgtttgtggcgctgcccgcgcacgatgagctggggccttcgaccatcacgtttggccaaatcgagggcggatatcgcccctatgtcgtgcccgaccgcgccaaagtctgggtcgacatgcgcctgaccccgccgaccgatacggccgccgcgacgcgcatggtagagcaggccatcgccgttgccgaagccgcggtccccggctgccatggaagctacaccgtgacaggcgaccgccccgctatcgagcgcgatccaagctctcctcttctagccgcgctcaagcgtgccgccgatgacgtgacgggggcggacacgaccgtcggcttctttaccggctacaccgacaccgctgtcattgccggcaagacaggtaaccgcaattgcatgagctacggtcccgggtcgctcgcgctcgcgcacaagcccaacgaatatgtgccccatgccgatatcgttcgttgtcagcaggtgctgatcgcgctcgccgataacgtgctctgggacgcgagcggccaagttggggcataataagccgcgaacaaaccgactcgtgcgttaggaccgcccatgaaagcacttccgtttccctgcatccgcccggctcaggaccgcgtgctcgaggcgctgcctgcaatgggcagcatcctgagcggcaacgatgctctgcgcggagccattgccgatggcctgatgctcaaggacccgggcgcggcgtattacgtgtacgaatgctcgggcgagccggggcgcgtaacaggtgtcgtggcgatctgcccggttggtgcgctggcgggcggcgacgcggttgccgccgatacgaccgccgctgcgcgcgcaatcgccgacctcaaggtacagccccgtcccgtaacgcttgtctacgaagcctctcccgtcatggatatcatcctcggcgccgcaaaagagggcgcttcactctatgccgtcaccgaccccgccggcattacgcaccgcgtgtgggaggtcaagcgcgaggacgccgtcggggccatccgcgccatgctcgaccaggcgccggagccggcactggccgacgaccctgcctacgctgtcgcactagtcgaggcatcacagctcctggccgacggtgcacgtgccgccggcacctacacgggcaaagagccgttcaactttgccgtagctgcgctcttccccgccgcgcaggtcagcggcggcgcggcgcaggttccgacgggtctgctcacgcaccaggtcgcgcggttctagcaagaccagaccgtccagcacaaaaatcggcagcccaacaaacagggggcggagatgcagcaggtacatgcatctccgccccttttgcgtcgagaagttatgccgacgacccgtgccgccgcgctcgcgttatccgcgctgcggacccgcagtagccacgagcggttcaagccccagctcgcgcgcgtagtcttcctgcgtaaagacttcgaccagttcaaacgtatcggccgcatcgtcaaacgcaaaatgcagcactgagcagttgcccggcacgcgttcgcgctcgtcggccgccgcgccccgcacgtggtccaaaaactccttgatagccgaaccgtggctcaccgcgagcacacactcgtggtccggacgtcgcataagatcggttatcgtcgccgccatgcgctcgcgcacctgcatctggccctcgccgccaaactgacgatagaaatctcgccacgggcgctcgggcataagcatcacgcgctcggcctcaaagtcgccaaagaaccactcacgcagaccgtccaggcgctcgtacgccaagcccggccacaggttggcgatagtctgctcggtgcgatgaagtgtggaggtgtaggcatgatcgggttcaatgccgcgcgcacgtaagaacatgccggcacgcgccgcctggtcgcatcccagctgcgtgagcggcgagtcactccaaccctgaataatgcgcttaaggttgaatattgtctgcccatgacgaaccagatacaggtctttattcataggggtcctttcgttcgttaccaatcaaggagcgaaaacgcaccgtcgcaatagccaaaatgaagcacggcaccgttgtcgggtagctctcccctgccagtcacatactcaagaaactcctggcaggaagagccgtgggagactgccagcacacagtcgtgctgcggcctggccatgatgtgggacagcgccgcgaccatgcgcgactggagctcgccttcagactcgccaccaaaggccaccggataatcaccccagggctgcggcggcatctcgcgatttgatgtaccctccagcgagcccaaatgccactcgcgcaggtcatcgaccagctctatcgagcggccctcaccagcaattagctcagccgtatgccgcgcccggcccaacggcgaggaatacacacggtcaaaggtcacgccacgcgcctcaaacgccgcgcgcgtcgccagcgcctgctcgcgcccgcgcgccgtaagcggcgaatcgtgcccaccctgcaaaatgttctgcacattgagctcagtctgcccatgccgcaccaaatacaaatctgccacacgtcctcccctcgcaccaccgcaaaggggacaggtacctttgtggtggtttaccgccggatcacaccgcggtgacgctcagctacaccagtacgtcggcaagcgggcgcttaggtacgtggtgcacctgcgcctcgtcgcgccagtaattaattgagccgtcggggttggaatcgatcgcatcgatcacctgcgtctcggccggaacgccaaacgccatgatcagcttgagctcatacttatcgctatcgagccccatggcatcgatcgcgtggggcgtaaaggccttgaacatgcaggcagccacctcgggcgtggcgctgcgggcggcgagcatcatcgtctgcgcggcaatgcccgtgtcgacctcagtaataggagcggcgggcttacccggaacggcgcgctcggcaagaatcgcgatgtagccggtcgggcgctcgccctcatcgggacccggccaatccttgagcgcaccggcccatgcaagctcgtcaaatacacgcgcgcagtcctctgcaccgcttaccacatgaaaacgcagacgctgagcattggcaccacagggagtcaggtgcgccagctccgccagctcaagcaaaagctcacgcggcacgcgcatggactcgtcaaagcgacggcacgtgcgggcgcagcgaaccaacgcatcaaacgcgtccaagccgagcttttcgcaaccctgctttgccatcgactccgcgctcgacggcgccgcgggaactgtttcgttcatagggacccccaatttcgggcaattgttcttaggagaatctaacctaaaaccttggcaattacatacagcggcgtaatgttctacaattgttgattaatcctcactggagcgggaacaaaagtaacaattcgggaatgtggggcggcaattcgtccttcccgccccatgcatcggcgcccttgggcgatacttgttgcagcacttttggcgtacgccgcacggagagcaatgaacgcgacgtgcaccgcacggaaaggagacattatgggcatctttaagaacgatgaccaaaaatcgagccagtttggatttgacgagaaaagcatggcgggcaaagccgtcaaggccgtgcgctggatttacgccatcacgggcgtcttggcgctcgtcgccggcatcgcactgctgtttgcgcccgccaagtccctcgtcttcctaacgaccgtcttgggcttctactttgtgatcacggccgcgatcaggctgtttaccgctgttttcgagccactgctgcccaccggctggcgcgtgacgagcatcatctccaacctactcattatcttgggcggcgtcataatcctgcgcaaccaggccttctcgaccgcgacgctcaccacgatggtggttatcgtggccggctttggctggatcgtcgaaggtgtcatgtccattctggagtccgagctttcgtccaaccgtgccctcgccatcctgagcggcgcgctctccatcatcgccggcatgttcgtgtttatctatccgctgtggtcggccaagatgctcgtcatctttagcggcaccgcactgctggtgtttggcgtaacgctgattgttcgcgctattcaatttggcaaactggtgcactagatgccgcgaacgctctttattgatgcagacgcctgcccggtcacgcgcgagtcgattgactgcgcgcggcgggcgggcgtcgccgtcgttatcgccggcaacagcacacagaacctggaacgccacattcgccgcgacgatccgcgcgacgtcgagcatgcgcgacgcggattttgggtcacgacgctcgatgtgagcgtgggcgccgacagcgccgactttgccattgtcgaacgcctgcaggcgggcgacgtagtcgtgacgcaggacattggcttggcgagcatggtgctcgggcgcgatgccgccgccatcggcgtgcgcgggcgcgtctacgataaggcgaccatcgacatgcaactgtttattcgccacgaggaaaagaaggtgcgccgcgccggcggtcgcactcgcggtccggcggcatttaccagcgaagaccgggcccgctttaagcgcagcctcaccgagctgctgcgctaaccaaggtagattttcgggacatgcccggaaatctacctttttgttttgcgcggtgtgagcgctcggaatccatggctcaacaaaaaacgggcttcaaaatgccatgcgtcgccgcattgcgcaggcgccgagcatggctatttgaagcccattttttaggcctacttagaggccgaaggcggataggataaggccccagccggcgccgatgacgtacatcatgaccaggaacacggcgttttcacgagcgctgcggttggtgcggaacaggacaagatagcccacgccggcggaaatgagcgtgccggcgagcatcggcgccagctgtagcgcgccctccaggtacagctgcgtaatgaccacgctggccgagcagttggggatcaggccgacgagtgccgagcccaagacggcgagcgtctcgttgccacgcaggaactgctcgatcgcgaactctccgaaggtctcgagcacggcaactagaatcagcgtcaccaggaaaataaaaaccgaaacctgcacggtgtgcgagatcgcgctgcggataatcgacaggacgggcgcaccttcgtgggagtgaccgtggtcgtgcccatggccgtggtggtgctcatgctcgcctgcgtgaccgtggtcatggctgtgtccgtggtcgcgctcgtgttcatcttcatcatcatcgcaaccgcaatggtcgcgctcgcacaactcgtggatgtggtcggcgctcacgcccgcctcggccacttcatcaatgatgtcgcccccggtatggtcgtcgtgcgcgcagttcacatgagccggattggcagcggtccccagcacggtacggcgaatcgccgcatgcgcgcgggaattacgacgaaggccgcggatagccgcgtccacgataaagcccgtgaccagcgcgatcagtgccttcgaagccaaaagcatcgccatggtctgcacgggcacctgctcggcgagcaacagcggcagcatctcatcggaggtcgagaggaacacggcgaccagcgtgcccagcgtcacgacacggccggcgtacagcgttgctgccatggccgaaaatccgcactgcggcacaatgcccagcagcgagccagccacgggacccgcagcgccggcgcgcttgatagcgccgttgacgcggtcgcccgcaacgtgctcaagtgtctcgagagcaagatacgtcaccaacaaaaacggcgccagcgagagcgtgtccttgccggcgtcgagcagaatatcaatcagcaaatccatgacggatggaacctttcatgtctttcggcagcattgtaaaagtcctagcggtcaactagggtattgtagttgtcctaggcgcgatgccaatagttgcccatggtaaactatcatctcgccataactcaatgccaccgagccgcgcgacacggcccgtccaaggagcagttatatgaacgtttcacaagcactcgaatacgagcgccagccgtttattcccatgtttatctatggcgatcacggcgccatggagtccgagcgccagaagggcgaggaggcccttaaggtgctcgaaaccgagtactttaccgccgagggcgaccccagcttcgactttgccaccgtgcgcgacctggctgaccgcaaccgcgacctgtgcgaccagattggcgaggcgcgcctgcgcaacgtgacgcccgcgacgctttcgcgcggcctgtccgatgccgacacctgcgccgccatcggcaagatgcaaaagcgcaccgccgcgtcggtcatgcgcgagatccgcggcgaccgcgacgcgctcggcgtggcctacgcccgcaagcccatccagggcaccgtgctcggtatcgacatcgagaccaccggccgtgcacccgagcgcggttatatcatcaatgtgggttgggaaatcatggagctcaccagcgacgccgtcccgcacgacgccgaggcgcactactgcggtttgcccgacatctaccgcggcgaggatgtgccgttgtcgaatatccaccacatcacctgggacgacatcgacggcaaaaagccattccgcgagaacaaggaactgcagaagcagctgctcaagcttatgaagaagtacccttacatggcgcacaacgccgcctttgaggacagttggttcaagatccacctggacggttacgccgaggcacgccgcgccggcaagatcatcgtcatcgactcgcgccagatctgccgcagcctggatgccgacgtccgctcgctcccccgcgaatccgcgcccgccgcactcgagaactgggcgcgccgccgtggaaccctcgccgccgacgccaacgagcagcacctgggcctcgacgacaccgacctcatgctccgcacggttcaggccgagttcaacctcaagaacctattcgcgaaataaccgatccatctgcgggagcgcctgccaggcacagcgcaatccgtctgggcacaccgacacgcagtaaactagggcgcagccttatggctgcaccctagttttcatcaaaacgagcaaatacgcgtgcttcacatagtcggcaggttggcccacctacatttttcgagttgttcggccagctgaaccactagtcaaggccccttgaaccgcaatcgaagctaaaatcgccttaatttcgcaaccaagccccataaatctacctgaatcaattcgaataggacgttgcgatcgcaccatttgtataggataaggccgaataactcaaattatgttggtgaggcatctgagcggtcggcaaaaacgcttagaagctacgaatccgcaactaaagttcatcaaaaaggggcagccggcagaaacctccccagccaaagctgctccctcaatacgacagctcaaaaacccaccgttcgcagaagataagccgcgccccaataccgttgcccgaagtttcgggcgtatgcggcgtccgctatgccatcatgcgcgtatgggaatcattctgtcacataccacggcacgcgctgtataccaaacagccaactcgctcgcaagctacgcgaccggtcccatacctatggaaaagatcagggtgtctgcgccgaccacgtccgacctggaagcggcacgagcatggctcaacagaaagaatgtcgattctgaacgtatccatgtgctgacgttttccaataatgccaaaaggcaccgcaagggctgcatctgccactgcacgcgctatacgtttgatgcagaaagctacctagaactcgagccgaacgtctacatcgtcgatatcaagctgtgcgcgttagaagcaacagccgacctcaacctttcggagctcgttgagtattactttgaaatctgcggctcctacgcgcttggaacgtccgacgaaactcaatatcgcgagcgcccagccctaaccagcgttgaagagctcagagccttcttttcagaggcaccggggtatcgtggatctaataaagcacttaaggcactttcttatgtacacgaaggctgtcgctccccactcgaaacggcgtttgtcatgatgctgacaatgcccaagtcaatgggtggcttagccatacgcgctatcaaaacggattatccgatcccagtccccaaaagatacgccgccctaacgcgacggacggttttctacctcgacgcgctgctcgaaaattcgatgaccgatatcgaatacaacggcttttaccacgacgaacccgagcagcaatcaattgacgaggagcgccgaaacacgctgcgaaacatgggatatgccgttatcacggttaatcgtcattcgtttttcaagcagtccgcttttaaacgggtcatggaagcgattcgcattcgcgagaagatatggcccggtcgactcccggataacttcgccatcctgcaagaaactcttcgtcaatttgtcttgcggcgctacttcgaatacggtcgccgcgtcctggagacactcaaagaagaagaggccgccaagcgcgaaattgcaagccaatatccgcaagctgatgacccgagcatcaacgatgtgcccgaacccgacgacatgcaacacgtcggggcccttgctgaggaaatcaatggggcttgggaatgcgacatgttcgcaaaaatcgatgaaaaccgcacggacgacgacacgattattgatctaattgagaattcgctcttctaaaggcgatctctgcggatgtccacctacatttttcgacttattcggccaccgatgtgccagattggctgcagcaatgctcaatataactttagataaaactgattctgcagaaactcccgtagaggaagaactgattctcgcggtatttgacacgataaagtacaaatatgaacagttctaatgcttctcaaggtggctttcttagcatgctagccgaacatctcgaaatatgttggcgagcattgcgtcgatgtctcccaacccacagaaaatcgcagaagcggcaagcagtcatcgaaattaacgcaaattgtattgacatatgaacatacactcatataatcggaagcaagttatatgagcgcatgttcatatgaagggatattgcaatgagcatccgcgttgatgaaacgaagcccgacatcgaggccaccgagcccgcgatccccaccacctgctcgcccgaggaccttcccgacgaggagcttctctacgacctcgccgacctgttcaaggtcttcagcgacaccacgcgcatcaagatcctctatgccctcatgggccgcgagctctgcgtagcagacatcgccgaagcgaccgaaacctcgcagtccgcggtgtcgcaccagctgcgcacactcaagcagtcgcacctggttaaattccggcgcgacgggcgcaatatcctatactcgctcgccgacgaccacgtctacaccatgctcaaccagggcatgagccacatctgcgaatagcgaccaaccacggtaccagcgcggcctgcacccaagccgcaaatacggggaaaggaatccaccatgaaaaagcagttcaagctcgacgagatcgactgcgccaactgcgcgcgtaagcttcaggacgagctggccaagctcgatggcgtcaagtccgtttcggtcaactttatgacccagaagctgacgctcgaggccgatgaagccgagttcgacgaggtcctcgaccgcgttgtggagttcaccgccgacgccgagccggactgcgagatcattctctagccaaggtttacgccaacccgcaaggccgcgcttgccgcggcctttgctcgcgaaattatatgagcgagtgttcatacattcaaatgggaggatacgagtcatggccaccgccgaccccaagaagaaaaagaagaagcgcaagaaaaaagagtcactcgagcataagcacaaccgcatcctggtagcgctgggcatttttgccgtggtgtacgccctcgatgagctcggcaccctcactgccgcattcggcaccccgggcgacatctacgccagcttcgcactgttcctcgtgccttttttgattgccggctacgacgtgctccaaaaggcatacaacaacatccgccgcggcaaggcgttcgacgagagcttcctcatggccgtcgcgaccatcggcgcgtttgccatggtgctcttccccgacaccgatccgcacatggccgaaggcgccgccgtcatgctgttctaccaggtcggcgagctgttccaggcatacgccgtgggcaagagccgtaaatcgatcagcgccatgatggacatcgcacccgactacgccaacgtcgagcaacccgacggcacactcgagcaggtcttccccgatgacatcgccgtgggcaccgtcatcgtcgtcaagcccggcgagcgcgtgcctatcgacggcgtcatcgtcgagggcgagacacagctcgataccgccgcgctcacgggcgagtcagtcccccgccccgccaagtccggcgacgatatcatcagcggctgcatcaacatgacggggctcatccacgtgcgcaccaccaagccctttggcgagtccaccgtcgcgcgcgtcctggagctcgtagaaaacgccagcgaaaagaaggcgcgcaccgagaacttcatcacgcgctttgcccgcatctacacgcccgccgtcaccggcgctgccgcggtactcgcgctcggcggcggcttggtcaccggcgcctggtccgactggatcctgcgcggcctgaccttcctggtcgtcagctgcccgtgcgcgctcgtgatcagcgtgccgctgagcttctttggcggcatcggcggcgcgtccaagctgggcgttctcatcaagggttctaactacctcgagacgctcgccgacgtggacaccgtcgtctttgacaagacgggcaccctcaccaacggcacgttctcggtggtcgcggtacaccccgaggccggctataccgagcagtcgttgctcgaagtcgcagcccttgctgagtcgttctccgatcaccccatcgcgcagtccgtacgtgtcgcctaccagggcgaggtcgaccccaagcgcgtaagcgactccaccaacgacgcgggccatggcgtgacggcaaccatcgacggcaagcacgtcgtcgttggcaacgcaaagatgctcgccgcggccggagtcgaagcgcccgattgcgaggtcgtcggcaccatcctccacgtgctagtcgatggcatctatgccggccacattgtaattgccgacaccataaaggccgatgccgagcagacgatccgcgacctgcacgccgccggcgtcaagcgcaccgtcatgctcacgggcgaccgcgaggaagtggctgctgcggtggccaagcggctggggctcgacgagttccacgcgcagctgttaccgggtgataaggtcgagcgtgtcgaggcgctgcttgcagcagaatcgggcaagggcaagctcgcctttgtaggcgacggtatcaacgacgcacccgtgcttacccgcgcagacgttggcatcgccatgggcgctatgggctcggacgccgcaattgaggcggcggacgtcgtgctcatggatgacaagccgtccaacatctcccgcgcgatccgcgtggcgcgcaagaccatgtcgattgtttggcagaacatcatctttgcgctgggcattaagttgctgattctggtgcttgcggcactgggcatcgccaacatgtggcttgctgtgttcggcgacgtgggcgtggcgattatcgccatcctgaatgccatgcgcgcgatgggtgtcaagaacctgtagcgttcgtgggctgtccggccgggaccgggcttggttttgaaaacgtcctcgcgcatgaggcccgtctttcctgctcctgcggagcaacggaaaggcgggcctcgcgctgtggagtgttttcaaaaccaaacccggccccggcctgcggtgacgtaggtggcagttcttgggcatcgcttgctggcggggttcctttgctgaaatggacttggccgaaaggaccgctggtcccggtcgctggttcgcgctttgcgcgaactccgcgctactgggggttcgttaggattccgccgcttggcccgtcgcctcgccccggttcagcatcgccctcagtttctcgaagctttcctcgctcaggcagtgctccatgtggcagccctcttgcgacgcgacctcagccgaaacacccgcatcctccagcagccccacgaaaaagcagtgacgctcccacatttggcgagcgacctccagaccacgctccgtcagatgaacgtcgcgcttgcccatttcgacatagccgttgctttccagcgtcgccatggccttggaaacgctcgccttggttacgccgaggtactccgcaacgtcgatcgagcgcacgatgccctggcgttccgacagaacgtagatcgattcgagatagtcttctccggattcacgtagggccatgggccgcctttcgcgatgattgctagttagcctttggatactttccacggcttactttaccgcaaaagttgcccatgtcttactactttgcctaaaagttagccgtgtttcacaaaacgagcgggacgaaaacaaaatgggaacacgccccgcaaggagtgtccccacgtgccgagccgcagctatagcagtccaaagtacttcgcggcgttgtagatcccatcgtcgtccacggcggtcgtcacgtaggtcgccgcagctttcaccgtgtcctgcgcgttgcccatggccacacttgtgcccacggccgagaacatcgacaggtcgttctcgccgtcgccaaaggcaatcgcttcactcgcgtcgatgcccaggcgctccagcgtcgccgccacacccaggtccttgccgccgttggccggaataatgtcgcagaacaggtcgcaccagcgcgtggtgagcgaatgcgacacggcatcggtcacgatatgctcgtcaactgggtcaacaaaggcacagaactgatagaccggcgcgtcaaaggcatgctcaaacggctcctcgtggtagacgattcccgcgttgctgccagccgtcaccacgcgctcggacaggcggttcacaaacgagttctcgccctgcatgcacagtgagtcgtagcgcccctgcgccacctggtccacaatcaccgcaacgtcgtccggatcgatcgggcagctgcggtagacgcccttggcatcaaaacagtgctggcccgaaagcgtaatgtacgcatcccagcccaggtcgaacagccagtccggcatctggtaggtcggacggcccgtggcgatcacgcacgcaatcccctgctcgcgaaagctgtcgagcacctgctgcgccgacgccggaatccggtgggtcttaaagctcagcagcgtgccgtcgatatcgaaaaacgcggctttgatcattctcgcctactcctcgccctcgagcttttcgctcgcctcgagccacgccatctccagctcgtccatggcggcgtgagcctcgtcgatctttgcctgctgctcgccgagcgccgtgtagttggtgggatcgacctgggccatggcggcctcggcctcctccacgcgggcgcgctgcgtctccatcttgcgctcgagcgagctcacctcgcggcggagcttctgacgctcggcgttggaaaggccgttgggctgaccgctcgacttgggcttgtcggcagcagccgccgcaccggtgtcgaacgtgccggtcttagcgctcggcgcgcccacgggctcgccctcggcggtagcgttgcacaggcgcaggtactggtccacgccgccgggcatatgcgtcagatggccatcgagcagtgcccactgttggtcggtcacgcgctccatcaaaaagcgatcgtgtgtcaccaggatcagcgtgccgggccagccgtccagcaggtcctcgacaatcgcgagcatgtcggtatccaggtcgttgcccggctcgtccaggatgagcacgttgggctcgtccagaatcgtcagcaacagcgacaggcgacggcgctggccgcccgaaagatcgccgatgcggctccagagctgctgcgtcgtaaagcccagacgctcgcagagcttctcgggcgaagtctccttgccgtcgatgacgtagtacttcttatagttgccgagcacctcgcggatcgtgtcgcccatgtagggttcgagctcctcgagctgctgcgacagcacgccaaagcgcactgtctggccaatcttcacgcggccgcgcgtgggttcaatcttgccctggatcacgtcgagcagcgtcgacttgccggcaccgttctcgcccaaaaggccatagcggtcgcccgcaccaatgagccaggtcacgtcagagagcacctgcttgggcgcgccatcggtatccgcatagccggcgtccacgtcgaccacatcgataacctgcttgcccaggcggctcacggcgaggcgcttgagctccagctcgtcacgcacgggcggcacgtcggcgatcagctcgcgagcggcatcaacgcgaaacttgggcttggtggaacgcgcctgggcgccgcggctcagccacgcgagctccttgcgcgccatgttgcgacggcgttcctcggtaaccgcggccatgcggtcgcgctccacgcgctgcaggatatatgcggagtagccgccctcgaagggatcgacctggccgtcgtggacctcccacatgctggtgcagacctcgtccaagaaccagcgatcgtgcgtgaccacgagcatggcgccctgaccgcgctgccagcgagccttaagatggcgtgcaagccagttgatggtgcgcatgtccagatggttagtgggctcgtcgagcatgagcacgtcgtagtcgccgatcaacaggcgcgcgaggtccacgcggcggcgctggccacccgaaagctcgcccaccgtgccctcccagggcacatcgctaatgagaccggcgaggatctggcgcgtgcgggggctcgacgcccactcatactcgggcgtgtcgcccacgacggcatggtgcacggtgtcggtgtcgacaagctggtccttttggccgagcaggccgatcgtggtgccgcgacgatgcgtcacgcggccgtcgtcgggctccagcgtgccggcgagcacgctcagcagcgtcgacttgccgtcgccgtttttaccgacaataccaatacggtcgccctcgcccacgccgagcgtcacgctatcgaaaatatgcttggtgggaaactctaggctgacggaatcgcatcccaaaagaatcgccatatgccctgctccttcgtagaaattcaacgttgtccataatagcagcgaaaaggcgggccgcacacgacacaaaaaggcgggccatctcccaaaagagatgacccgcctctccaatcagtcccgtggcaaccgtggccgccgcgggcctcaagcatgtcccggactaggagaacatgccggtgaggtaatcattcagccgcttatccttgggccgttggaaaatctcgtcagtctcgtcgtactcgaccatatcgcccatgtagaagaacgccgtgcggttggacacgcgcgacgcctgctccatgttgtgcgtcacgataacgatggcgcggtcggccacgatcgatgacatgaggtcctcgatcgccagcgtcgagatggggtcgagcgccgagcagggctcgtcgaacagaatcacgtcggggttgagcgccagcgtgcgcgcgatgcacagacgctgctgctggccgcccgaaagcgcgtaggcgctcttgtcgagcttgtctttgacctcgtcccaaagcgccgcgccgcgcaggctttcctcgaccatgcggtcgagctcgtcgcggtcggtgatgccgtggcgcttaggcgcaaacgtgatgttgtcgcgaatggacttgcggaacgggttgggctgctggaacaccatgccaatggaacggcgcagctcgtaggtgttttcggtcttggtgttcacgttgcgcccgcgatagttgatctcgccctccacgcggcagccgcgaatctcgcgattcatgaggttgaggctacgcaagaaggtcgacttaccgcagcccgaaggcccgatgagcgccgtgatctcgcccttgtgaaagtcgagcgacgtattgtgcagtgcatggtggtcgccatagtacacgttgacgtccttggtggagagcacgacctcgtcgctcacggccttgccgctcgcgcgcacgcgcttctcgctctcccccacgctcgacaaaaagtcctgggtctcggacgatgccgcctcagttgcgggcgttgcatttatctcgctcattcggccgtcatcttccttgccagttgtttgcccacgatacgggcgactacgttaaacagcagcacgcaaatcatcagcagcgccgcggtgccccaaacgatctgctgggcctcggggctgccctcgccatagatcttgtagatgtgcacggcgagcgactcaccggggcggaacacgttccaggcgcaggtggggctcgacaggttaaagctcaagaagttcagacgcaccggcgagctcatgcccgaggtaaagagcagcgccgcggcctcgccaaagacgcggccggccgaaagcacgatgccggtcacgatggcgggcatggcctcgggaatcaggatgtgcagcgtggcctcccagcgggtaaggcccatggccaggcatgcatcgcgctgggcctgtggcacgtcctcgagcgcctgctgaatcacgcgcaccagaatggggatattgaacatggtgagcgcgacggcgccggagatgatggagtacttccagcccagctgcaccgagaacaccaggaagccaaacatgccgacgacgatggaaggcagcgaggacagcgtctcgatggcggtagaggcgatgtcgcggatagggccgttcggcgcgtactcaaccaggaagaccgctccgcctaggctgatgggcaccgagatgatcagagtgatcagcagcaggtagaacgagtcgaacagctggtagagcacgccgccctgcgttccgttggcgcgcgacggctctgtgagaaagcccggctggaacagcgtcgagatgccctcaaacaggatataggccaccatggagatgacgatgagcatgacgatggcgacgatcgccgtcagcacgcccgtggcgatgcgatcctgcttttggacacgcccgagcctcgcctcgtcgatgtggatgcgcgtgctagccacgagccttcgcccccttgcggccaatgagatggatgatcaggatgaagatgaggctcatgcccatcagcagcagaccgagtgcccacaggacgtcgtcctgggccgagccctcggcgtagaccgccatggacgtggtgagcgtggtggtgatggtcgaagccggcgacagcagcgacgtcggcatggcctcgatgccgccgatgaccatgcgcacggcgagcgtctcgccaaaggcgcgggtcatgcccaagataaccgcggtcatgagcgacggcatggcggacttgagcaccacgtgccagatggtctgccagcgggtgtagcccagcgcgagcgagccctgtcggtagccgtcgggcacggcgcgcaggccatcgaccgaaagcgtggtcatcgtcggcagaatcatgaccgccagcacgatggcgccgggcaagatgcccaggcccgtgctcacatggaaaacactcttcataaggccgacaaccacgtgaaagccgatcaagccaaagacgaccgagggaatgccggtcaaaagctcaataagcggctgaaagatcttggaaccaaacttaggctggatctcgaccgcaaagatggcagagccgatggcgatgggcagcgcgatgagcgtggagagcaccatgactgcaaacgaggtgacgatcaggggcagggcgccggtataaggcaggccgttttcggccgtgttggccaggtcccacttggtgccggtaaagaactcgacgaccgagacgccgtccttgataaaagccgagaggcccttttgggcgaccataaagatgagcgcggcaacgacaagcgtcacgagcgctacgcacgcgcccgtgacgctcaggcccacgttctcaaggtcgcgctttggcagctgttttgccattgcaaacctttccgggggcgattacttatttagcagagaccttgccgctggcgtccttgacgaccttcatggcagagacggggataaagccctgctcctcgacgagcttgccctggacgtcgtcggaaagcatgaactccaggaaggccgtggtggcctcgtcggcgtccttggagcagtacatgtgctcggtagcccagatcttgaaggagtcgtcggtgacgtttgcgctcttgggctcgacgccctcgaccttgatggcgttgaacttggagtcatcgaagtgcgagaagtcgaggtaggagatggcgttgtcggtactgcccatctgagtctggacgtcgccggacttgtcgagctcggcgtcgcccttaaagtcgactgcctcgtcgccaaagacggcagcctcgaaggtggcgcgggtaccggaaccggccttgcggttgagaacgacgatcttggcgtcgtcgccgccgacctccttccagttggtgatctggccggagaagatgcccttgagctgctcgagggacaggtcgtcgaccttcacgttcttagagacgacgggacccatgcccacgacggcgacctcgtggtcgacgaggttcttgacctggtcggcctcgagcttggtctcggcgaagacgtcggagttaccgatggtgacggtgccggcggcaacagcggtcagacctttgcccgaaccgttgcccgagccggagacggagacgtcggggttggcatccatgaacttctcggcagcggcctcgacgagagcctggaacgaggaggcaccgtcgtaggtcacctcgccggagacggactcggcagcagcggcgctacccttgtcggcggcgtcggatgcgcctgcgccgccgcagccaacgagaccgagaccgacgatgctggcaagaccaccagcgaggccgaggaactgacgacgagaataagcctgatcgagcatgatcttcctttcgtacatgcgaatcgcgggcaccctgcccgctttgctgtttggaaagatacgaccccgaccgggcagcacccgcgccaactgcggtttcttacgggcatttgataaacccttaccgcaagcgcggcagggctttacaaacgaataacaatccagcgccaaatatggcgcaccttttacaccaataaaagcaaagttgcggtgaaatagttcctgtttggctgttaggcagccgattctaggaactattccaccgcaacttagattggcaaaacgccgcaaccttaaagctcgagctcgttgagccttaagatcgcaacaatatagatcttgagcgcttgcttgagctgttcctcgttggcgcactcgttggggccatgcatctggccgccccatgcgggcaactccaggccggtctcctcggggccaaatgacacggcgcgggcaaagttgcgcgcgtacgtgccgccgcccatggcaaagggctcggcatgcttacccgtaaactcgttataggtatcaatcagcgctttcacggccggatcgtcggcagagaccgagaacggcaccttcgcgcgacccagctggcacgtcacgccaaaacggcccacgagcgggtcgagctgctcgcggatggtatcggcactcgtgctgtcggggaagcgcacgtcgatgacctgctcaatatggccatccgccacgcggatgacgccagcgttgcaggtaagcgggccaaacgccgagctcgtcgcatcgatacccaagccgcggccataggcgtctgcatgtacaaaggccaggaacttgacgaactcgtgctcggcaggcgtcagcaggcgctcgtcacgggcaccaaacgcgtcctcggcctcgcgcaggtacgtcacgatcaggccgacggcgttgatcgtcccctcgggcatcgaagcatggccaccgataccgtgcgcgaaaatctgggcatggccgttctcgagcgccgtgatctccaggcggtcggcgttctcaatgggcgccggcagttcatcggcggcaatcgcaagctcgcagatagactgcgacggaatggcgttgctcgcctcggcaccgctccacgatacgatgcgccctccatcgatcttggggctcacaaacgtcgccccaaactggcccttctcggcattgcagaccgggaactcggcatcgggcgtaaacaaaaagtcggggtctgcgtggttctccagataatggtgaacgtcggacatgcccacttcctcatcgcagcccagcagcgcgcggaaggtatagcgcggcacaatgccgtgcttgagcaggtaggcaccggcgtagagcgacaacaccgccggacccttgtcatcaatcacgccacggccgagcagccatccctcgcgacgctccatcgcaaacgggtcggtgttccagccggggccggcgggcaccacgtccacgtggcagatggtcgcgagctgcttgtcgccgcgacccgggatatcggcaatgcccacatagccctcgtcgtcgctcgtctggtagccgagcttttgcgcaatgccgagcgcgcaatcgagcgcatcacgaaccgggcggccaaacggcgcgctaggctccgcatcggcagcaacggccacggacggatagctcaccagttgttcgatatcggcgacgacatcttcccagacctcgtcgacatactcagcgacgctctgctccacctgattcatggactgcctccttaccaatgagcgacgggtacgcccgcccctcacatcaagtacttatatagcgaaaagtttagcaagctcggccaccgagtgcaccactgcatcggcacccgccgcctcgtgctcgcccggcgccgccgcgcccgaatagatgccaatgcacggcacgcccatcgcgtgcgcgccctccacatcgttaaagcgatcgccgatcatcacggcaacgtcggccgtcgcgccgagcgccgccagagcatcgcggaccgaatcggccttggtctcgcgaccctgcggcggattcatgccaaccaccgcctcaaactgagaaagcccgagctcacgcaccatgtcgatgcactttgcctccatgcgcgacgtcgccacggccatacgcttgccccgggcggctaacccatccagcagctcggggatcccgtcaaacacgggatactcctccggtcccagctcatcaaaaaagacgcgatactcatcggccaccacaagcgactcctcgcgggaaaagccgtaaaagtcgtgaaagctcttccacaggggcggcccgatcatgcggcgcagatcacccatctgcgcctccgaaaacccgcgcgtagccagcgtcttgcgcgtcgaggtcatcaccgcccgacccgtatcggccaccgtgccatcgaaatcaaacagcacgaccggccgcctgcatatctccagtgcctccatcggcatccctcttccccagttgacgatttccacaccgacacttcaaactgttgactattcaacaattgaacctagaaatgtggaacgactccactatacttgtcgcactttgctctcagaaggcggcgccgtcgcgccccaacgaaaggtgcaattatgtcttttgccatcataaccgactccacgtcggacatctcccccgcccgtgctcaagagctcggcatttacgtgattccgctgcatgtgattatcgagggcgaggacctgctcgaccaggtgcagattaccgcccaggagtacgtcgcgcgcatggctggctccgagcagctgccgcacacctcgcagccgagcgccggcgagttcaaggcactctttgaccgcgtgcgcgccgacggccacgacagcgccatctttatctcgctgtgcagcgagtggtccgcctgctacgccaacgcgtgccaggtggccgatacccacgagctcgacgtgcgctgcatcgattcgcgcaccggctcgggcgccgagggcctgctggtggagtacgcgctcgccatgcgcgaggacggccgcagcctggacgaggccgaggctcagatccgcgcgacgctgcccgacgcccacctgctgctgattccgcgcacactcgagaacctggtcaagaacggccgtgcgcccaagctcgccggccagctcacgcaaatgctcaacattcgcctggccgtttcgccggagtggaaatcgggcgagatcaaggccataaaaaagggccgcggtgccaagcgcatcgttaccaacaccatggccgattgcctcgcatttttggctgagcatccgggctccagcgtgcgcgtgctcacgaccggcgccgccgaggagcaggagctcgtcagccaagcgctcgcaggccaagactatgtagacgccggcaccggccccatcggctgcaccatcgccacccatgtaggcgtcgacgccatcgccatcagctactgcccccgctaccagcccatccactaggggcacctttaccgcttgcggtggaatagggactatttttggcttatcagccgcaaatcaatccctattccaccgcaacctagaaatcggcgatcagcccagcgggccctgaaacagctcctgatgagtgcccattctcaccagcctaatcactgggttagtcttatggggaagataaagaacgaccacatcgaccaagccatcggataggtggaaatcgatgtggccgttgtagtttccgcccgggtttgagagctcgtgggcgccgtactccgctggaagcgacccatgggccacaagctctgcaaccgccgctttaaactcactctttagctgcggatggatgcgcatcgtccgtttgtaatccgccttaaactgagcctcgactttaatctcaaacatcgctagtcctcatcgaggaacgacataagctcatcagcgtcgttgaatgacgggctatcgtccggcaaaatccccaactcatgagcctcggcgattaccatggcacgcctcgtcgcttcgttgggcacttccgcccttcctacgatctcaaaaggaatctttcgctgatttacaagctgccgaacggcaagattcagataggaattgaggctgaggccgaccgaatccaagaactcagtcgcctgctccttgagcccctcttcgatgcgaaccgtcgtaggcttaaccgttgcagtagacatacgcgacctcctcgccctcgtcttttgcatcagtatacccaatataaatggcaaactgacgttagatagcatcagattgctatatatattcatatcgcggtgggcacgattgccctacatcagcccactcagggcaatgtcgacggcttcgttgaggtcgtcggtgatgtgtacgagctcgggatcgagcgggctgatcataccggcatccatcaccgggccgttgagccagtcgaacaggccctgccagtactcgctgcctaccagcacgagcggcatgcgcttgaccttgtgcgtctgcaccagcgtgagcacctcgaacatctcgtcgagcgtaccaaaacctccgggaaacacgatggcgcccgagctgtatttgacgaacatggtcttgcgcacaaagaagtagcggaagtccatacccaggttcacgtatttgttgagcccctgctcgtgcggtagttcgatacccaaaccgaccgacttgccgttggcgctcgccgctcccctgttggccgcctccatgatgccagggccgccgccggtgataaccgcgacgccgcgctgggcgattttgcggccgaccgtgcgcgccgccttgtagagcggatcggtcttgggcgtgcgggcactaccgaagatggtcaccgcgggcccgagctcggcaagcgcgccgaagccatcgacaaactcggcctgaatgcgcagcacgcgccagggatcggcatgcagccagtcggtcgagtcctcgggcgccagcagattggcgtaggtgttgtccttaggaatcatggggccgcgcatgaccacggggccgcggcggtacgtctcgtcgtaggcgggctcgccctcgacgttcccattcttaatcatgggtactcctatcgaaaacagaaacgggcggggtcgacgccatgcgtcaaacacccgcccgaacatcaaccattcggtatggtacccacgatgcatcaagcgcttgcaagacatcggtcagcggtcttgcagaccatgttagcgaacgcgacgaccgatcgccgcttggcctttgccgttgcccgcgctccgcaagcgtccgcgccgtccttagtaatccaccgccgcggggctgttcatccagtcgctcacgaacgcaccgtagcggccctcgataatggcctgacgggcacgctgcataaggttgagcaggtagtagatgttgtgcatcgacagcagaataccgccgagcatctccttctgcgtgaccatgtgacggatgagcgcgcggctgtagccgcccgtgcacaccgggcaggtgcaggtgggatcgatgggaccgtcgtcgtgcgcaaaacgcgcgttgcggaagttaaggcgaccctcgctggagaacgccgtgcccatgcggccggtgcgcgtcggcagcacgcagtcgaacatgtcgatgcccacgcccacaccgcgcacgagggtggtggggttgccgacgcccatcaggtagcgcggcttgtgcttgggcatgtactcggaagccagcggcgccagggtctcgaacatggtctcgtggtcctcgcccaccgagtagccgccgatgccgtagccggggaagtcaccgcactcctccagatggcgcagcgagcgcaggcgcaagtccagatgcatgccaccctgaacgatgccgaaaagtgcctggtcatcgcgggtgtgagccttgtagcagcgctcggcccacatactcgacagctcaacggcgcgctcaacgtaggcgcgcgtggcgggatagcccgggcactggtccagctgcatgcagatgtcggagccgagcttcatggcgatttccatgttgtcctcgggcgtccagaacacgtggcgaccgtcgtagtcgttgacgataaagcgtacgccctcgtcggtgagcttgacggcgtcgttgtggctgaacacctggaagccgcccgagtcggtaagaatggggccatgccagttcataaatttgtgcagtccgcccagctcagcgatggtgtcctcgccgggacgcatggacaggtggtaggtgttggcgagcacgatctgcgcaccgagctgcttgacggtctcggtggggatgcccttgacgtttgccttggtgcccacgggcataaagatcggcgtctcgatgtcgccatgcggggtgtgcagcacgccggcacgcgcgtgcgtcgtcgggtcctcggcgatcaggtcgaatttaaaaaggttctggtccataaactggaactccttggttgcggctcatacgcaaaccattatacgggcaacccgcaaggagcaccgactcgacagaaactggcgcattaaacaactagccgttggggacgttcttaaacgactagttgttggggacagccttcagcgccatcttgcaaaggagtgtcccaatctgccggcacttagggaccgtccccaagtgccgacaagactgtccccttcgactagtcatttaagaacgtccccaacgactacttttcgtcagcaacgcaaacgccgatgccctggcaacgtcagcgagcggtcgccagagcgaacaaattggcatgaaaagagggcggcatagaccttctggtcatgccgccctctttgaatgacaagttgtcgctctggtgaccgcgcagcgtcgagccgttacgcggtttggtaaaaccgcgtaacccctacggacgctggcccatgccaccctcgagggtgacggtctcgccgttcatatacttaaagtcggggccgcaaagctgaacgaccacgcggccgatctccttctcgacgtcgccgtagtggcccgccggcggcatgtgaacgttggccttgaacgcctcgggataggcatcctggaagttctcgagcgcagcagtccaggcaagcgggcacacgatgttgacgttgatgccgtccttgccccactcgttggcggcgacgcgggtcaagccgcggatgccttccttggcggcggcgtagctgcactggccgtagttgccaaacaggccggcgcccgaagcaaagttgaccacggagcccttggtctccttcaggtgcggataggccttctgcatgtacaggtaggtggcatacaggccagagtaaatggccaggttaaactggtccatagtgtggtcggcgatggtcacgcccgaggcgctggcctgggcgttgttgacgacggcgtcgatgcggccgaactcctcaatcgccttgtcgataacgttctgtacgacggcctcgttgtcctgaccggcagaaacatcggcctgaacaggcagaaccttgacgccgtactcagcctcgagagactccttggcggcctcgagcttggcgacgttgcggccggtgatgacgaggttcgcgccctccttggcaaaagcgatatcgatgccgtagccgatggagccagcggagccgtccttgagcgtggccttgccgccgccggtgacgatcacggtcttaccagtgaaaagtcccatacgaagtcctttcaaaatcgcgacgggcacgcccgccgactgcgcgcatccaaaataaacgcgccaaaagctgaaatgcaactttagcttcttcaagtgaaaaataaagcccatggcgggcgaacggcgcaacgtctttcggcgaagggaatgtcaagtaaaaattggatagagcggccgagtttttgttaacgcgacgagtcatcgaacacgttttgaaactttgctgcggggcgcgggatgtcggcgcgagactttatcatagggtgacaaacaacgatgaggagcacatgcctatgacagacgagctggacccccagactcaacagcatattgatgattccgcagacaccattgacgactgcgatacttctaccagcagcgatggcagcattgatgccgccgtcgaggaggctcctgccgccgcaggcgaggccgcagacgcaaatgtcgccgcagagcaagacaaagaagagcagctagagcagccgaacccgagcgatactgagcccaaggccgagaacgctccgcaagtagcaggccccatcgaggtgtcttcggaagaagagctcgacgccgtcatggactccatgatggatgccgtcaaagcgatgaaggacgctgtcgccgatgccgatatcgacgccgaggaagaggaagcagccgaggccgcctcgacgtttgtgcccggcgagaccccggttgccgaccagggcagcaccatgccctcgttcctgcaactcgagcaccccacgatcggcgccgacgcggtcgacccgcacgcagcgggcttttccgtgatcgaaggcggcaccggcaatatcgccgcgccgcagactgccgatgcgaatgccgccaaggccgcacacccaaccacctcgcatgctcccgccacgagccgcgacctggggagcgccgtctcaaacaccgctaacgccgtgggcacttttatcgcccagggcgcgtcggccatgcgcgagatgaacgccgccaagaaggcactcgccgatgcccgcgcccatttagccgagcttgagcagcgcatcgccgaccaggcagaggagctcgagacgcgccaggacatcgcagaccgctacgatcagatcatcgccgatcaacgccaggcgattgccgcggcacaaaagaccgctgcggcagctgaaattaaccgtgatgcccgtgccgccaaagcgactgagctcaagggccagctcgagcaaatgaaggcagaagatgatgcgaccgagctccgcctgaaggctgcactcgacgccgtggaagcccgcgaggcgagctcgcgcgagaccggcaaccgcctcgttcgtcgccttgaggattccaagcgcatccgcgacaaagtgaaggctgagcgcgatgccggtgtcgccgccgcacgacaaactgccgatgctacgcgcgcgcagctcgagaccttgcgtcgcgagtatgccgagctgcagcgcaacccttcggcaaatcccgccaattacaccgtgcgcaccagcgagttgtctatgcaaatctccgacgctgccgacaccctccgcaaggccgaggaagatattccgcgcgtgaccgccgatcttgagcattcactcgccgccgccgagcaggccgtcgagcaggcacaggcccccatcgctgacgctaaacgagcgcaccaggccgtaacggctgaggcagatgccgcgcgcgacgagttgcagtccgcaaaaactgccgccgcgacgcgccagcgcgagctgcgcgaaaagatcgccacacaggacaaggcacgccgcgagcaagagcaggccatcgcaaacgcccgggcagatgccgcgcatgcgcagtcgattatcgagcaggcgaccgaggtgcacgaccatcccgagatcaccgaatcgctcgccgggtccttggcacgcgacaaggccgagtataccgagaccgagcgcgaagttgcccaactcgaggccgccgaagacgacgtacgcaagcgaacccgcgactcacgcgtcaaattcaccggagccatcgcctgcattgtcgccgtaatcctcgtgatcgtcctgatctggctgttcgcgagcaagtaaaccagctgccaaaaaacactcaacgcagttgcggtgagatagttcctgtttagcctcaaaaaaggccaattcaagaactatctcaccgcaacttattagattgatgcaaggtagtcattgaggacgttcttaaacgaccagtcgaacaagaacgtccccaacgaccacatcgacaaccaaagaaatgccgatgttatggcagagtcagacactatgacccaatccaggggcacggaaacgacaggagcccccgctcgtgaccgcgggtcggggctgcgacaatgttgttgaagtgccagaggcgcagccgcgccgcaacgaggttgggaggctcccgtgcctagatattctaccgccttcggaatggacgtacacctcaggtccaccaccgtctgcgcgctcgacgcggagacgggcgaggccgtgacgaggaggttccgcggcaacccctggggcgaggtcgcggagtggatgtcgggcttccccggcccgtcgctcgccgcctacgagagcggctacctcggcttcgccccgcagagggagctctccgggctcggcgtcgactgcgtcgtcgcggccgtctccagggtcccgaggtcggcggcagacctctcgtccaagaacgaccgcaacgacgcggccaggatggccaaggcgatactgtcgcacgatatctccccggtatgggtgccgtcccccgagatcgaggggctcagggacctcgtcagggaggcggggctgtccctcccggaatcgtccaaataggtgttgccaatccatgccgaagaccacgaggttcgagagcgtgcagagcgcgaggcaccagagcgccttggcccaccaggcgcgcccgagcgggaagcccaggcctagaagcccccgcatccgcgtgcgcgcgtccgcccgcgcgacgcacgccaccacgagcgagagagccacgggcaggaagagcgcgtaccagtagttccacgcgctgaagatctgcacgccccggtagggcatcgcgccgagcagcggcatcggcagcgccatgagcacggccaggcgaaccggtgccgcgtggcgcgacttcagggcctcagcgcgcaggcccgcgagcaggccgcctttctcgcccgtcatgccgccacctccccgcgcgctcgtcgcccctcccggcagacgctcatgaagagttcctcgaggtcctgcccgggtcgaagcgcatcctcgtaggcgaggcgccccccgtagatgatgccgatggtgtccgccatctgctgcacctcggagaggatatggctcgagacgatcaccgtcgtgcccgccgccgcgaagccgcggatctggtcgcgcagctcctcgatgccgatggggtcgaggccgttggtgggctcgtcgagcacgagcaggcgtggccgggcgatcagcgccagcgcgagccccaggcgctgccgcatgcccatcgagaagcgcccggcgcgcttcttcccagtgtccgcgaggtccacggcggcgagcacctcatctatgcggctctcgggaaggcccagcagcgtggtgcgcacgcgcaggttctcgcgcgcggtgaggttggggtagagcggcgcctcctcgatgaggctgccgattgcgtagaggtcctcgcggcgccaggcgtgcccggcaaagaggatctccccggccgtcggccgcagcattccgcagatcatcttgagcgttgtcgacttgccggctccgttgggaccgagcagcccgtacacctcgccctcgcggatatgaaggctcacgtcggccacggcgtcctgcgcctggtcgccgcggccgaagcgcttggtgagcccacgtgtctcgagcatgtaacccatgggtttatcctttctcttccgggcgcgcgggccgagccaccgtgcccgcgcgccttacctttcgggttcaccatccatgatggggcgcgtttctaacgaagccgtaacggccgttgggctcttttggcgccagcccttctcgacccgtacgccactcatggtatgtttatcgcgataacaaggacggaggtgcccgtggcacgcaataagtacctggaggagacggtcgagaagattctcgacgttgccgagcggctcttcgtggagcgcggctacgagcacaccacgatgatctgaagagcaatacgctaaatcgaaaaaggcaatcgaagccgcgcctgtggacttatcgagggtcgagattcccgccccatccatcggcacccagcagaaggtcgtcgacatcctcgaccgcttcggcaccctaacgaaatcgctcaccgacggtaggataaacccccatgaatatatgaattgacctgctgactccaatgaagattggagggtaactgccaggggtgacggcccggcgagtgttattttgcgagctatgcgcattgaaagcgacctttcgtggtataaactacttgccggaagccgcggctttcagggtacggcttacgtgtacgtttaacctccgtgggcgacggggtgccgcaaggcgtagaatatcgcccacctgtaggggcctgcagcgatgcgggccccgcttcgtatgagggggcgtaaccgatgaagatcgtatccatctcccaggacttcttcgacctcgtcgatggcgaccgtgagctcatgcttaagcgcgaccgcccctgcatcgcggtggcgaggctgcgtttccgaggaaagcgcaggaacttcgccgtgccgctgcgctccaacatcgccccaatgtgctcaaagaccagtacttcgcgctgccgccccgccccgcgacgcgccccggctgccgccacggcatccaccacatcaagatgttccccataaccaaggcctaccagcgccgcttcaggaccgagggctcggcttactacgagacactccagcgcatcatcgatggcaacaccaagcgcattgtctccgaatgccaggcgtacctcgaccgctacgagcgcgagggaaggcctcgctttgccgtcggcatcgaccgcatcgtggggctgctggagggcgagaagtagggcacctcggctcagtctcgagccatgcggagtcgctccgcatttttgaacgccgcgtgtgcgtcccaaatacttgagaagcaaactgcgaagtgcagtggcgcgcccgtgcccgtgcatagtcgtcaccatcggcgtctacgcggcgtcggcttcaagtggaactggcgccgctgctgtatatggtttgccttgctgcaaatggcgatcaatgcccgcgatgcttctgtttgcgcttcagctctcgctgctcgaagcgcgcctccgcctcatccgcgcgacgctggcttcttgcttgggccgactcccgcttcatcgcttcccgctgtgccgcgagcgcctgttgtgccttggtgctcaccgcgggccgtttaagggctttcgctacctcgcgagcgcgccgcttggggttcttcgcgggcttgcttgtttcagtggccttgtcgccgaagaacgagagcttctcccattcgcttgtaacgaatcgcaggatctcctcatcggacggctccgcgccgaagacgatgcgggcgacgccgtactttccgccctcgacgtgctccgccagcccgacccagaattgaccgtcgtgatatacggtcagggtggacgacacgctgatctgcatggctggttcctcctttatgtagatgaccatgcagagaagggacaaccaaggaggcaggttactgatgcggactcccgcacgcccacgactacccgacggggactgtgttttcatctctgatgcccgcattgtagcacgcgcggatgcgcccttcatcgctgccgacatgacgtggctgggattcgttcctcgacacatccttttgtatattgccttcccggtttcgaaactttaaatcaattcgagtttcgaaaccgggaaggagagcgtatgtgagaggcgatatgagcatcaacttgatgcttgagggggagctcgcgtcgcttctgcccatcggggacgtgttcccgaaggtcctcatctcccgcatagggcatgagacctgtacccgggaaggcgtactcgtgctggacctcgcgcggtgctgctcggtgagcaggggttctgaacactgcgtagggatatagcgcgacagggggtgcagcaccgtttgcgccttgtctagagagcacgaacgagagatgtggtctgcggacgactgaatagcttcatctgttttggttacaacgaaatgtgtgccgcgcgcctgcggcatgaaggagggagatttctatgaatatcgttgtattgagtggtagcccgcgcaagggtgccaataccgacaccatggtcgaggcctttgccgagaccgcgcgcgaggccggccatacggtcgaggtcatccgcgttgccggcaaaaagattgctggttgtctgggatgccagtactgctttacccatgagggcacctgtgtgcagaaggatgacatggccgacgtgatcgagccgctgaaagacgcagacatggtcgtctttgcctcgcctatctactggttcgatatcaccgcgcaggagaaggccgccatcgaccgcctgtacgccttcggtgctacgggcttcccgttcaccaagacggcccttttgctcgatagccatagcgagggcgtctatgatgcggcgatcgctatgtataagtcaacctgcgcgtactgcaagtgggaggatcagggcattgtcaccatcagcggtatgaccgagcgcgacagcatggtatcgtcgcccaagttgaaagaggtgcgagagctcgctcgcaagctcgcctaaggacaagaggggcgcatggcaatcagcactagcggaaatgcttgctgcccttaccaggaggaatgctgattgccatgcaacgatgctcccgcggacaattccggtgtgctaaaacgccttctcgttcaagaattctctgaacgcggggatgtcgaagccgacgaggccacgcccacgttccccgataacgccgtcctcgaggaggcggcgtttgtattggcttgcgtagttgctggcgacgcccatgcgtttggctatctccgagatcctgctggggccagaatcgggcagcatcgcgagcaaaaactcaatgtctttatcggaaagctctcgataggtcgtttcgagagaagcccgatgccatgcttctcgagttgcctgaagatgccattcatgcacgtgcgccagttgccctgggcttcttgaacatatgtccaatcgatgcccactggaccaatttgaacgccgttcatgcgcgcgtgagactgtgaaaggtagctatctgccgcttctttggttcgctcgataatatcttcgagcatgcctggcatggcggagccatttgctgtactccatggtggctcctttgcaagttttgctaatttttgcaacttttgctaacttttgcgagttttgctaacggcttaggacggtgcgggaagcccccgtatcgtcgacatttccgaggatgacctccgcaacgagcggggcccggggcgcgatattgctgcgctccgggccccgctgctttgtaaaactatggcggttctgccgtcgtcctagtcaaacagactcggcatgtcgttttctttcatgagggcaccggcggagggcagactctgcgcggtgaacttctcggccgagacgccggcgccaaggatctcttcggttgtgccgaccgtggtgaccgagcggcccttcttggccgtaagggcctggacgccctgcgtgttggtggtcgtcttggtcttgagcagcgacgtgttgaagttcatcaggcgatagtcgctcgagaccagcgcgatgtcgcgatcctccttgagcacctgggcatacagcagcttgctgccaccgtagatggcgttcttgaggcgcttgcggttggttttggtgacgtatccggcaagtgcgacacgcaccacgcggccgttttcaaagacaaacagcacgtcggccttgtagtcctcggggtcgatgacccagatgacgctctcgtcgggttccatctcaagatcggtcggcaggtacgagcccagctgggccgacttggtgtcctcaaacgccgcaaccttgcacttgtacacctggctcttgttggtaaacacgagcagctcgtgcgtgttggaggacggaaactcgataaagggtttgtcgccgtccttgtacttgagcgtggtcgccttcttgagcacgcggtctgtcatcttcttaaggtagccatcgcgcgagagcatgatggtgaccgggtactcctcgacctcgggctccaagcttacttcgataacctcatggggctcaatcctgcccgtgcggcgcggcatcacgtacttcttgttgactgcggccagctcgtcgctgatgaccttcttgatgttctcctcgctggagaggatctcctcaagctcggcaatctcaccctctagcttggcgatgtccttggtgcggttgaggatgtactcttcgttaatgttgcggagcttgagctcggcaacaaactcggcctgggtctcgtcgatgtcgaaacccttcataaggttgggcacgacctcggcttcaagcttggtgccgcggatgatggcgatggccttgtcgatgtcgagcaagatcgcctcgaggccgtgcagcaggtgcaggcgctcggactttttgcccaggtcatagttaatgcggcgacgtgtggactcaatacgccacttgacccactcgtgcaggatctggcgcacgcccataacacggggatagccatcgacgagcacgttgaagttgcacgagaacgaatcctgtagcgtggtcgagcgatagagcttggccatgagcttgtcggggtcgacgccgcgcttaaggtcgatggcgatgcgcagacccgaaaggtctgtctcgtcgcggatgtcggcgatctccttgaccttgccttccttggagagcttgacgatgcgttcgatgatgacatcggtcttggtggtgtaggggatctcgtagacctcgatgatgcgctcttcgggaatccaacgccagcgggagcggatctggaagctgcccaggccggtctcaataatcttctccatctcctcgcggcggtagatgatctcgccgccggtcgagaagtcgggcatgggcatgtactcgagcaggtcgcagtcgggatcctgcaggtagtgcatcgtggcggtgcagacctcgttgaggttgaagccgcagatgtcggacgccatggcgacgccgatgcccttgttggccgagacaaggatgttggggaacgtggtgggcagcaggcgcggctccttcatggcaccgtcgtagctgtcgacgaagtcgaccgggtccttgtcgatgtccttgaagatctcggcgctgatgggggagagcttggcctcggtataacgcgaggcggcgtagctcaggtcgcccgaatagtacttgccaaagttgcccttcgactctacgaagggggcaagaagcgcctcgttgccggtggccagacgcaccatcgtctcgtagatcgcggcgtcgccgtgcgggttgagcttcatggtctggcccacgatgttggcgctcttctggcgctcgcccttgagcagacccatcttgtacatggtgtagagcagcttgcggtgcgagggcttaaagccgtcgatctcggggaacgcacgcgagacgttgacgctcatggcgtagggcatgtagttgacctcgagcgtctgcgtgatcggctggtcggtgacctcggagtgcaggccgatgacgttctcggcgttgacctgctttttctttggctggttcttcgtcttcttctttgccacgatatcctcttgaacttcttatgggccgtcgttatcgatttgctgttactgcaggtccagctggtccaggtattccttgccgtgctcggagatatggcgcttgcggcctgcctcgtcgttgcccagcaacagattgaacatggtctccatcttggtgacgtcctcgggctccaccttgatcaggcgacgcgtctcggggttcatggtggtgagccacatcatgtccgggtcgttctcaccaagacccttggagcggttgatggagcacttttggtcgccaatctccttgaggatgccgttcttctcgagctcggtgtaggcaaagtaggtcttctctttgcagttgatctcgtagagcggcgattcggcgatatacacgtaaccctcgtcgataagcgtgggcaccaggcggtagagcatggtgagcacgagcgtacggatgtgataaccgtcgacgtcggcgtccgtacagatgatgaccttgttccagttgaggttgtccaggtcaaaggcaccaaggtttttgatgcgcttgtccttgatctccacgccgcagcccagcacgcgcatgaggtccatgatgatgtcggacttaaagatgcgcggatagtcttccttcaggcagttgaggatcttaccgcggacgggcataacgccttggaactcggcgtcgcgcgaggtgcgaatggcgcctgctgccgagtcgccctctacgatgtagatctcgcggcggctcttgtccttggagcggcagtcgatgaacttctgcacgcggttggccatgtcggtcttctgctgtaggttggtcttgatgctctgacgcgtcttctcggcgttctcgcgcgaacgcttgttgatgagcacctgctccatgatcttgttggcagcgtctttgttctcgattaggtaggttgagagccgctccttaaagaaggccgtcatagcctgctggataaagcggttgttgatggccttcttagtctggttttcataggacgtctgggtggagaagcagttggtcaccagcaccagacagtcctggacgtcctgccacttaatgccgctctcgtttttgttgtacttgccctgttgcttaatgtaagcatcgatggcactggtcagagcgctgcgggcggccttctcgggcgagccgccattctcgagccacgatgagttgtggtagtactcctgcatcatgatggtgcgcgagaagcacatgcacgcggtgatctttacattgtagtcgggcaggtcctcgcgatcgcgaccgcgacggtcggcctcgataaagaagggctcggtgaggtagtcggtaccgaccttctcgagcacgtagtcttcgatgcccttgggatagcaaaagtcctcttcggaaaactcgccatcgtcgccctcaatgcgcaggcggaaggtcacgttggcgttgaccacggcctggcggcgcatggtctcgcgataccaatcgtgggggatgctgatggaggtaaagacctcaagatcggggcgccatttgatggtggtgccggtacggtcctcgtcgctgggctcaatctcgagtgccttctttttggcgccaacgaccttgccctttttaaagtgcagggagtacttgttgccgtcgcgccaaaccgtgacgtccatgtattcggaggcgtactgggtcgcgcacgagcccaggccgttggtaccgagcgagaagtcgtagtcgccgccctggttgttgttgtatttgccacctgcgtagagctcgcaaaagacgagctcccagttaaagcgcttctcggaggggttccagtcgagcgggcagccgcggccgttgtcctctacctgaatggaaccatcgcgaaaggcggtaagggtgatgagcttgccgtagccctggcgcgcctcgtcaacggcgttggacaggatctcgaaggcggcatgcgcgcagccgtcgagtccgtccgagccaaagatgacggcggggcgcaggcgtacgcgctcctcgtccttgagctgacgaatactgtcgttaccatagtttgcggtgttttttgccatgctcgctctcttggtacttcctcttgtgtatttaagtcgtatagatagtcaaggtagcatagcccagcccgtgggcgattccaaccaacacgaaatccatcgaacaatcgttcggattaacagggatagtgtttagtggtagcgcggcattgttaaacaaatttggatacagatgaattttatttaatagggatctagttttactaaacaaaatcgaacgatgctgatcgcacgagcgggcacatcgatcgactatcaatcacgtttactcggacaaaaccgagtcggttctgtccgagtaagtttgaatagtgaaccgaagttgtaatgtccgcatggcgatgacagacatggttttcataatgacagatatagttgacatcctttgatggatgcaatatatttctgtcatgttgcaacggatatctgtccattactacgaaaggaactccatgccgggcaaaaggaacctacgcatgaaggcggcgcgcgcggcggttggcctttcgcaagctgacttggccgaggccgtgggcgttacgcgccagaccatcggccttatcgaggcgggcggctacaaccccacgctcaacttgtgtgtggcaatctgtaaagcgctgcgcgttacgttgaacgatctgttttgggaagacgggatcgacgtcgaccctaacgctctttagaagttcgctatgaaatttgaagatttaaaactcgtgcaaaagtggcgtgaatatgccggcccaaaggatgagcgcctggaggctgagagcgcgaaggtctacaagattggtttcgtgctgctttcgtttggcatgttgatgatctttttctaccagtttatagctcgacaggttgcgtgggttcacagcgacgccagtgaaatgccgcatggctttgcagcgccgtttgaggcagccatgtatttgtggctcgttctcgtgatgttgatttgcgcaggactgcaaacgcggaagggctatgtcgataccaatcgttttgggcaaaccgagtatcttcctgttggatatttcctgcttctcagcggtcttagcggcgccgcgttcgcgcttgttattgccgcaatgcgctgtatcgctgaggcgcagatcgtaccgctcgaaagcgtcttttggttggcgaacctggccacgggcgtgttctgcggcgcgacgattttcgcggccacgtttgctgtcctgtgcgcaacgtttttcacggcgaaaagacgccgtgccaagctcgaggcagaactcaactcctctgacgacatctaatgcgtaatgggctggctctgggtatccagaaccagcccatttgatgttcgatgagccgagtcggcgtctctcacaaaagtaactaggagctagcgaggcttatcagaattgacctcatcggcggtgtctttttcgagcgccgtgcggcgggcgctgtaggcgatgaggccggcgcctgccgcggcgagtgctgcagcggctgccgtaaggggagcattgacatcgcccgtgccagcgagcgcgcccgcttttccggagcgcttgttagtgccgtggtccttgccactgctggagctgcttccgccggagccgccgcccttgtcagtaccgccgccactcgtgccgccatcgccgtcgaccgtcatcggggcgtcgtgaagttccgtcgtatccgcgttgtcgcatacgccgacctgaacttctgagcgttcgcatgccgcgtcgggcacatgaagctcgtgcagcacggcacccagcgccgagtttgcgcccggtcgaatttcctcgagcgttacgggatcgagcgccaccagattacgcgccttcgcatatagcgttacacgtttgcccacttcatcgctccaactctcggggatggcgaagctcatgcggaactgtgccgtgcaacccggtgccagcacggcgttgccactgtcggctaccagcgggtgcgttgcaaaaggtgtgcccagcgtctcgagcgcgtacttcacgtgtgccgtgtcgttggccgaagcgtcctcggcaagctctggatcgtagatcgatgccatgcgtgtgttcgctccgaacccgatggatgcgctggagaacggctggctggagccctctcggtacagatcgattgtgccggcggtcagcaaggtgttgccgtcgtttcgcaccgtgaccatgaaggattcgcctgctgctccgggcaccaccgcgcccgaggtagcgactgcgcccgtcggagtggcacacgccaccaagggcacttcgatgccgtgtagttctgcctcgctcttctccgcgctcacaatgtgcgtggcgagcgcggagagcatgctccccgacgtcaaaaatgtcgttatctgatcgacgggatggtccagctcgcacatcacgaacggctccgtaaacagatcgcctgccaaggtgctggcgaagatgcggaagtgcttgcccatcactgctaccgggttgccttcttcgtcgtaggtttgccccaccttgccatcggtgttctctacatagagcacgcacctgccgttgttgcttacgctaaacgatgccgggccacagcctgcggcacccacgggctgcgttgcaaatgccgatgcgcctcgcgtccaagtaatatgctgcagttgctcgttgacggtagccaaaaagcccgtgtgctgcggccacggcaccgcgtggggtactgtggcatctggcgacataacgccccagctcgcaatggactggccgatcacggcgtacgatgcacagccacaaccgcctgcggtctcgtatgcaatgggcaccaccattttgccgttgatattctcgggcgcgccgagctcgatgctcgacggtgcctgcggaaagcggaggacctgacggaacgtgagactgtcgcccgaaacgtccgaccacagggtaaagcactccagcgcaacctcggcctcgctgccgagcgtcttttctgcggtggttccgcggcggtggaggtaggcgcccgacaggcgcccgtcgacaagtgtcttgcccaccgtgatgcgtgggcactgcaggcaatggtagccatcctcctgaaggcggccgcgcgagatgctgcgccacgacgtgtgcgatatcacgcgaactccgtcgttgcttatgcgcaggcgcacaacggacagtatgccggatgtgctcgccgtatcgaaaagggtgttgtcgccggcggggcgctcgcccgagaccagcagcacgtaggcgtcctggtttcctcttccgtccgtatattccactacgtcgaagtcgtaatcgtatatgctgtcgcgctccacgtcgccctcgccaaacccaaggggaaagtccacaggcgtgggagcggaccacgtcccgtttgcctttgtgtgtaccaccaggcgcgagcgaccattgtcgccgtagcgcaccgaggcgatacggaacaggcattctacgccggcaatcattgccagcttcatgtgggcttcgctgagcacgccagcaaacagcacgttgtcgctcgagggcttgatgccgccacgctcgtcctccgacacgccggcagaatcggcgttcgggtcggcaacggtgttcgttgcctgaccgatgtaggtgtactcatacatcggcgcggcgttttcgtcgttctctatcagtgcatggacgaaatgctcgatctgtcccgtgtcgtcgctttctgcatccgcctcgagctcaatgcgcgtgaccgcccgatcccaatcgcgcacgacaggcgcggcgtttacggcagtggccttaacctcggcgcgtgcgagcagctcggcgttggtgacgatggtggccgatgcgataaattgcggaacgccgcccgcctcgatgttgccgggcgtgccgaagcgggcgtccagcgtgtaaggcgtatctccacccaatgcgagctcagagcgctggagcgcatactggtcgccattgttcaccgacatattccacgaatcgatgagtgtgggccacgaccccgaccaagccttggtggtccacttgaacattacgaactggagtatcacatcgacatcgacgtctgcacctacgcgcagtcgcggaagctggtgtccatccgccttctcgtacccaatgaacagcgtgagggatgcggcgccgctcacggcagacgaagcgacgcctgcaacgccggcgccaaaggtgacggcgagcccgatctggatggtgaacgagcccgacgtgtttgaatagtcgagcgaaatgtttttaaaaaacgccgcgccgctgccgtgcgtgtgggcacccacggcgagcgccagttttgccagcacccaggggttgacgtttaggaaaaatggcaccggtcctagggtaaactgctcggtccaattgaggtcggttcttacctggaagagggccttaatattgccgtatgcggggtcgttgttgttaccccaggttttgcccacccaatcgtaggcgagcgagccgtacagctgtgtggcgatatccatcgtgaacagcggcgtgcaatggtggcgaaggagcttggtgtttcttggatcggtgcccgaaccggcactcatcctcttgtactgattccacttcccctccatctcgtcgaggtagcggtttgcctgcttggcgcccgactcgcgcggcgatttcttccagtattccggatcagggttgcccgaatcgttcatatagctagctggtttgtaccctccgccaaacagcacgtatccagcaaacgagaaatcgaacagaatgggaaatgtgggcatccagcacgtgaacttattgccgccgataccgggaaacgccgcggggaaatcaaacggagtgatctcttggtccatggtggtgggaatgatggtggtcgagcccgattccgcctttgcggccggcgcggtgacaacggccataggggatgagagcgtgtaggttttgccctggtagtcgagcataaagcgcagcttgcacccttcctccagaaggcccgaagctgcatcgaggaacgtgtcttcgagcgtgaacgtcgccagattatccgcgcccgatgcgctggccttgatctggccgatctgcgtgacggtttcggttgagctgcccgcagagggcatcactttattgatatgcaacgttgcctgcccgccctgcggcagatgagcctgcacggtaaaagcgtgcgtgtcgggctggtcgtttgctgcttcgtccgctggcattgccataaacgtggcgtcggcgtactggatgtcccattcgtcgaacgtgagctgtcgaaagtacggctcgccatcggagagcggacgtgtgggtgcggtaatagcggtgccgccctggatacgcgcaaggggaatctcgacatcgcggtagcctgccatgctaatggagatgccgccgttaaagtcgtacgcgtcgagaagcgttgcctcgtccacgtagccttctgaaagaggggcgacctcaaagatggccgtgccttcgtcatcggtcgtggcggtgagctgcttgcctgcggcatagcgcgatatgagcgtgacctgggcacccgtgatgggcgtattcttgttggcgacgtcgaccacgaccacaccgaacatggtgcgcgagagaacgagcaccctgaaggggtctttttcgtcggcatgggcttcggtgggtgcgaacggcaatatgaaggcgtttgcgcttcccggcacgcgcggcatcataatgctcgctaacgaggacgctccggcgacaagtaacgaacggcgatcaagcatcttgggctcccatcccgcaagtatcggtggaaataatccaattttgcgagaaggcgccccgtggcggtagtgccgttcaagggtcaaaatgtccaaattgatcgagcgaagcgccgggttccggaacgcgttcgatgcgcttggtagtccggtcgctaacgtaacatatgcgcgaccagctcggcgcgtgtgccgatgccaagctttgcgtatacgccggataggcggtttttgacggtgcccggcgatactcccatatggcgtgcgatttcggcgttggtccacccacgacaggcgagcatggccatggtgaattccgtggtcgttagatcgtcggcaacgtcctcgcccgaatcggggttgtggatgcgccgccagccgtagctgaagcggtacgtgatctcgatgatgcgcgcgaagtcgtcagggtattgcgtttttaggcatgcctcgataagcccctgtaaaaggccgtgatgctcgccaatgagctcaataaggccgtcgggacgcgcaatgttccaagcaactccgaagtgcgtttttgcggcgtcgatgtccttgaggctcatgcatgccatggaagctgccaagtgcaggaacagctccgagatgggataacttccctgtttcatgatcagggcgttttccgccatgcccaggctgcggccatattcgccgcgcaggtacagggcatgcgccatcacgtagctggcgaacaggcgcagaccttcgggcagatgcgccgcaagcggataaaactcttcggcggaatacggggaaggcaagtgcagcaggacgctcgcggccgaggcgaacaggatatgcgtggcgtggacggcgggcgactcctcgtcagccggcgtatcgaggatgcccgcaaggcaccggcgggcgtcggcgatacggttgagcgacaggctggcgtatccgcagataaagcatgcggaatagcacagcgcgggatcggtggcgtcaagataggggcgcgccgtcttggcagcgagggcggcctgtccgcgaaagtacagcgcttctgccgtggcgatggtgcgtgaatcggggtcggaaatgcctgcaaccgcagcgtcaatctgccccggcacaaaggcggtgcacatcaacggcatgggaacgcatgggtagccatcgcagtccatcttccatctcccaacagctggcaacaatgcagcaattgtactcctgttgctcgggacccctttcgttttactgttcggttaacgctgcggatcgttttggaaggcttacgagtatggtagtaccgttctcggaactttcttcgacctctaccgtgccaccgtgaagcgctgcaatctcccaaacgagcgctagtccgagtcctgcgccgccgtatgccctactgcgggatttgtctagacgaaagaacggctggaagatgctctcacggtactgcttgggtattcccgggccctggtcctcgactcgcaggaacacatggctgtcgttgtcgcagatggagacgttgacagtcgagccggtgcggctgtaacggatggcattttcgaccaggttaaacaccagcctatagaggagcgtgtcgctcccgattactaaagcgtctccagcacaattgagggctatgcccttattttcggcaagtggcgcaaggtcggtgaggacctcttcggacaaaggaccaagttccacatcgtcctcgcaagggacgctgcggagctcactcatctcgagcaataccttggccattcgagacatgcgctcggtttgttcttgtagcaggccgagcagctcggctgtttcgggttgcaaaccggagtgctcggagatgaatagttcaatctgtgcttgcataagggcgagcggggtgcgcagctcgtgtgcggcgttgccggtaaactgacgctgtgcagagaacccttcgccaagacgggcgatcatgtcgttgaaagaggcgctgcatcgttgtagctcggtgggcacatcttcactgagtctgatttcgcttaggttgtcaggctgcacgcgctcaacctgggctgcaaaagcccgtagcggtttgagtgcacggccgctcacaaagtatgccagcacgccgccaaggagtgtgactccagccgtgatgtaccaagctgtcgtgccaaaagattcctgtgcgtcgtttacgacgatcgtgaccttgtcatcgggggtcgctttcgttgggtcgaacacctggggcgaatccgcgccggcagcgttaaaggccgagatgtcactgccgatggcatccatatagcgcatgcccgtatagccgaccaggcagttcgtcagcacgcacgccgcacacgtcagcagcgccgtcatgatcgttatgcgccattgcagcgaaagccttttcattcgctatcctccataacgtagccctctccaatccgattgcgaatcgggtcgtatcccaaagcgctgcgcaacttttttcggagcgacgagatgtgaacgcgggttgcgttgctaaagctgttcacggtgctatcccaaacgtgctcgataagctcctcttggcttaccggtcgcccctgattaagtatcaggtattccaagattcccgtttccttgcgtgtaagagataaggcctcgctgcccacggaagcgatgcgcgccttggtgtcaaagctgagttttccgcaggttaatactatgtcgctttgtgcgaagcgcctgagggtaaggctgcggatccttgccgcaagttcgtccagatgaaacggcttggtgaggtaatcgttggcgccggcatcgagtccgtcgaccttatcggatacttcgccacgcgcggacagaatcagcaccttggtctcgcagtcggttttcctaagttccctgagtacggtcatgccgtcgatacggggaaggttgaggtcgagtaccacgaggtcaaagacttcgacgcccagcaggtcgagcgcctcccgtccgtcgtgacagcagtcgacgctgtatgccaggtttcgcaagctgcgcgcgattgcgtcacacagcgcccgctcgtcctcgacgatcaaaatacgcataacagtctccttgcacatttcaaatcgcgcctaacacggattttatagtcgatatggtccaatggtcgcgtaacgaaaggagtggtcgagttgttcaaagcggtaaaacccatggtacaggtcgctttgttgatcgtcggaattgccatggtgtgctttggtgttatgcgtggcgaggcggatgccgtgctggccaaagcgattaggctgtgcttggagtgtatcggaattggataaaagagcaaacaccgcgtcgcatgttttggcccgatttcgcggactcattcaggcggcggcgacgctggtcaccaacattcacctgccaaactttgccaaaggcggcatctatcagggcgcggggaaaacagtctgcgtacctggacttaattgctattcgtgccccgcggcatcgggcgcgtgccccatcgggtcgttccagtcggtggtaggttcatccaagttcaacttttcttactatgttaccggtacgctcattttgctcggcgtgctgctgggacgctttgtatgtggctttctgtgtccgtttggctggcttcaggagctgcttcataagattcccggcaaaaagttctccacaaaaaagcttaagccgctcacgtacatcaagtacgtcgtgctgctgtttgccgtggtgctgctgcccgtcttggtggttaacgacgtgggcatgggcgacccgttcttttgtaagtacatctgtccgcagggcgtgctcgagggcgccattccgctggccattgccaacgccggcattcgatctgcgctggggcagctctttacctggaaacttgccgttctcattgccgtagtagtgctgagcgttttgttctatcgccccttctgcaaatggatttgcccgctcggcgcattctatgcgctcatgaatagggtgtccttgttggggattcaggttgacgcgtgcaaatgcgtctcgtgcggcaagtgttcaagggtttgtcagatggacgttgatgtggtccgcgcgcccaatcatgccgaatgtatccggtgcggaaagtgcatcggggcctgtcctgtcgatgccatcagctatcgctatggcctggatgtgtcggcggaaaagcttcccttgaccgccgataaaaagtaaacaagcttcgacaaaacggaggaatgatcatgaagctttctaagattgcggccctgtttatggtgccggtattggccttgtgccttgtggcatgttcggcgtccggtggcaatgcgagcgaatctgcgagctccgatcctaagatcgcagaactcactgcgcagaagccgaccaatgccgacgaggccgccgagctgtatgcgaagctcatgaaaaaggagaacgatatcctttcgagtgataacgcgccgtgggaaaaggtattcaatgcggcaaataaagactcggtaatgattgaggacggcagcaattacggcgatttcctgctcaagaccatcgacggtgccaaggatgagttcacggcggatgagcttaagacgctcaaggccggtgcgcagcagatcaaggagatcgaggacaagctcgagagcctggagaaggagttccccggctgtggaagcacgccgagctcaggcgagagcgtcgacgcttcgaccgctggcatgacggctggtgccaatacttcgagcgaggcgacgaagttccccagctttacgggcaaagacctggatggcaacgacgtgagcagcgacgagctgttcgctaagaacaaggtcaccgtcatgaacttctggttcaccacttgcaagccgtgcgtgggcgagctgggcgatcttgagaaactgaataaggagcttgccaagaagggcggccaggtcgtgggcgtcaattcctttacgctcgatggcaacaagggcgagattgcggatgccaaggacgtgctgagcaagaagggcgtgacatataagaacatctggttcaagtcggatagcgaggccggtaagtttacgtcaaatttgttctcgttcccgacaacgtatgtcatcgatcagaatggcaacatcgtaggggatccaatcgtgggagccatcagctccgccgagcagcgcgcagcactcgacaagcttatcgaccaggcgattgcgaatagcgagcagtaaaaaccgcgtaaagcatagcgaggatcgtgtgtcgctgtgcgaagtagtctgctgcctttcaagataagctccaccatatagaggtcccgctcgggacctcttcttttgggcgccgtcccgttcgttttttggcgcggtttgttacattcctcactggcgtcggcaaaaaatggggatagagtaggacaaaagcgtcgaatacgaacggcggaggagagcgggcagggtgcctgcgcaggagaggttgccgtccatgctggagctcaaaggtatttgcaaaaggtacgttacgcagtcgtttacgcaggtagcgctcgacagcgtgagcctgtcttttcgcgataacgagttcgtggccattctgggaccttcggggtcgggcaaaactacgatgctcaacgttatcggtgggctcgatcatttcgattctggcgacctgctgatcgacggtatttcgaccaaagactttcacgatcgcgattgggatgcctaccgcaacaaccgcatcggctttgtgttccaaagctataacctcattccgcatcagaccattttggaaaacgtggagctggcgctcacgctcacgggcgtggggcatgccgagcgtcgccagcgtgcgcgcgaggcgttggagaaagtcggcttgggcgagcacgttaacaagcgcccgagccagctatcgggcgggcagatgcagcgcgtggccattgcccgcgccctgatcaatgaccctgagatcgtccttgccgacgagccgactggcgctttggattcaacgacatccgtgcaggttatggatttgctcaaagaagttgcgcgcgaccgtctggtcatcatggtcacgcacaatcccgacctggcataccaatacgccacgcgcatcgtcaacctggcggacggcaagatcaccgatgattccgatcctttcgatgtcgctgacgccacgcgccgcgaggccaagcctacgcgcaaaacctcgatgagctttgtgacggcgctggggctttctgcccgaaacctcatgaccaagaagggccgcacggccatgacggcctttgcgggctcgattggcattatcggtatcgcggcgattctggcgctgtccaacggcgtaaacggctacatcaaaaaggtcgaggaggatacgctctcgagctacccgctcaccatttccaagcaggattacgacctgtcgtccatgatgggcggacagggggctgcggatgatgactcgcctgaaaacgtggattcgtccgacgacagtgccgaaaccgataagattcccgtggtcacggccgtaaaggatatgtttgcgagcgttaagtccaacgacatgacgagctttaaggcatggcttgacgacggcggcgacggtatcgacaaagaggtcaacgccattcagtacggctacggtgtatcgccggttgtctatcgtgccggcaagggcgatgagaagcccgttcggcttgttcccaacgcaatgaccgaggctatgagcggaggcgcgagttcggcggcaacggtgagcatggaatccatgggaacctcggtctttaacgagatgattgacgaccagagcctgctcgacagccagtacgatgtcgtcgccggtcattggcccacgtctgccaacgaagccgtgatggtgctttcgagccgcggtacggtgggcgactatacgctctacagcatcggtgcgctggatatcgatgagctcaacgatctggtaaacagtgccatgacggccgacggtggggtcaaagcacccgagaccggcaccgactttacctacgacgatgcgctgtccacgacgtttaaggtgctgtcgccggccgatgcctatcgcaaaaacgaagagaccggcatgtggaccgacatgtctggtgacgccgactttatggccgccaaggttgccgatggcatcgacgtacacatcgtgggtgtggtgcgccctaacgagacggccaatgcgagtgcgttgtctccgggcattgcctatacacatgcgctgactcgccagcttatggagcgcgccgccgattcgcagattgtgcgggagcaactcgcccaccccgagacggatgtctttacgggcaaaaccttcgacgaactgcaaggcgaggccaaacaaggcgtggatctgggcagcatgttcagtgtggacgaggcggcgctcaagagcgcgttctcgttcgatacctccgtgctctcgggtgttgccggcggtatggacccgtcgtgtcttgacttgtccgagctggacattgacctttcgggcgtagggaaggatatcgacttcagcgacatcatgtctaaggcgccagcccccgatttctcgggtgtcttcgatgggttggagcttacacccgagcagatgcagcaagtgggggcgctcgccaaccaactgttcacgggctttatgcagtcggaacagtttaaggcgctgacgcccgaagatcttaaggacgcgtcaaagcttgccgccgcgttctcgacgtatcttgagagtgatacggcagcccagcaaatcctggctcagctcaaggcactcggcggcgatgccctggccgagcgcctgcagcaggcgatgaccgactatgtacaaaagcagctggctccgtatctgcagcaggctctggatcagatgatgaagtcgatcagcgaccagattgcgacgacggtgtcaactcagctcaaggcaggcgcggcagggctcatgggccagatggcgacgcagatgtcatcgagttttgccaacctggcgagcgctatgcgtgtggatgcgagcgcctttgcccgcgccatccacttcaacatggacgccgaggacctgagttcgcttatgatgagttatgccaaggcatcgcagcttacctatgacaacaacctgaccacactgggttatgcggacgaggcagaccccatctcggtcaagattttcccgcgcgactttgaggcgaaggagcgcgtgctcgaccatatcgatgcgtataacaagcaggtcaaagctgctggccacgatgagcaggcgatttcgtacaccgactatatgggaatcattatgggctcggtgaccgacattgtgaataccatcagcttggtgctcatcgcattcgtgagcatcagcctagtggtgagctccattatgatcggcatcatcacctacatcagcgtgctggagcgcaaaaaggagattggcatcctgcgcgcgatcggcgcgtcgaagcgcaacgtggccaacgtattcaatgccgagacctttatcgagggcctcatcgccggcgtctttgccattgtcgtcgtggtgctcgtgagctttccggttaatacctgggcgcttgcggccaaacaggtgcccaatctgatgagcctgcccgtgcaggatgcgctggtgctcatcgcaatttcagtgctgctgacggtcgttgccggcctgctgccggcccgcagcgcatccaagaaggaccccgtcgaagccctgcgctccgaataatgcgacaaagggacagtccctttgtcacattgagacccttgcgaaaacggggtctaattaccgttcggcaggttaagaactccctctccccgcttaatgcttgacgaagagtcctctggtttatatacctatcggtaggcatataggatgtattgccgatagaaatggagcaaccatgactctcaccacaccagccaaaaaagattgtctccgtgaaagcggcgcatttgcttgggtcgtcgttattgcgctcggcttaatgtccgccggaacaactggcacatatagcattattgccggctcattcgttgctccagtatgtgaagatctgggctttgactacacttctttttctttctatttcaccgcgattcttcttggccttgcgcttgggcttccgcttttgagtcgcttcattccaaaagtaatcggcaaaccatggcatatttgcattgaactcgtccttattgccgccggcgccgcaatggcgttctacaccgaggtctggatgttcaccgtctccgccgcagtgatcggcatctgcttttcgtttacaacgggcgtctgcatgtccgatgtcattgaccaatggttcagcaaatcgtccggtctcgccatcggcctcgcttggggcgttaattctctctgcacgctgttattgagtcctgtcattacgctggtcatcgagcagcaaggctggcgtacgggatacatcgtgcttgcggccgtttctgcagctatgattttgcctgcaagcgcatttatcattcgccttaacccctctgatcgcaatatgcttccgtacggagagaccgtctccgaaacccatgagagctgcagcgccgatgagcaggaagatgtcctttcgggcatggcactccgcgatgccgcgaaaacgccgtcttttattctctgtgtcctcttgctttgcgtggcgcagctcacctgctgcatgaaccagctgtttccaacctatgcaagcgaggtcggtttcaatcctatcgtaggaagcttaatggtctcggcagcttcactctccgatatcttcctaaatcccttcgtgggcaaaacatgcgacaagcttggcgctattaaagcaacggtcgcatggacaggtgtcagcattctttcattcctgcttcttatcattggcggaagcaatgagaccgtttccatcattgcagctggtgtaaacgatgtcatgttcgccatcgttggaaccgcaatgccgatgcttctcctctcgctctttggatcacgcgattttggaaggatctattcgatcgtttgctcagcgggctatgtcgtcggtgcttttggaatgccggtcatgatgaaggtttacggcatggcagggtcattccagggagtatttatcttctgcattgcctgcaaccttatgattgctgcgtttgctatcgtttccggctttctcaataaggctgctgaaaagtaataagcgccgattgcaccggcatagattgccacgcaacaggggtcgactccaagccagattggagtcgacccctgttttcgttttaaaggttgcccgcaggcaccatgggcgccaacatgcgcttcagcttggctggtctatttgaacataagctcgactattcccgcccaaaccgctttctcatcaatatcctcaccttgagcgaccgtattgcttgctccctccagaacggtataaagaatttgtacgtagagcattacgtcggcgctatcggaaaacgcgccaatctctacaccatgaagaaggatgtctttaagcgcatccatggttcgtttggtcgccgtcgcttgacgttcctgaactgcaggaattcgatttgcttgaacgctaacctcggccagcacgcgccggcgcttttcatcgcttcgatagccacctataactgaattgccgagctcgataagcgcggccttgaacccgtccctatcgactattagcgagtagtcgcgccgatagtcaatggtcggaaacatgctgtccaagagcgtagtgaaaatctcctcttttgagggaaagtagtagtacaccgacggcttggatataccgacaaagtcgcaaatctttccgatagacgctttgtcataaccgacttctgccacaagatcgtacattgcgtccaatattttttttcttgtgctcacgctgcatttctccattgcaaatcacttccgcactaccaacattattaaggatggcaacggaacatcaattcgtgtccaaacatgaccactatatacggcgaacggtatgtatcagtaggcgagcggcaattattcaaaattatctaccgaacggtaggtatagtagtactatagcaggtgaaaccccgctattgtcgcggccggacagcatcgcgggaaacccgacggaaggaccaaccatgtacgagaactatcgtatgccgggcgagttcgagaagcgctccaacgtctatgtgacatggcttcccgattacatccgtgcagagggctacgataaccgccagccctgcgttgacgtgatcaaggctctgctcgagtatggcgacgttacggtcaacctcaattgcggcacccccggctcctatgaggaggcttgctcgcgcctgaaggaggagggggttgatctcgatcgcatcgagatcacgcagttcgaagactccaacttctatgtccgcgacaacggtcccagcatcatggtcgacgacaagggccattcttatatggtcaaccccgcttggacctattacggcgtgtgggacaagaactccccggagtgccagtccgcacgtaaggcagccgttcacatggcggttgcgctcggttgcttcgatatcgtcaattccgaaatggtttcggagggcggcgaccgcgagtttgacggtcacggcactctgatcgccatcgaggacacggaatgccgcaagcgtaatcccgagttcacgaaagaggaaatagaggccgagtataagcgcatctacaacctcaacaaggttatctggcttccgcagcctatgctcgaggacgacgactatcgactgggcatcctcgacgagaaggaagacggaactcccgtctttggcatgagctttgcagctcacattgatgagatgtgtcgctttatcactccgaacaagattcttcttgccgaggtgtccgatgaagaggcagcctcgagcaaggctggagcagagtctcgtcgccgcattgaggcagcctacgagatcctgagcaacgaaacggactgggagggcaagcccttcgagatcgttcgtatgcccaccgccgagcctattgaagtcgttatcgcccctggcgatgaagattacgagctctataagggcttcatcgacgaaatgggcggcaagtttatggatggcaccccctggcccgagggccccgtccacttctacgccgcagcgagctactgcaatttcctgatttgcaacggcgtcgttcttggccagcgttattaccacgagggcatgagcgaggtcgtgaaagagaaggacgagcaggccaaggcagttcttgagagctgcttccccgatcgcaaggtcatcatgattgattccctcgcgcttaacctgtccggcggcggcgtgcactgctggactaaggacgtggcggccagtcgttagtgagccttagagcctgcgctctttggcttaggcgccacatgtaccgctccccgagggatatccgtgttttcctcggggacacattcaacaataattttgataataattcgaaaggaaataggcatgaacaacagcctccgcggtcgcgactacatcaacatccatgatctttcctccgaggatttccgctatctcatcgatcttgcctggaaccttaaggctcagaagaagtccggtgtcgaccagcactacttccccggcaaaaacgtcctcgccaactttgagtggggctcgacccgtactcgttgcgcattcgagacctcctgcaatgatttgggcatgggcttcacttatctgaccaactcccacatgggtgactgcgagaccgtcaaggatgccatgcgcgtctttaacggcatgtacgatctcatcgtctaccgcgcacagaaggacgagcagttcctctatgacgtcgccgacctggttgacatcccggtcatcaatgcccttactctcggcgatcacccgactcagatgctcgctgacgctcttacgatggaagagcaatggggcggtttgcgtacgagccgcggcaagaagatggctttcgttggcaactgcgccggcgccccagtgtggtatggccgtctgtgcgctatgctcgacatggacttcctcgccatcggccccgacgacctccgtcatcagatgtgcaaggaaatgatcgaagaggtggaggcctgctacgccaagtacgctcccaataggacctttaccatcacctctgacctcgatgccctggatggcgttgacgttatcgttaccgaggagtggcgctacatcaaccccgagtgcggcgaagaggttctggatcccgacgactacaactcctggttgggcgatgccgagtctttgtacccctatcgcgtcaccagcgagctgtgcaagcgcaccaacaatcccgacatcttctgcatgcatgagcttccctctgtccataacgcagatcaccgtgtcggcaaaatgctcctcgaccagtgcaagaacgacctccatcgcgaaatcatcaccgagggctttgagattgccgacgagtgctttgaggccaacgcttcggtcatcttccgtgaggcagagaaccgtcagcacaccatcaaggctgttatgtgtgcccttctgggtctctaggagctgtatcaatggataatgcaaagttaaagagcagcaaggtttacgcatgggttctcgtaatcgcgctcggccttatgtctgccggcacgaccggatcctatagcgtcatcgcgggctccttcgtcgcacccgtgtgcgaggagttcgggtttgactattccatcttctcgtattacttcaccgcaacgctcattggtcttgcggcagctcttccgtttgtcggaaaactcattcccaaggtcgttggcaaggtttggctccccgttgtcgagcttattttgctcgctgccggcgcaggcatggccttctacaccgaagtctggatgttcatcgccgctggcgccctgattggcgtttgcttcgccttcaccaccggcgtcgccatgtccgacgttattgaccagtggttcaaaaaatctggtggcctggcaatcggtctcgcttgggcagtgaactcgatttacatgctcatcatgagccccgtcatcacctctgtcatcgaggccgctggctggaggactggctatctggtgctcgctggcgtctccgccgtgctcattctccccgcttccgtcctgattattcgctataagcctcaggacaagggcatgctgccctatggctacgtcgagggcgagacggtcaccgagaccgaggagacgaccgaggatagcacgcgtggcgttagctatgcgcgcgccattaagtcgcctgccttcttcttctgcatcggcttcctctgtctcgttcagctcacttgctgcatgaaccagctcttcccgacgtatgcttccgaggttggttttagccccatggtgggcggcttcatggtatccgctgcatcgctcttcgatctgttcctcaatccgatcgtcggcaccacttgcgataggttcggcagcacgaaggccattctgggctggctcgctgtctccatcctctcctttgtcatgctcatgatgagcagcggcaactcgacgctcagcatcctcgcagcaggcgtgaacgacgtaatgtacgtcatcgctggcactgccctgaccgttttggttatggatgtctttggctcccgcgatttcggtcgcatcttcgcgctgatctgctccgtgggctatatcgtcggcgcctttggcatgcccgttatgatgaaggtctatgagcttgtcggctccttccagggcgtcttcatcttctgcatcgcatgcaacgttattatcggcctgttcttgctgctggcaaaaaagactggtaagaacctctcctgggacgaatagttcgattcgtcttagacatacgctgtagggcttaacctgcagccgctttggggcatcgactaacatcggtgccctttttcatcgaatgtgacaaaggagcagccactttgtcacattgagtggcatgtaaatcgaggtctaatacttttccgagaagtgaacggccatacttggacctccgaagcatcgacatttttagacgtcaaacccgcaggatttggctggcaaaaccgcaggaaattgcatctcgaaagtgccgatgcttcgggggcccgttttcactcgttcacttctcgggaaaagtattaaacctcgttgtatggggtgcggctggagggtggtcatcgttcagtagctacctcttccttgtgaatcgcctgaagcgcaaggcataatgcatgtgacaaagggacggcccctttgttgtgttgatatgagagaagagtagatgatcctttcgctggcccctatggaggggattaccgggcatgtgttccgtcgcgtgcatgcggagtgcttcggtgcgctcgattgctattacacgccgtttttgccgccgccgcgggtgggaaaccgctttggcggcaaggcgtttaaggagatcgatcctgccaataaccaggggctcaacgtggtgcctcagctgatgtccaagaacgcggacgagtttgtgtgggcggcacaggtgctcgccgacatgggctaccgcgaggtcaatctcaacctgggttgcccttcgggaacggttgtcgccaagggcaagggctcgggtttcttgcgcaatctcgacgagctcgaggcgttcttaagcgatgtgtgcgagcggtcgccgttgccggtgtcggtaaagaccaggctggggctggagaatgacgacgaatacgagcgcgtgctcgatctgtattgccgcatgccgttggcagagctgatcgtgcacccgcgcgtgcaaaaggaccgctatacgggatcgccgcgcaaggagttttacggcgagacgctggggcgtgcgccgttccccgtggcctataacggcgacattttcgatcttgaggatatggatgcgctggtggaggcctatcccgggacgcgccatgtgatgctggggcgtggcttgcttgcgaaccccgcgctcgctcgcatggtcaagggcggtcccgctgccacggcagccgaactgcagcgtttccacgacacgctgtttgcggcctatgcagaagagattggcggcaatgcggtcttccgcatgaaggagtggtggttctacgccaagtgcgctttcgctgatcccgctaccgtccacaagatcgtacgcaagaccaaaaaggtcgacgaataccgcgctgccgtcgagcgcgtctttcgtgaacagccgcttgcacccacagctcgcttccacggctaactagtcatcgggggcgttctttaacgactggtcatttaaggacgtccccaacgactatgtagcaaaaacatgtacaccagcatccaaagatgtcgaaaaatgtcgactttggatgctggtgtacatgtttgggtccgacgggggagcgggcctaggcaatcagtgcatcaagtgtaatgagctctctgagccgctccgtgcgtgtttgcccatggcgtttggctttttcgtcaaacgcctcaagaatcgattcgcccacacgtgctgatataacgacgctcggctcatcggagattggtggccttcccaacttgatggtgtgacctttcggccactcatctttttcgtaggcttccgcggctttcttcaactctccgggagcaaaccccatcatcttttcgagctgcttagcatccatggcgcctcctatcgatcgacataatgtcgagcgccggttctcggattctctttttgtatacaattttgtagacaaaaatacaagcagttcatcgggctaattagcttgttttgacctgcctgttcgataggaaatgagcattgacggcttcgatactcctttgcttttcagcttggaatttggatgctcattgaacttccggaggggagccctttattaagctattgagattctgggcaggagctctcactggtcttcggtaatggggccagcttaattcgcgacacagtgtgtcgcgaatgggagtagtcgttaggtgtccttcaatggctactcatataagaacgttcaagtgtcggattttgtcatttagtgtcgctctcagcgactattctggagggtcgtggtcaaaaaagggcaaatatgagtactgttgccattatggttgcatttatttgctataaattgtagttcctgatgagatttgttcccattaagagctacttttattgaacatatgaggagaaataacgtcgtctgcggacgagtggaacgttgaatagttcctgaagtgatcaaaatcgctgctactaaacaggtagcagtactcatatttgcccttttttgaccacagccctctcggaaacctttccagaggcgtcaaacagccataatccaaaggtctcctcaaacaattagccggccaagagcgtccatgactaccaaaaagctgtacgccagcatccaaagatgtcgaaaaatgtcgactttggatgctggtgtacatgtttgggtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatccaaagatgtcgaaaaatgtcgactttggatgctggtgtacatgtttgggtcgtatgggttggggccctggacggacagagcgtgcgtactagagcaggttttcctgtacccatgcgatgatgtcgcttgactcgtagagcggcttgccgtcgatgaacaagcagggaacctggcgttttccgccgacggcgatgagtgtctgctcggcttcggtatcggtcgagatattgcgttcgggaatggtcacgctgctatcggccaaaaagcgcttgacctttatgcaatacgggcagccggtcataacgtagagcacgagctcgtgatcagtagtcataggtctccaatcggttgcggttttgattgaaatacccaaagccgccgcggtctatgcgcacgtcaacgacgactcgatggcctggaccagaaacgccgtggctccggtgccgcagggcttgtcgtagtagtcaacaaagcgctggtcggcaagatagccgtgggcgaggcccaggtacgcctcgtcttggggctcgcatccccagttgagagcaatccatcgacggtgcattgtaaccagtttttgagcttcgttgctctctgggtcgccaatgcccatggcaatcgagagctggcccaaaatggcgcgttcaagttccttcatgtcgttccatgtctgaggatccatatccagtaacgtttcgtttgctgcatcgatagcctcattgccatagcgagctcgagcctcggcgccgtagcattcctcgttttcctgcacggtgcgccagcgctccagttgcggcaggacggcgcccatgagcgagacggcttcgtcaagcgacatgccggtgttttgcgccaggcgcggggcacagtcctcgatcatcgcctccatggtggtggcgtaggtgtacttgccgtggtcgtagcaccacttgcagtaatggtcggtcgtggcgcccgtggcatcggtgccgcagtcgtcgggcgtgagtatcatgccgcagctctgacaatagtgctcgggcatttcgagcaggtgagacaggggctcgccggttacggcggcaatgagcttcatcatgtcgatgcccggtgtgacctcgccgcgctcccaacggctgatggcctggcgtgtgacgaagagcttggcggcgagctgctcttgggtaaggtgatgggcgcggcggacagcgatgagcttttctgcaaaggccatagcggctcctttctgctggttgatggcttaagcatacgcggtgacaggcgcccttccaagcaaccgttggttgcacgacgggggaccgcggcgaagaattgcgcgtaacgccccatgcccccatgccgtacaatgaccggcatggaacctatcgcacacatacataccgacctgccgcagaagttcggcatcccgcgcaacagctttttggcgccccatctgcagggacgcatcgtttttgagccggaatttgcctccaatgcagcggttgagggtctggactccttctctcacctgtggctgctgtggcgcttcgaaaacggagcgcccggcggcacggttaaggacatagctaccgatgccaagacgcaggacaggtccggcaccaacgtcaagtggtcgaaaaccgtgcgtccgccgcgtctgggtggagccgagcgcgtgggcgtatttgccacgcgcagtccgtttcgccctaatcccatcggtcttacctgcgtcaagctcgatcgtgtcgagctcaccgacgatggtccgatcatccatgtgctgggggccgacctgcgcgacggtacgcccatctacgacattaagccctacattccatttgccgactgtcacccggatgcgaccggcggttggattgaggatgctccgtggcaaacgctcgatgttgagtttccacaagcgctgcaggatatggtcccgcccgcaaagctccccggcctggtcgaggtccttcgccaagatccgcgccgtgcgggcagtaagcacgagccaaaccgcgtctatcatctggccttcgccgggctcgacatatctttttcggtcgataaaacccagttaaccgtagtcgccgtcaacgacgcgcgagactaaccagccattcgcccgcacccgtcaaattaagcgccaaaccccgcgccaaaaccgcccacgctggtggacaataacgcctaccaaaacaatcaactttgcacgggagcttagcatgaaatacgactttagctcgcttatcgaccgccacggcatggacgccatcgccgttgactcttggggcgagatccccggtatggcgccgaacgcacccgacgagggcttcgatcgcattcccatgtgggtggccgacatgaactttgccacggtgcccacggtccaggaacacatcattcagcgtgtccagcaccccatgtttggctatttcaatccgcgtcccgagtacttcgaccgcatcatcgaatggcagagccgccgtaatggcgtcgagggtctgcgccctgaacatatcggctacgaaaacggcgtgctgggcggtgtcgtgtcgacgctgcgcgcgtatgtccagccaggcgatgcggtgctggtccacagccctacctacatcggctttaccaagtccatcgaagccgcgggctatcgtattgtccacagcccgcttaagctcgatgaccagggcgtgtggcgcatggactttgaggacatggagcgcaaactcgcccaaaaccacatccatgccgcggtgttctgctcgccgcacaatccctgcggccgcgtatgggagcgcgacgagatcgagcgcgccatggacatctatcgccagcacgattgcgtggtgatctcggacgagatttggtccgatatcatcctgccggggcacaagcatatcccgacgcagtcggtgagcgaggatgcccgcatgcgcacggttgccctctacgcgcccagcaagacgttcaacctggcgggtctggtcggcagctatcacatcatctataacgagacgctgcgcgaccgcgtgtgcgccgtgtccaacaagacccactacaacgagatgaacgtcatctccatgcatgcgcttatcggtgcctaccagcagcagggctacgagtggctcgatgagctcaatgaggtcatcgagggcaacgtcgactacttctgcaattacgtggacaagcattttgcgggcgtgtcctattcgcgtccgcagggcacgtacatggtgttcctggactgcacagcgtggtgccgcgagcatggccgcgatattcagtggctgctcgacgagggcgctcgtgtgggcgtggggtatcaggacggccgcccgttccacgggccctgccacattcgcgtgaatctggcactgcccctttcgcgggtaaaggaggcgtgtgagcgcctggaccgctacgtttttggggtatagggggcgctcgattcgagtgctgccccatgcgcccacgccgtcaaaatgcgtgggcgcatggggcgcagagggtagcgagcgcgtttttcgcattcgctacttttcatgaatctgcttgccgcaaagatgctcaatcgaaatctcgtagagttggacgcccttgatgtctttggcgatttcttcctcgacttcttcggcagaagggtagtacttaagcgcgagctggcggactttgtcctcgataaacgcgggcgcttcatctaccaggcgacaacgaccaaagacaacggtactcataacgtagggagcccagtcgccgtccttgtaccactcgttgccgtaaacggtaaagcagatcttgtcatcgcgcttgagtgcgtcgaccttgtggccagccttggcgccatggaaataaatcttgtcgtgctcggcgtcgaagaagtagttgacgggaatggcgtacgggtagccatcgtcgccgttgacggcaaagacgccgcgcttgcaggtggcgagcaactcgcgcgcttcctcgtcggtgatggcgcgtttctttcgacgtaagggcccaaacatcgttggtttcctttctggtcgtgcatggtggttgagcacaaactatagcgaaacggatccgtatttcttgatgcgggcgagcatgtttttgagcttgttaaagtcgagcggcttgggcaggtgagcgttcatgccggcatcgtgtgccgcctgggcatcctcggcaaaggcgttggcggtgagcgcgatgatggggatatcggccgcatcggccttctcgctcagacgaatcgcgcgggttgcctcgtagccgtccatgcccggcatcatgatgtccattagaatcgcatcgaagctacccgcgggacggccaacgtataggtcgaccgtttcgttgccgtcggcggtgcgagttacgacgatgccctcgctttcgagcagagcctgggcaatctcggcattgagctcgttatcttctgccaaaaggacgttcatgccggcaagcgagcagctgtttgcctggccgtccgcacgttcccttgcctgagggttcttgtcgatatcgagcggaatctggacgttgaacgtactccccgcgccaacctcactcgaaatctcaatcgtgccgcccatcaggtcaataagtgacttgacgattggcatgcccatgccggttccctggaacttgctgcgcgcatcgtcaccttcctgggcaaacggctcatagatatgctttaaaaactcgggagccatgccaatgccggtatccgaaacgctaaagcaaaagagcgcgcgcccatcatcgagtggcttggtctgtgagctaaaggtgacggagccgccgcgcttgttgtacttaatgctgttgtctagcaagttgattatgatccgtcggatatgggtgggactgccgatcatgtatggccccgtagcgtacggcaggctattgtcctgcaatgtgatgccgttaccggacgcgcggagcttgcacagcaccagcgcatcgtcacagagctctttgaggttaaaaggagcatgttccagtgttagcttgcggtcttcgattttgcccatctcgaggatatcgttgatcagcgagagcaggtgattggcggcaacacgcgccttggcgcggctttcgcgggcgacttgcatatcgccgtctttcaattcctcaatttcgataagacccaggatgccgttgagcggcgtgcggatgtcgtgactcatgcgcgtgaggaatgctgtcttagcggcgttggcggcatcggctttctgctgttctttctgcgcgcggtgaagcgaccagacaaggatgacgatgccggtgagcaaaatgcagatgacgactgccgaaatgacgatgcggttgcggtagagaagtcggaacgcatccgattcttgcgccgagtacgatgtgggggaataactgcttgcagagagcgattcgccggcattgacgatgcccttattgataattcccaacagctcgggcttgccgcgcgaaattaaacacgatagttgcgccgtgttggtgagttcctgcgtttcgaaatcctcgatgccataggtgtcgcggatggtttccaagcgcgtgctggggacaatgatgcaacttgcctcccccttattgagggctttgagcgcctcgccgccatttggatattcggttatcgttgcgtcggggaagaggctctcgagctcaagacggttgacgatcgcgctctgcgtgcaagcgattttcttaaggtcgcggttcaggttattgctgctgtgaatggcggtcagggaaaccgttcccatcgggtttgactgcacgacccctttctgttcggcaagccagtagtcgcgaaacagaggtagggcgacatcgatagttccgttggaaagggctttgaccatttgcttgttatttgagatcgcgactgttttaaccgtaatgccaaacttgtcgcgcaacgtcgttgcaagcgaggcgagcgacccttccatctcgccgtcgtcattttgcgtgcagtagggaagttggtttttaagatagccaatcgtgatggtgttgccgtttgctttgagccaggaggtctcggtgccggtgagcgatgatgagccgctgttttgggccgagtagctcgatttgacttcgtcgttatagcgcgggttgacgcgggcgattgccgtcatggcggcattgatgtcattcatcaaatcggggcggcttttgggaacggcaaaatagtagtcgctcgagcctacgtagaacatgggcgaggcatcgggcgacgaaatggtgtcgttcatgatgacggcgtcgacctcgccgtctgcaagcgcctcaaagagggcgccaccggtgttgatttctttataggtacaggtgatgccttcgttggcgagccactgctggccgacgaaggtttgcatagcgccggggttgtagccgatggtaaggccttggagcgcttgggggtcacccttggccaggtcgtcgcgatcgggcctggcgtagatgtagtagcgctcggtgccctcgggattcgaggaaaagagcaacttttgggcgcgttcctcggagtaggagatgttgggcatcaggtcgatttcgcccgcctcgagcttgtccatgagctcggtgaaggtgccactgacgtattcgtattgccagccgggcgtgtagtacgaaagcgtctggaggtattcgtaaccccagcccgagaggcgttcgcccggcgtgccttcctggaaacccctgttgctgacgagccagccaacgcggaccgttttgacctgctgatcagagtcgccggcatagacgggggcgggcatggcgccgcccagcacggtaagtgcggtaagcacgatgaccagggcacgatatatagttgaacgaaggacagcggcagttctcacatgcaatcctaacgaatcgagacattaccgcataaggataccagctcaggtgccccgttcgcccacagatatagtcatcggggacgttcttaaacgactagtcattggggacgttcttgaatgactagtcgtttaagaacgtccccgatgactagttccgtttgcgggggaggcgtgggacaatatcgagcaaatgtgaatgattgtccgcggaaggggtcgcgatgaaaaagctgaggacacttgccgatgtgttgcatcaggctggctttgcccacataacgggcgtgtttcttgtctttttcctgctctgctcaacggccgtctggctgtccgagcccacgaccctcacctttggcgacgggctctggtttagctttgagaccgtgtcgaccatcggttttggcgatattccggccgagacgccggttgcccgcgccatcaccgtcatcttgagcgtcatcagcatcttctacatcgccatgctcacgggtgttgcggtgagctactgcaacacgctcatcaagctgcgccaaaaggacaccatggcacgctttatggacgacttggagcatttggaagagctcgaccgcgacgagctcgccgacctgtcgcgtcgcgtgcgcgagtaccgtcgccggcaacgttagggctagcgcatcgcgcaacaagggggattgcatatgaatatcacggtgtacctgggcgcgagcgtcggcaacgatccggcgtttctgcctgcggtgcaggagctcggcacatggattggcgctcatggtcacgcgctggtgtacggcggatccaggtcgggcctgatgggcgcgcttgccgatagcgtgctcgatgccggcggccacgtgacgggtgtggagccgagcttttttatcgaggcggagttccagcacgacggcatcgacgaccttatcgtgacgagcgatatggccgagcgcaaggcgaagatgatcgagcttggtgacgcgtttatcgcctttccgggtggcacgggtacgctcgaggagattgccgaggttatgtctgccgtgtcgttggggcacctcaacgcgccgtgcatcttgtacaacctggacggttactacaatgacctgaaggcactgctcgagcatatgatcgacaagggcctatcgagcctgcagcgccaacagggaatttattttgccgacaacctgcaaaagatcgcatcgatcatcgacggctaggcaacgggctcgcatgcgcgcgacacccaatagtgccatttgcagcgcagatggttggcgcgttcaggccacgtccgctctacaataagacgtatttctgtcgactttgactacgggagggcccgatggataagcttgccaaacctaaaaaccgcgcgctgtttttggtcagcgttgccgtgaccggcgcgttcgcaggtgccgcagtctggctgttcttttttgcgatggagcacggcatcgactatctgtggaccgagatcccgcacatgttgggcgccgcttcgcccgagctcgcgagcggcccgttcggctttttgccgtatccgtttttcgtctgcctgctgggcggtctgctcatcggtctgtacgaaaagctgaccggcaccaagaccgacgacctcaaccaggtgatggccaaggtcaagcaagacgggcgctacccgtacgacaatctgggcaagctttcgctcgcggcattgctgccgctgctgtttggcggaagtattggaccggaggccggcctgaccggcgttatcgcgggtctgtgcagctgggtcggcgaccgcatgcgccgctttggcgccgagtttagggagctcacgttgttgggtacccaggccgcgctgacggcgctctttaccgcgcccgtctttggctttgtggccccgctcgccggcagcgccgatggcgatgaggattccacgtctgacgagatcaccattaagctccccaaggcgcagaagactgtggtctacggcatcgcgatcgcgggtggtttgggaacctatctgctgctcggccagcttatgggcggcggcatgggcatgcccaggttcgaggctgccgaggtgggcaacctcgagctcgcatggcttatccccctgtcgctgatcggcacggtctgcggttggctgtactttgtctcggagcacgcgagcgaggcgctggcccatgccataggggagcgccccgtcgtcaaggccatgctggctggcctggcgctcgccatctgcggaacggttctgccctacaccatgtttgccggcgagacgcaggccgatgtcctcatggaaacctacctgaccatccccgccggtgtgcttatcgcgaccggtctggtcaaggctatgctgactcccgccctcatcaacatgggttggcgcggaggccacttcttcccggttatcttctcgggcgtaagcctgggctacggccttgccatcctcaccggcgccgatccggtcttttgcgttgccgtctgcacggcctcgacgatgggcgccgtcatgcgccagcccgtcatggtcgtgggcctgctgctcatgtgcttcccgctcaagggcatcgtctgcatgatcatcgccgccgtcatcgccgccggcattccgttgcccaagtcactgcgcaagtagcgcggctttatcgcggcacaatgctcggaggataagaaatgattctgtactttagcgcgacgggaaacagcgagcatgtggcgcgccgtgttgcagcggcaacgggcgataaggtcatgtcgattgagcgctttgatgccgagtcccttcgtcttgccttggcgggagggccctgtcagcttggatttgttgccccggtgtatgcctggggcttgccgacgccaatgatagagtttttaaagactgccgacctgtcgattgccgctggcgcaaaggacggcgggcgaccttatacgttctatgtctcgacgtacggttcgacgaccggccaatcggcgaagtttgcccgcgatttgctgcgcgagcgtgggctcgagctggacgcggcgatgagcgtcaagatgcccgatacctggacgcctgttttcgacctgtcagatcctcaaaaggtcgagagcatcaacaaggctgccgaggcgcagattgatgccgtggtcgaagcggtacgggcgcggcgtacgggcaacatgatgcgccatcgcgtgcccctgtttgcatcgtgcgcatatcacgcgtttgggctgccgcgcatgcaacggacgagcaagtttgccgtcgatgccgatcgctgcatcgattgcggcctctgcgccaagcgctgccccatggcggcaattgagatgcgtgacgggcttcccgtctgggcaaagccggagtgcgccgcctgtctccgttgcctgcactgctgtcccaagtttgccatctcacgcggtaaacgcacggctgcccacggtcagtacaagcattccaagcccggcgtgaggatgtaacggctgcgtgcctgctctctaaaagctcatggtaagaaacaagccgcgcgaggccgtgtgtttacggtctcgcgcggttgttgtttagagcttcctcaacacgattgcgatggtgttgaggtattcaagcgcgcccgcttcaacggcggcgcggtcgcccgctgcgtactcgttatcgcaggcgagccagtcttcccatgcctcgttggtgcagagcatgggctgcatcgagacggtctcgacgccggcggtcggctcgatcatggcgcgccaccaggctatgtcgtgcatgtagtcgagctgctcaggcgtccaagatttgagcaggcaatcgggcagattgtcgtggcagtcgcggaccatgccagggatgctccggtagagcattccaccttgctttacgtaggggagcaagcgcccgcccagataatgcgggtcacgcccatagtagttgtacgagtcgatgctcacgaccgcatcaaaaaagtcatgctcaaatggcagcccctgagaggcatccgctttaacaggatgaatggtgttgcggggaataccgagtgaatcgaagaacgcgcggttctcctcggggtcgctccacagatcgacggcgtaggtgtcaaacccgtattcgcgggcaagcagggcgctggtgataccggtgcccgacccaaggtcgcagacgcgggcgccgcgggggatacgtgcgccgcgaagcagctcttcgcagagcttgaggggattcggccccataattttagagcgtacgagtgtcgcgtcgaagctggtggctttcgggaaggattgagattcctgggattgcattgttctttcctatcaggtgcaaattggcagatgacggaggcggaacggcgcaacaaaccacggccgttggacggccgtcttcatggttctatgcgattgaccgttccctaaagaacaatgaccaaaaagacatccccttggatgatcgagattgggccaaggcccgtgacgtctctattgtaggacgttacgggctggcgggggatatgccatttgtcatgtattggcggacagtcgattatggccacgggcgtgccgagactcgcgttccctgcgccttacttccatattgcgagtgcggcggtgcccaaaacgatgagggcaaggccaatgccgctgcggcgcgagagtttttcgttgaaggtcaggcgcgcgaacaataccgaaacaaggatcgagagcttgtcgatctgtaccacgacgcttacctgcccggcggcaatggcgtagtagtagaacagccatgacgcgccggttgcaatgcccgatgctgcgagaaacgcgagttcatgtcggtcgacgcacgcgacctgctccagttttcccttggccgccacaatcgcccacgccatggcgagtaccacacaggtgcggatcgccgttgccagattggactcgacgccctcgatgccaaccttggcaaggatggatgtgagcgccgcgaaaacggcggcgccgatggcgtaaacgagccaagtcaggtcttgcttctggcccacgccggctgactgtctcttctcaatcatcaggaatgtgccgagggtgattgcggccgtcccgataagctttacggcaagattgcttgtctcgccaaagagaacaatggcggtaagcgcggcgagtacggtgctcatcttgtcgacgggtacgactttgttgacgttcccgatgctgagcgccttgaaataacagatccacgaggcgccggtggcaagtcccgagagaacgaggaacagccaggacttgggcgcgatgctgccaatggttccggcggatccggaaacacctgccattgcccaggcaaatatgagcaccatgcaggtgcggatggcagtcgcgatgtcggagtcggtatgtttgatgccacatttggccaaaatagatgtgatgccggcaaagaatgccgatgcaaacgctgcaacaacccacgacacgggtgcggtgcctcctcaagaacgactacgccaggtctacggtgctcgtccgatgataccgcttgcggctacaagtcgcgtgctcgatagatcttggtgctgacggtgcagctgattgcaaatagcacgaacgccaggacggcaatgccggcgcacagacatccgatgacggcggggtcgggatttgctccggcaaatgacataagccagatgctaatggggttggaggagctcagtattgccatagtgccgcagccaagtagggcaaacaggccgacggataggcgcagtgcctccatgtgtccaaatcggaaaaatatcggctgtgccaaaaacaccatcatgagggagatgagcatcgacgtcgccgaggcggttgcgatttcaaagatcgtctggcctgtcgaagggatgcccatgtggtcgaagaacggaagggcgaggatgttcaggagcgtagccgcgcatgccatgacggccgaggaggcaataatgcacaggtagcgtgcgcagacgatgtctttgcgcgagaacggcaacgttgctcgatagcgctcccaaccgttttggttatcgtagccagccagcgagttcatgattatgatgggcgacatggcgctgactgcacaggtgccggcgctcatgccggagtcaccatccgtcgcgttggcaagggtcagcacgacgaatatgaacaggccgacgccggcgatgctcgggagaaacgagcgcatgatggcggtctcggacataaaggcgcgtttcatttggatgcccctttcagcgtgaggcgcagatagtcatcgatggaaatccgatcacagggaatcgcgggaaaggcctcgagcgtttcgcggcgattggggacgagtacgtcaacgctgtaggcgtgacgggtggcgcgggcgccttcgacgtaagccataagctcggcagcttgcgcctgggaacagtgagcaatgccggcgcgatcggtaatgtcctcgcgcggcaggtcgaacacaatcgagccactatcgatgcaggcgacacggtcggcggcgcgttcaagatcggatgtaatgtggctcgagaacaatacgccgtgctgtccgtcggcaacaaaggcgagcagctcgtcgagcagctcctcacgtgccatgggatcgagacctgccgtggcttcatccaggatgagcagctcggccttgtggctgagcgtacacgcgagctgcagcttcatacccatgccgcgggagaggtctttgacctttgccttggggtccaggccaaaccggttgatgtggccagcaaacgtttcatgactccacgtggggtatgccgggcttacgagtgcctcgacctcggccactttgagcgtggaagggaaggggcacgtgtccagtacgagaccgatgcgggagcgcatgcggcgttgttgttcatcggacgcattggcattgcagcgctgcccaaacaggtacacctcgccggcatcgagctttatgagtccgagtgcggcgcggatggtcgttgttttaccggcgccgtttgcgcccacaaagccgacaatctgaccgggttctacggtgagtgtgacatcgcgcagcgaaaagcgatcacttacgcggcgtgagacacctttgagttctagcaagttttgcatggtatagcctttcttgcagatggctactgcatggtttcgggggctaccaggtcgagcatctcgtgcaacttatcgcgcgtgacgcccagggcttctgcctgtgtcgctgcctgtgcaagcagctcttcgacatggcagagctggttttcgcgcaagagctcttggttgcccttggcgacaaagcagcctttgccttgcacggtgcagataaagccgagctgctctaggtcggcgtaggcgcgcttggtggtgatgacgctcacgccgaggtcgcttgcgagtgcgcggatgctggggagtttggctcccgcggcgagcacgcccgaaaggatttgagccttgacctgcgaggatatctgctcgtagataggcttgtcgctcgaattggataggataatgtccacagcggctccttagctgatgggctacacgtgtatataaccggtaagcacagtatatatacactatgcacagttacgcaagaggaaaatcggaatgattggccaccgtttgtctaaatctgtaacaacaagccccgaatatcccagctagttgttacagattaagatgctgtttgtccgccggtccttttgtctcgatttgtaacatctggagcggttttgggcggctagatgttacagttcgagattttgccggcaggcccatccgtttgtctcgatctgtaacaggtagaggttcaaaaaccgctccagatgttacagatcgagacaaactgctgcggagcgccgccgccgaccggcagtcaaagcctcgactgatgaatttgtcctgataggtgccctgtcgcagcatttcgcggctacaatagtcgcgttacaacgacgtaatgcactcaatgcaagaaaggatccgcatggcaagcctgtcggatgaaatctcgtcgcgccgcacattcgcgatcatcagccacccggacgccggtaagaccacacttaccgagaagctgctgctctataccggcagcatccagactgccggctcggtcaagggcaagagctcggccaagcatgccgtctcggactggatggacatcgagaaggagcgcggtatttccgttacttcctcggtgctgcagttcacctacaacggcgcctgcgtcaacatcctcgatacccccggccaccaggacttctcggaggatacctaccgtacccttatggccgccgacgctgctgttatggtcatcgacggcgccaagggcgtcgaggcccagaccaaaaagctctttaaggtctgtacgctgcgccacattcccatcttcacctttgtgaacaagctcgaccacgaggctcgcgatccgtttgagctcatggaagagatcgagaacgtcctgggcatcaatacgtatcccatgaactggccgatcggcagcggccgcaacttccgcggcgtgttcgatcgtcagacccgtcgcgtcattgccttcgagggcgacggccacgccaacgccaccaagaaggtcgccgaggtcgaggccgagctgggcgaccctgccatggatgagctcatcggcgaggagaaccataagaacctgatggacgacatcgagctgctcgatggcgctggcgacgagctcgacttggatgctgtggcctgcggcaagctgagcccggcgttctttggctcggcgctcaccaactttggcgtggagcccttcctcaaggagttcctgcgtctggccccgacgccgcgcgcctataccgatacgctcaccagcgagccggtcgatccctgccgcgacgactttagcggctttgtgtttaagatccaggccaacatggacaagaaccaccgcgaccgcatcgcctttgtgcgcatttgctcgggcaagttcgagcgcggcatggacgccttccacgtgcagggcaaccgcaagcttaagcttgctactggcacctcgatgatggccgatgaccgtgcgattgttgacgaggcgtacgcgggcgatatcgtgggcctgttcgatccgggtatctttagcatcggcgacactgtgtgctctggcaagcgccacgtgcagtatccgcagatcccgacgtttgcccccgagatgttcgctcgcattacgcaggtcgacacgctcaagcgcaagcagttcgtcaagggcatggaggagcttgcccaagagggtgctatccagatcttccgcgaactgggtgccggcatggaaagcgtcatcgtgggcgtggtcggcgtgctgcagtttgaggtgctcgagcgccgcctcaaggccgaataccgtgttgaggttcgtcgccagccgttgccctataccgatatccgctggatccagaacgaccccgacactattgatatcccgggcctttcgctcacgcgcgacaccctgcgtgtcgaggacatgcgcggcggtaagctgctgctgttcacgagcccgtggaacgtggattgggcaaccgaccacaaccccgaccttatcctgtcggagtttggcaacgtagcgttttaacgcatcggcgcggtggccctgcggggctgccgcgccgattgcttgcctgatgccgcgcgagcggctatcatacccaccgtcgtctcaagaccggggcgtccgagcagttcgggtccgatatcctgctcgttaaacctaaaaccaaaggagtacataatgatcaagaaggtcatggaggactacaaggtcctgctgcggagcattcccgcggcaacggtttcgctgtttttcgtgagcgtcatcatgatgaacctgctggccaacaaagagctcatcagcctgccatatctggcgctcgactgtggctttgtggtgagctgggtttcgtttttgtgccaggacatgatctgcaagcgctttggcgccaaggcatccatcaaaatctctatcctcgcgctgctggtcaacctggccgtgagtctgtgcttttgggcatgctcgctcacgcccggcatgtggggcgcctactacgacacgggcatgatcgaggtcaacactgcccttaacgccaccatcggcggcacctggtacgtggtgctgggctcttcgctggcaatgctcgtttctgccgtggttaactccacgctcaaccagtcgctcggccgcatgctcaaaaagaataactttgcgagctttgccttccgctcctatgtgtccacgggtgttggccagtttatcgacaacttggtctttgccattgtggtgagccacacgttctttggttggacctgggtgcaggtccttatgtgctcgctgaccggcgctgttgccgagctgctgtgcgaggttttcctgagccccgtgggctacaaggtcgtgcgcggctgggagcgcgagaatgtgggctccgagtacctcgagcgccacgcaaccgcctaaggagcaagtatgcgggttttgatcacgggtgcttcgggcggtatcggagccgcatgcgtgcaacgatttttggacgagggccacgaggtcgtgggctttgatttgctaccggcggcgatcaaacacgagcgctaccgccatctgatcgttgatgttcgcaagccggacgcgtttccagacgatcttgaaccccaggtgatcgtgaacgttgccggtacgcaggattcggctgacgacatcgccgccaacctgtatggcaccatcaacgtgaccgagcgctacgcctttgcgggggaggggcttgccgccaagccggcgccggctatcaaatccgtggtcaatgtggggtcggcgagcgggcatacgggatcggagtttcccgactatgccgccagcaagggcggcgttatcgcctacaccaagaaccttgcaaaccgtctggcgccgcaggctatcgccaacagtgtggacccgggtggcgttatcacgccgctcaaccgttgcgtgatggaagacgaacacctgtggaaccagattatggagctcacgccgcttaagcgctgggccactgcccaagagatcgccgagtggatctactttgtgggcgtgaccaaccggtttatgaccgggcagagtctgctgatcgatggcggcgaggccggccgcacacaatttatttggcccgaataggaaacgcgcccgatggaatgaactgcaccccaaaacctggacggcttaaataagaactacgccgcaagggactcactttccccggaggaatacgctgccgcccgtgcgtccacgctgaacgcccactacaccagccctaccgtcatcaaggcgatctatgaagcggtcggcaatatgggcttccagaccggtaacattctggagccgtctatgggcgttggcaacttttttggcctgctgccggagcagatgcagggcagcaagctctacggcgtggagctggacagcatcaccggacgtattgccaagcagctttatcccaaggcggacattaccatcgcgggctttgaaacaacggacagaaaagacttttacgacctcgccgtgggcaacgtcccgttcggacaatatcaggtagatgaccgggcttataacaagctcggtttttccattcacgactacttctttgccaaaaccctcgaccaagtgcgtccgggcggcgtgatcgcgttcgtgacctcccgctacacgatggacaagcaatcgcccgaagtccgcaggtacatcgcgcagcgggcggagctgctgggtgccattcgtctgcccaacaatgcgttccgcgccaatgccggtacggatgtggtttcggacattctctttctccaaaagcgtgaccgtcccattgagatcgaaccggattgggtacacctcggccagaacgaggatggctttgctatcaaccgctattttgttgaccacccggagatgattttaggcaggcagacctccgaaagcacccaatacggcaagcaggatttcaccgttgtccccattgaggggctggagcttgcagatcagctccatgatgccgtgaaaaacattcgcggcacctatcaggaggcggaactgccagagctgggcgagggcgaacagatcgacacgtccatccccgcagaccccaatgtgaaaaactactcctacaccgtggtggacggcgaggtgtactaccgggaaaacagccgcatggtcaaaccggagctgaacgccaccgccgccgagcgtgtcaagggcatggtcgcgctgcgggattgcgtgaatgagctgattgccctgcaaatggacgagtacagcgcagaaagccggattcaggaagcgcagaccgagctaaaccgcctctatgatgcgttctccgcaaaacatggcctaatcaatgaccgtgcgaaccgtcttgcgttctctgacgattcctcttactacctcctgtgttcactggaagtgctggacgacgacggaaagctggagcgcaaggcggatatgttccacaagcgcaccatcaagcagcagcgcagcgtagattctgtggataccgccagcgaagcccttgctgtctgcatcggagaaagagcctgcgtcgatctcgacttcatggcctccctcatgggcggcagcgagaaaatcccgcagattgttgaggatttgaagggcgtcatttacaaggaacccaacagtggtccgtttgacttgcaggacggcggcgagcattgggcaaagggctggcagacggcggacgaatatctctccggcaacgtccggcagaagctccgtaccgcgcagcgcgtggcagcgcgcgacccattcttcgctgggaatgtggacgccctgattgctgcccagccgaaagaccttgaagccaatgagattgaggtgcggctgggtgcgacatggtttgataagaagtacatcgagcaattcatgtacgaaacctttgaaacgccccgctatctgcgcggacagatcgagatcagctatgtcccgtacaccgcagaatggcaggtttcccgcaagagcatggtgcgctacaacgatgtggcggcattcaccacctacggcacagaccgcgccagcgcctaccggctgctggaggatgcgctgaacctccgcgatattcgcatctacgataccattgaggacgcagacggacgggagcgccgtgtcctcaacgccaaggaaaccacccttgccgcgcagaagcagcagcttatccgggatgcgttcaaggactggatttggaaagacccggagcggcgcgaaacgctggtacggcaatacaacgaggaaatgaacagcactcgtccccgcgagtatgacggcagccacatcgttttctccggtatgaacccggaaatcaccctccgggagcatcagaaaaacgccatcgcccatgtgttgtacggcgggaatacgctgctggcacacgaagttggcgcgggaaaaacctttgaaatggtagcctctgcgatggaatctaagaggttgggactgtgccagaaatccatttttgtcgtgccgaaccatctgacggaacagtgggcatccgagtttctgcggctctacccttcggccaacatccttgtcactaccaagaaggactttgaaacccacaaccgcaagaaattctgcgcccgtatcgccaccggcgactatgacgctgttatcatcggccactcgcagtttgagcgtatccccatcagcccggagcggcaggagcggctccttcatcagcagattgaggaaatcaccgatggcattcaggataccaagctcgcaggcggcaacagctttaccatcaagagcttggagcgcacgaaaaagggactggaggcgcggctgaaaaagctgcaagccagcgaccgcaaggatgatgtgatttactttgaacagctcggcgtagacaggatgtttgtggacgagtcggacaattataaaaatcttttcctctatacaaagatgcgcaacgtggcagggctttccaccaccgatgcgcagaaatcctcggatatgttctccaagtgccgctacatggatgagctgaccggcgggcgcggcgtggtgtttgccaccggcaccccggtttccaactccatgacagagctttataccatccagcgctatttgcagcatgaccggctgcaagagatgggtatgggccacttcgattgctgggcaagccgctttggtgaaaccaccaccgcgctggagcttgccccggagggaaccggctaccgggcaaggacgcgctttgcaaagtttttcaacttacccgaattgatgaatctgttcaaagaggttgccgacatcaaaacggcggatcagctccacttacccacgccggaggttgtgtatcacaccatcgccaccaaacccacgcagatccagcaggacatggtgaaagccctctcggaacgagcgtccaaggtacacagcggtgcggtcagcccggatgtggacaatatgctcaaaatcacctcggacggacgcaagctggggcttgaccagcgcatcatcaatcccatgctccccgacgaggaaaccaccaaggtcaatcagtgcgtggcgaacattctccaatactggcgcgacggcgaggaggaaaaactgacacagcttgtgttttgcgacatttctacgccaaagtccacgccctcgcagcgggcggcaaaggcttcccccggtacgctggacagcccggaaatccatgcgctggagagcgcgatttcattggaggaaagtgcggaaacgccgttcacggtctatgaggatgtgcgccaaaagctcattgacgccggtatgcccccggaacagatcgcgttcatccacgatgccaatacggaggtcaaaaagcgggaactgttcgcaaaggtacgcagcggtcaggtgcgcgtcctgatgggcagcacggccaagatgggcgcaggaaccaacgtacaggatcgtttggtcgcacttcacgatttggattgcccgtggcgtccccgtgatctcacacagcgaaaaggccgcattgagcgtcagggcaatcagaacaagctcgttcatgtctgccgctatgtgaccgaagggacgtttgacgcctacctctggcagaccgttgagaacaagcagaaattcatctctcagatcatgacctcaaaatccccggttcgctcctgtgaggacgtggacgctacggcgctgtcttttgcggagatcaaggcgctgtgtgccggtgatccccgcatcaaggagcgtatggatttggacattgaggtgtccaagctaaaaattatgaaggcagaccacaacagcaagcaattccgattggaggacagtctgctgaaatactttccggaaaagatagaagaacacaagggctttgttcgtgggctggaggcggatatgcagaccctcgcagcgcatccgctcccggcagagggctttgtcggcatggagattcgcggcgaccggctcaccgataaggaaaacgccggtgccgcgctgctggacacctgcaaggaggttaagggcaaagacccggtacagatcgggagctatcgcggctttaccatgtccgttgcttttgattccatgtggaaaacgtacacgctgacgctgaaaggccggatgacccatcgcgttgaactcggttcggatgccagaggcaaccttgtccgcatcgagaacgcgctggataaaatgccggagcgtttgcgcagcgttcaggagcagcttgaaaacctctataaccagcaggcggcggcaaaggccgaggtcggtaagccgtttccgcaggagcaggagctggccgcgaaaacggcgcggctcattgagttggatatggagctgaatctggacggcaagggacagccgcagcctgagcaggcgattgcaaaatcggcgcggccttccgttctggacaggctgaaagcgccgcctgttcatggcgcaccggaaaagccccacaagaaagaaatggaggcacgataatgaaaaatctccccgtttacaaacacccggcatcctatgccagagagcatgacgagcttgccgcctaccgcgcatccaatcaagcgaacacggcctgcaaggaagcgattgaaaccgccatccgtgaccactaccgggataaccggctggatacagcggcggtcgatcaggtggtgcagcagttcggctatgaccgcgcgtttcatatccttgccatcaccgtctgtcaagcggattgggacaggcgctattctcccgacaaccgggcatgggcaaacgccatgtccatccccgccaatcctgacgcatggggtactgaccgcaactgctatctggccgtcaacagccatcccggtctggtcgatctgtttctcagccagacccgcaaagcctacgcgcaggagcggcagaaagcctctgtccgggacaagctgaaaaagccgcctgaaacaacttcgccgaaaatttcggcgaagtccaaagccccggagcgctgagcgatggcaaaacgcaagcgggatattcagcttaaattccgcgtcacgccgcaggaacgggaaatgatcgaaacaaagatggcgcagttcggcaccaccaacatggcggcgtatctccgcaagatggcgattgacggatatgtggtgaagctcgaccttccggagctgcgggagctggtgtccctgcttcggtattccagcaacaacctcaaccagctcacccgccgcgcccacgaaacaggccgtatctacgaaaccgatctggaggacattcagcaaagtcaggaacggatatggacggcggcagagaaaatcgtttcctcgctggcggcgctgaaataagtcgcaggggcggcggtcactccgccgcccctgttcacacaaaagcaaaagccccgacgcaaaacagcatcggagcttctacggttccagattgttttcatcaaacagcggcgaggcaaaaaagctgctcaggtcgatctccaatccctgacaaagctcgtggatgatccgcagcttcatagacgggtatgcgcagttcacaagattaccgatggtggacttcggtacgccgcttttcatataaagctgatactgcgtcatgccacgctcctgcatcagctcaaccaaacgcctgctgacggcttcattcaactgcaagtaccacacctcccgtccctgtaactgtaccaatattatatttcccatctggagaaaattagttcaggtagctgtactaaagaaggattatgtgatatggttagatgtcgggcaaaaggcgaaaactattcgtatgactttgccgcatccttgcaaaacaccaatgggcaaagtattctaatatcagaaaaagatttgactgcttggaaaggagctgcggaacgtatgctgacaaacgaaattgtgctaaaagtattttctgactacctcaaccgcgatacggattttgaagttgtcctgaccagcagaggctacacggtcatgggttttgacaaccaccgtcaggactggaacaccgtggacttttgccctacgcccgaagcgctgcgggattctttgttaaacgcctatgagagcttccgcgagctggagatcacgggcggtgatcgtgatttgaccgaaaaggaagaagaaaagctcgccaaagagcgtgacgcgctgaccgcactttgtgaaaaggaggccgcaaaatgttcatcctgaaaattctctttgcgccgctgtcgcttatcctgtccctgttcgtttggctgtgcgcagggctgctgtcctgctccggcttcgtgttcaaactggcaagcggactgctctccctgctggctttcgccgtgctgattacctactccgtaaagaacggcatcatcctccttatgctggcgtttctgatcagcccgatgggacttccgctgctggctgtgcaggggcttggcaagctgcaagacatgaacaccgccatgaaaaacttcattcatagttaaaacacaagccggggcgaacgcctcggcttgcttttctaaaatcgttgtttactttcttgctaatatcggatataatattagcaagaaggaagtgataacatgaccgcctacgaccggcttgatctgctttttcagcaaaacaatgggatcgtcaaaaccgcgcaggttttggaaatcggtatttccaagtccacgttttacgcctacgccaagcagcacggcgtagagcaggccgcgcacggtgtttatgtttcgcctgacgcatggacggacgccatgtacctgctgcaccttcgctgtgcgcaggccgtattctcccatgaaagcgcgctgtttttccatgacctgaccgaccgggagccgaatccgtattccatcacggtcaagaccggctacaatcctgccagcctgcaagcagacggcatcaaggtctacaccatcaagaaagaattgcatgatgtggggatcgtcacgatgaacacgccctttggcaacccggttcccgtctatgatatggagcgtaccatctgcgatctgatccgcagccgcagtggaatcgagatgcagacctttcaggatgcactcaagcaatacgcaaaacgaaaagacaaggacttgcggaagctgatgcgctatgcgcagatgttccgtgttgaaaaactgcttcggcagtatttggaggtactcttatgattaagactgcacggcagctcaaagacctgatacgcaatctctccaaggacaaatccgcagatgcgcaaatcctgatgcgcaattacatgatggagcgctttctggagcgcatttctctttcggaatatcgggacaagttcatccttaaaggcgggatgctggtggctgcaatggtcggccttgacgcccgctccacgatggacattgacgcgaccgtaaagggtgcgacggtcggcatcgaggacgtggagaacatgattgcctccatcatctccgtaccggtggacgatggcgtggggttccgggtgaagcgcatttccgagatcatggacgaggccgagtatccgggcatccgtgtcagcatggaaacggagtttgacggcgtgataacgccgctcaagatcgacatttccaccggcgacgccatcacgccccgcgaagtgcgttacagcttcaagctgatgctggaggatcgttccattgaaattttggcgtacaatctggaaactgttctggctgagaagctggaaactgtcgtgtcccgcgccaccaccaacacccgcatgagagatttctatgatctgcacattctgagccagctccacggccagagcatcgtcccagccgatctccgtgcggcgctcattgcaacggccaggaaacgcggtacagagaagtatcttgccgacgcgcctgcggcctttgatgaagttgaggccgacccgaacatggaaaagctgtggcgggcttatcagaagaagttttcctatgccgccgacctgtcgtggcatacggtcatggaatccatccgcagcctatatgaactggcacgggagtaatagagagcagcaaatcggaatttatatataaaggagaatattgatgaaactgtttttatgttcgcacttttcaagtgtaggaagtctgataaaggaagaaattgaaaataaaaaagtcgcatttattccaacagcttcgctgcgtgaaggctacaccggttatgtcggctcggctcgaaaattattcaaaaagttgggagcaatcgtaactgaaattgatatttcaacggaggcttattcaacgatacagtctgtttttgaagatgcggatgtgatatattttaccggcggaaattcttttttccttatagaccagctccgtaaaacgggaacggatgagctgttgaagaaagaattggcaaagggaaaactgatgattggtgaatcggcaggtgcgattatatgcgctccaagcatccaatatatcgagcaaatggatgaaaagccggaggactactcacaagaagatgatgcagggattgatttgattgatttctatgttcttccgcattatcttacagcaccatttaagaaagttaccgagaaaataatgactgagttttcggatttgaatctatgcccaattaacaaccgtcagggaattgtaattgatggtgaagattcaaaggttatttgcaaagactaatttgaaaattccagtttgtcgaactatcagtttgcttttacctcttgcaaattaacacatttcaaacggtctgcttcggcaggccgttttacttttcaaggaggtgtccaacatggcaaccacacgcctgatgcctctccacaccggcaaaggccgcacggtgggacaggccatcagcgctatcatcgactacaccaaaaatccgcaaaagacagacggcggcaggctgataacaagctggcagtgcgacagcaggatcgccgatgccgagttccttttcgccaaaaatcaatacacccaaaagaccggcagagtgcgcggcgaggatgatgtgatcgcctaccatctgcggcaatcctttgttcccggagagatcacaccagaggacgcgaaccgtttgggctgtgagctggccaagcgcttcaccaagggcaatcacgcctatatcgtctgcacccatatcgacaaagcccatattcacaatcatgtgatctggaactccaccgcactcagccagacccggaaattcagaaacttttggggcagcagccgcgccgtgcggcggctcaacgataccatctgcatcgagaatggctactccatcgtggagaatccaaagcgccacggcaagagctacaacaagtggctgggcgacaaaaagaagccctcccaccgggagcgaatctgcgcggccattgacgatgcgctgacacaaaagcccgatagctttgaaacgctgctggagcagctgcggcaggccgggtatgagatcaagggcaagaaagtcccgtccctgttaggcggcgaacagaaaaagtccattcgcatggataccctcggtgacggctatactcccgcagatctccgcgcggtgattgcaggtgaaaaggcgcatacgccgcgaaagagcgccgcaccgccagtcaaaccgcaaaagcgcagcgggaatctgctggtggacattcaggccaaattacgcgctggcaagggtgccggttatgcgcgttgggtgacgttgttcaacctgaaacagatggcacagacggtggcctatctgcaagaccatgagcttttagattacgccgttctctcggagaaagcggcggcagcgtccgctcacttcaatgagctttccgcaaggatcaaatctgctgaaaaacgcatggccgagattgcggtgctgcgggagcatattgtcaattacgccaagacccgcgatacctacgttgcctatcgcaaggcagggtactccaagaaatttcttgcagagcatgaaagcgagatcacgatccacaaggccgcaaaggactattttgatggactgggcttcaagaagctgcccaccatcaaggcgctgaataccgagtacgccgagctgctggcggagaagaaagcggcctacgccgaataccgaaaagcccgtgaggaaatgaaagagctgctgacggccaaagccaatatcgaccgtattctggagctggacaaggagcaggaggaagcgaatgaacgacgggaaaaagaggcggagcagcgctgagctacccgcccacaagcgatttgcaaaatcgcgcagccgcaggatttatcctgcgttccagaacacacattttgtgttctgcggggattggggcagcgccccaacaagcatgaaacaggcgggctccgtgtaaacggaatccgcctgttttcgcaaagtgggtaccgctttgcattgcttgccagtttcttgttcccgttcgtaacccctctgaagccgtggttttcgatgccgcatatagcgtaacgcttcgcctcgcacgcggccggttgaccgtgtctgcgtctgcgcctcgtcgtacccgaactgcgcgacatggcactctgcccctgcgggaacgtccctgattttttctgtagcagcttgcattcgtgctgaaaattgactttcaggcgtaaatcgtgtaaactatattagtacattagtcactgctaaccgaaaaaaggagggcatccaatgacaagcgaatacatgaacaacctctatcgggatctgctctccaattcaccgcagaccgtaacgatcccgattccttctgatatgggaaccggacaaattgcgcaggtggtgacaaaacagggtgccgttgtttcagactggaagatgaattatttttctgacatgaatgtgcgcgggattaacagcgaggactatattcaaatgctgttctgcctgaacgacggcgtgtcgtggaatattgcaggcagcagagagggcgcttgtcttgcaaagggagaatcctgcatttaccgtggacacgggaaaatggagtctctctgttatgcgcaaaacagcgacttctattttaagaacatcaaaattcccgttccatatttcaaacgtttattacaggactacttcgaggatggcgagattaccgtctatgaaaagaaactgctgaccggaatttcaaaggtgagcataacgccctatatggagcatattttcgcagagttacaagactttacacattatcggggtgggcttgggtatctgtttctggaaagcaaaatccacgaattgctgtcagtatatttgagcgaagtgttggagctgcgaatcctctcgccggaatactgctgcatatcaaaaagtgaacgtgattgcatcatcgaggcaaagagaatcattgacagcgagcttgcctttgcgccaagctgtgaaggactggcaaggcaggttcaaatcagcgtctctaaattatcaaggggattctccatgatgtacggcatttcggttcatgcgtatgttattgagcagcggttagagcgagccgcaggattgttattggagagcaatatgaacattgggcagatagcggttcttgtgggttatacaaagcccagcaacttttctgctgcatttaagaaaaagtatggagttatgccaaaagattatcgagaggccagccgaatcaaataggtgctttgcatacccaaaataaataccgattttgggtagaatgaaattgcttttgggttggatattggacatgaaattgctaaaatgcgtggtgtggttagaacactctaaccacaccacattttcattttctcagaggaggatactggtatgagttcccagaaaaaaagttcccggcttgagggaaaagatttaattactatcggcatctacaccgtcatctatgtcgtgattgttatgctggtggcgatgcttggctttatccccatttttattccgctgatggcggtactgtgccctttgattggcggcatcccctatatgctgtatgttacaaaggctaaaaaattcgggatgactgcaatcatgggtttcctgattggcctaatcatggtgttcttcggcaacggctatcttactatggtaactggtctcgttggcggcctgttggccgacgtgatcctgaaaaaggcggactacaaaagtgcaaagagtacagttctttcctgcggcgtgttcagcatctgggtgtttggcaactttgctcccattttcctgaaccgtgaaagctatatggtaatgttgactgaaggatacggcgctgaatatgcagctacccttaatacatatatgcctatgtggattgcgcctattctgctggttgcctgctttgtgtttggccttgtcggaggtgtgattgggaaagctatttgcaaaaagcacttccagcgtgccggtattgcataatggcgcgggaaattctgctcagcaaaaaaacagaacaagggttacggctcgatccgcgtacaaaactgttgctcatcttcatcataagcatttttgtcatgggtggaacaggcggagaagctatggggctgatccgccttgttctttgtacggttccggctatattgctgcttacctcgaaacaatgtgcaaaagctgtgggctatattgctgtgttttctgctttttatgctgttcaaatttatgttttaccgcaccttacgggaatattgaatttcctcgttctgtttacaacaggattcttctgccgaatccttcccagtgttgcgattgctgcctatgcagtgaaaacaacaacggtcagtgaattgatttccggcatggaaagaatccatatgcctaaagaagtgacgatccccttaacggtcatgttccgcttctttccaactgtctttcaggagtcagaagcaatcagtgacgctatgaaaatgcgtgggattaaacttggagggaaaaaatcttcaaaaatattggagtataagctgatcccgatgattacctgctccgtgaaaatcggtgaggaactttccgctgcggcaattacccgtggcctcggtgctcctgtcaaacgcacaaacatttgccagcttaaattcaattttgccgatgtggtgctgatcttgttttgttgctttgtagtgttttgggcgattgcttccccgataatttccgcaggagggattttgccatgatagattttcaaaatgtttctttttcttatggtgaagaatccagcggcggagggattagaaatgtcaatctcaccataaacacaggggaatttgttttactcacgggagaatccggctgtgggaaaacaacgattacccgtttggtaaacgggctggtgcctcattattacgagggcaatttagagggtgatgtccttctggacggaaaaagcgtatcagatacgccgctttatgacttggctgctatggtgggatctgtattccagaatcccaaaagtcagtttttcaacgtggatacggatagtgaattagcctttgcctgtgaaaatttaggctatccccaggaagatatcctgaaaaggattgaccgtacagtttccgattatcatattgaagatttgatggggcgaagcgtgtttgctctgtccgggggcgaaaagcaaaaaatagcctgtgcttcatcaagtgtattgctaccgggaattatggtccttgacgaaccatcttctaatctggatatggctgctattgatgacctgcggcaggtcttgagcctctggaaaaagcagggcaaaacaattctgattgcagaacaccgcctttactaccttcacgatcttgcagatcgtgtgctgtatgtaaaagatggggagattgaacgggaatacacgcctgctgaatttgacagtttatcggatagcactcgaaaagaaatggggctgcggccgttttctctctcgaagttgaaacccgcgaatcagtatcaggcgcatacagctaaactgatggaatttcaaaatttctgctttgcgtataaaaagcgggaaccggaaagcctccatattccgagtgctgaactgcctgttggagaaacgattgccattatcggcctgaatggcgctggaaaatctactttggcccgctgtatttgcggactggaaaagaagtgtggccttttgcaggttgacgggaaaacccttgattggaaagcccggctcaaacattgctacatggtaatgcaggataccagccatcagctatttaccgaaagcgtgatggatgaagtgcttctgagcatggacaacgaggatgaaactgttgcagatgaaatccttaaacagtttgatctgctggaatataaagacaggcacccgctttctctttccggcgggcaaaaacagcgggtagcgatcgcatctgccattgtgagtaaccgggagatcattgtgtttgacgaaccaaccagcgggcttgatctcaaacatatgtgggaagttgcgcggagtttgaagtcactcgcggatcagggcaaaacgcttcttgttattacgcatgatccggagttggtgatggcgggatgttcgtatgtagtccatatggaaaaagggcaaataaaagaaagctatccattggacgaatccggcagtaaaaaggttttggattttttccgaatccgccagtgaattttagaaattatgaatgtcagggccgccttgactggacagaaagataatgataagaggccgctttactttggcggcctcttgtttttgaagcacagacagtacggctcaatataaggagggcttatgttcaaaaaaatctttgagtacgcagggccatataagaaaaatatgtatgtggccacggttgtcgtactggtcagcgttcttatgggcgtcctgccttttgtgctggcctatcaggtcatttcaccattggttatgggcgattctgttgagacagaatttgttttattgcgtgttataggggttttgatctgtcttgttttgcaggcggttttatatggatggggattatcaatttctcataaagcagcatataacacattgttccggctgcgggtatctctgcaagagaagtttgagaaacttccccttggcattgtggaggaaaaagggacagggacaatcaaaaagctgtttgtcgatgatgtggacagcttggaattgctccttgctcattcagtcccggagggtatcgcaaatttgctgatcccgctggtgatttatgttgctatgttttgtgcggactggaaactggctcttatgtctttggcctctatcccgatcagcctgctctccatggtcattatgtactctgttggaatgaagcgcatgggtccctactatcagtctgcacagaaaatgaacaacacgatcattgagtacatcaatggtatggaggttgtcaaggttttcaaccgggagagtgaatcttacgagaacttccgcaaggatgtaacggactatcgggattataccttggcatggtataaggccgcctggccctggatggcgatatacggaagtctgctgccctgcactgttattctgactttgcctcttggggcatggtttgttctctgtggcataagcactttacctgatttgattttagtcctctgcctttccctcagcattgggattcctctcctgaaagcactgggctttatggagacgattccgaatctgaattataagatcacggcacttgaacagatgttaaatgcggcaccgctgcaagctgctgaggatgatttccacggacaggattttaacatttcttacgatcatgtttcctttgcgtatcaaacgacacagcctggcccagatgggaaaccgataatagcggaaaacgaagtcctccacgatattacccttgtggcaaaagcaggacaaaaaactgccctggttggtgaatccggttctggcaagagcacccttgcaaaactgttgatccactactatgacccgcagaaagggagcatttccattggcgggcagaaactttgtgatatgagcctggaggcattgaacagccgcatttcctatgtggctcaggatcagtacctgtttaacacctccctgctggaaaatatccgtcttggacgtttggatgctaccgatgaggaagtaatggaggcggcgaagaaagcccagtgtatggagtttctggaaaagctgccgcaaggtattcactccatggcgggcgatgcggggaaaatgctttccggggggcagcgccagcgaatttccctggcgcgagcaatattgaaggatgccccgattgtagtgcttgacgaggccacggcctatgctgatccagaaaatgaggaaaaaatggaggctgctattgcggagctggtgaagggaaaaaccttggtagttatcgctcacaaacttcccgctataatgaacgcagatcaaatatgcgttatggatcacggaaagatggtggcaaccggaaaacatcaggagctgattcaagcttgcccagaataccaaaagttgtggaaagcggctcaggacagcgccgagtggaaagtatctactgcaaaggagggaagataaatgtttgcattgatttcaagaatcctgaacctctccgggaggtataaaagccgtattcaggctgcatttctatgtgcatttgtcgagtccattctctccaaaatgccgatcttcatggcgtttattgtctttgccgggtttgctgataatacgctgactggaaagacctgtctgtttgtcggacttggattattagctgttgtagtggttcagacagtggttcactatttgagcgaccgtctgcaaagtgccgctggatttatgatctttgctgataaacggatggagttgggaaatcatttaagaaaaatgccgatgggttactttacatcggggaatattggcaaaatcagctctgttctcagtacggatatggttttcattgaggaagtttctatgagtaccattggcaacatgatgagctatatgctgtctactttggttttagctgtttttatgttcgtactggattggagacttgggctgattgcggtaatcattaccttgctggcatcgctggttgcaaaatatatgaataaggtttccttcaaggaggctgtcgggcgtcaaaaccaaagcgagaatttgacggatgcggtcttgtcttttgctgaaggaattggggttatcaaaagttacaatctgctcggagaaaaatctgacgaattaacggaaaacttcaaaaaatcaagggatgtcaatacgaagtttgagcagaaaatgacaccgtggaccactggcttaaacattctctatggcgtgggtattgccgctatcttcggtttatccgtttttttacatcaggaaggcgtactctccctggcttatcttttgggcgtgctgctgtttgtctttgatctctttggacctctgaaagctctttatggagaagcaacccgactgaccgtgatgaatgccgcattagaccgcattgaagctgttttggacgagcccgaacttcccgataacggaaatcaacatattctgtcacaggcacagccggatcagccagaagtacaatttagcgatgtggccttcgcctatcaggacaaggaagtcctgcacaacatcagcttctctatgcagaagaataccatgaccgcacttgtgggaccgtctggcggtggcaaatccacgattgcgaaccttctggcgcggctgtgggatgtgaaatccggcaaagtgacaatccgtggtacagatattcgggatgtacctctcgccgaactgatggaacagatcagcatggttttccagagggtgtacttgttccaggataccatttacaacaatatcagcatgggtaaaccggacgctaccgaggaagaagtctatgaggctgcaaaaaaagcccgctgctatgattttatcatggcgctgccagatggattccagacagtcatcggtgaaggcggcgctactctgtccggcggcgaaaagcaaagaatctctatcgcccgctgcattttgaaggacgcaccgattgtcattttggatgaagcgactgcaagtgttgataccgataatgaaagctatatccaggaggcaatcaatgaactggtaaagggtaaaacattgcttgtgattgcacaccgcctgaataccatccgtcaggcagatcagattttggtgatctccgatggacggatcagcgaacagggaacccatgacgagcttatggcaaaagccgggatttatcaggattttgtaaatatccgtaaaaagtcctccggctggagccttgcataaaggagacaatagtgatgattcatgcgtccggagaggattatctggaggctgtgctggttcttcaaaagaatcacggtgctgtccgctctattgatgttgcacggcgtgttggagtttcaaaagccagtgtaagctatgcggtgtcggctttgcgtgaagggggctttttaacggtagatagtgattacgttttgcatttgaccgaaacaggccggaatgttgccgaaaaaatttatgagcggcatcagttctttacagagcaatttatcgcagctggcgttgaccctgaaattgcagagcgagatgcttgccggattgaacacgccatcagtcaggacacctttgaaaagatccgggatgcacacaaacaggaaaaataggatactaatgcccgtcgttccaactgtgcggacaagagcagccagtggggaaaatataagcccactggctgctctacatgaaagacaatcatcggcccttttgttttcccctgtacatcacttcagcttatctgcgctcatgcacaggtctatgtaccgttgcgactcttcttcaccctttcctgcaaagtaatcaagaacgcacttggcaacggtctgcggcgctctatcgtggaacacgattccatccagactgatgtccatttcttctgagatcagcgcaaccgtttcaaatttcggattgctcttgcacttttcaatctcaatgacagttcgggtacacatattaagccgttccgctaattcgcgctgcgtgatctttttctgctcccgcttttcgcgaagcttttgggcgaacaggtcaagaaagttcattgtaaatcacctctactacattgtagagtgagcctcaattcacttaaatacacatgaagctcacattgaatgagccgcaaatcacattcagcgagttggaggtaattttatgatgtcacggatgaacaggagatactgctaaggccgctcgcggtcatgtaaaaaagcataagcaccgattagccgtccacttcaaaaagcacgcggctatcccccagacgagctgcactcacgaaagcgagttgcagctctctttttatgcggtttggttcatccgtgatttagcccctcccggtacagtattcgttactcatgttttcactcgcacgcaaggcgctcgttcaggtcatcatgcctgttcgagcgcctttttacgttttcctgtcggctgtcgttctccgccggtgttggtctggttcaccacccacccaacaccgaaacggaggacatattatgtttaacagaaagagcagctatgcgctgaacaagaaagaccccaacgctatcgtttacatggatgccaacgaagccatcatccgcctgacccgcgaggactttgccagcgaggaagaatttctgaaatggaagtccctgtcggatgcagactatcatgcttccgagaaagaggatcatgtctacgctaatcatacccttgcactggacgagctttccgaggaagcagcatctattcccgctgcggatatctgcatggagcaggcgcatgaccgggtggcggaaatccgccgtagcacccaaaaggttacgcaaatcaggaagcacctgacggacactcagttccgcaggatgtggatgtatttcgtggatggaatgacgattgacgagattggaaaagtcgaaggcgtgtcgcatcaggctatttctctcaacattacagcagcaatcagaaaaatcaaaaaatatttctgaggtttttcaaaaacaccttgcaaaagtggcccaaaatcggcgataggtgaagggacattctccacgaagcctttcgttgaacgttgaaaactgaatagaccatgatgcaggcacaaaacccgcgtgatagcggcataaggtgcgccgccacgacgatggcttcaaggaggtgattccggaaaagccatccgagcgatctacgcagccttagacccgattcggcaaatcgggcgcgatgacagcgcggcggataatgaaacttgctcacgccctcccacagacttgagggggaaccctgcggtatgcgccagctctttgaggcagcggtatcgtggagttatgacagccctgccaagggcggcctgcatcatgcccactatccggggcgcgtggcaaataggatggatcttctcaaatggacaagcagagcggctgcgccggtattcgccattatgttatgtggctccaattctacccgcgcagccgcctctcaaagtcagataccatgcgctgacggcctttccgtcagcgcattcatgtgaccttgaggaaacccaccaaaccgagaaaggagatcgccatgatgcagccgacgccaaacgaaacccaaatccacacggatgaactggtggacatccgggaagtatccgtagacaaaaatcttcccaaggaagaacgcattgtcgcctttatccgccagatcaaaaatccttaccgcttccgctgcggcgattttgtggtaaacgcctgctttgccgggaacggcgttacgttggaggaatgtctgcaaggcattttgcgctgagcgacatcctcgcttttttccgcagagagtgctatgatcggtgtggaaaaggatgaaaacctaatagccagataaccactcttttcatgcgggagcagtccgggagaaaggagtgctttttcatgcctaaatacaaagctaccgcttacatccgcctgtcctacaccgacgatcattccagcgaaagcgacagcgtttccaatcagcgcaagctcattgaaaactttgtagagcgtaacccggatattgaggtcgtttccgaaaagatcgacgatggatacagcggcatcatctttgaccgccccgcgttcaaggaaatgatgcaggatgtcaccgatggcaacatcaactgcgtcattgtaaaagacctctcccgcttagggcgcgagtacatcgaaacaggccggtatctgcgccgggtattcccggcctacggggtgcgtttcatcgctatcaccgacagcatcgacaccgcccacgacagcggcgatgatctgaccgtatcggtcaagaacattatgaatgaagcctactgccgggacatttccatcaagacccgttcttctctggacgtgaagcggcgcaatggcgatttcgtcggcgcgttcccggtgtacggctacatgaaagccgaggacaacaagaatttgctcgtccctgacccctacgctgcctgcgttgtctgcgacattttccgtatgcggctggagggcgcaagcgcctccaagatcgcatctgagctgaaccggctgggtattctctccccgctggcgtacaagaagaacaacggtctgccctacgcgaaaaagggctacgcggacaaagccgactgcaagtggtcagcaaccaccatcatccgcatcttgcaggacgaaacctataccggaacgctggtgcagggcaaacagggtacgccgcattacaagatcaagcagatggagcagcgccccgcctccgagtgggtgcgcgtcccggatgcccataaagcgctgattgcccgtcaggattttgagctggtgcagcgcattaagggactggatacccggacttctcccaacgaggatacggtttacctgttctccggtattctgatctgcgggtgctgcggaagccgcatgacccgcaagaccaaccgtgcgaacggcaaggagtaccactactattattgtccaaccggcaagaaaaagggctgcgcccatccggtcatgctgaaagaaagcagcctgatcgactgtgtgcgggacagcctgaaagcctatatcggcaatattgcttctctggaggcgctgctgaccggcattgaccagaccagcatcaatcaggcgcttgccaaggaatacagcgaccacatcaccgacaacgagcgccggttggagcaggtgctggagttcaaggcacggctttatgagagccttgtggggggtatgcttaccaaggaagaatacgcttcctataaggcaaagtacaccaagcaggccgaggacatccgagaaagcgtccgcgttctcaaggaaaaactcacggaggtgctggaaaaccggagtgagcgcaaccgctggatttcacagtttacgcagttctccacgctggaaaccttagaccgcagggcgctcattcacatggtacagagcatccgcgtccgtgggaagaaggagctggatattacctttacccatgaggacgaatacaaaaaggcgttgcagcttctggcgctggcagcgcagcagaaagattacgaacagagaaaggtgggctgagcatggcaaggaaaagcagaaaagaaacggctgcggtggccgtgcaggaggctgacgccgcttgccgcgccgcgatctatgtccgcctttcggtggaggatacccacacgcacagcgtatccattgaaacccagcagatgattattgcccgctatctggagcagtacccggagatcagcgtgtacgatacctacattgacaacggcgcgaccgggacaaacttccaccgtccgggctttcagcagatgctctcagatattgaggctggtcacgtcaactgcgtcattgtgaaagacctctcccgtttggggcggaacaccatcgacaccggctactacattgagcagtatttccgcatccgcaacatccgctttattgcggtcaatgaaaacttcgataccgtcgccccggaggacgcccattccggtatcatcattccgctgcggaacatgataaacgaagcctacgctttggacattgggcgaaagatcagagcgcagcagcggcaggccatgaaggacggcaagttcatcggggcgcgtactccctacggctatctgaaagccgaggacgattgccaccagcttatcatcgaccctgttgccgccgttgtggtgcagcggatgttccgctgggcttccgagggcgctggcctcaataccatcgccgtgcggctgaatgaagcgggcgttctcactcccagccactataagaagatgcagggcaagatcacccacgaaaatttgctcggcagcggcaagtggcaaacccgaacagtcggcgttattctccgctccgaggtctacaccggagatctcgttcaggggcagaccaaaaccgtggatcaccggcaggtcaaggccgatgccgaggaatggacggtggtacgggacacccacgaggccatcatcagccgggaacagttcgcggcggtgcaggaaatactcaatcagaccgccagccgcgccaaggcacgggaggtcaaagcctacacgccgaatcttctcaaaggcaaggtgttctgcgcccattgcggcggcagcctgcaccggcagagaaacatccgcaagaagtccgacgatgtgtacttctaccattgtctgagccagagccgaatcagcaaggatgcctgccccggcgtgaccatccgcgaggatgcgttgctggatatgttggcagatatgcttcaggactcgcttgatacggcgctggggcaatacaccctctctcttgcggagctgccccggcaggccgctgaccgcgctgagctgcgggagaagatcaccagccgcaaacaggaaatccagcggcttcgcagtatcgtgcggagtttatatgaaaacctcgtccaaggcgttctcaccaaggatgaatactttgactacaaggagaagtacgaaagccgcattgccgacctcgccgtggaaatggaacagttggaggacggcctgcgaacgatggatgctcaagcagagcagcaccgggtgctggaacaggatgccgcacaaatcaagaccgaccgggcgctgaccggcgcactcatcgagcggctgatcgaccgcatcgaggtgtcccatgataagcaaatcacggtgcgctatcgtttccagagcgagtttgaaacctatgcggaggtgctggaacaatgcagaaatatgtgattgctctctatatccgcctctccattgaggactacaagtatgacagtctgagtatcgaaaaccagagtcttgtcctccacgaatatgcggcctccatgccggaagccctgaacgcggagatcatggagttcatcgacaacgggtacagcggcacgaattttgagcgtccgcaggtacagaagctcattgagctggtgcgggccaatcaaatcgactgcatcatcgtcaaggatttttcccgcttcgggcgaaacagcattgaaaccggctactttatcgagcgcgtgttcccgctgttccatacccgcttcatttccatcagcgacgattttgacagcagcaaattcaagggtgacaccggcggcatggacgtagcattcaagtatctcatcagcgaatattacagccgcgatatgtccatcaagaccaagagcgccaagtacgccaagatgcagcgcggcgagtatcagagcaaaatctgtccctatggctaccgcaaaagcgccgatggcagaatggagcctgacccggaggccgctgccgttgtgcagctcatcttccagcttgccgccgagggcatcaacgccaccgccatcacgcgagagctgttccgcagaaacatccccacccccggccagtacaaagcggcgcgaggcaatcacacacacgatatttcccgctgtcacgggatttggagtacatccaccattctccgcattttggaggacgaacgctacaccggcgtgtatgtgattggcaagcgggcagttctcgaagtaggcggcaacagaagccgcctgaaggacagagaatcatggtacatcatccccgaccatcacccggccatcattgagaaagccgtgtttgataccgcgcaggccagtcagctccgcttttcacagcccaacaaaaagaagcgggactacccgctgaagggcaaagccttctgcggctgctgcggccatgcactgtcccgcaccatgcagaaaacctcgtattattactgccgccattccgaagcagacgaagaaagccgctgccacaagatgcgcctgaacgccgcagagctggagcaggcggtattcctgacgctgaaaaagcagatggaagccgccgcgccacttgcccctgacggtacgctccgggtggatgcttccgtaccggaacgcaccgaatatgagcagcagatcgaggcactgcaagacggtaagcgcgccttgtatgaacgctatctcatgggcgagattgacctgaacacctacaaggcggaaaagactgcgtgtgacgagctgcttttgaaaacgaaaaacgcctatgccgcagtattggcacaggcgaagcagaaacgggacgaacaggcacggcaggacagccgcatggaagcgtccaaggcaattttcgatgcggacacgctgaccaccgagctggccgagctgctgatcgacagggtgctggtgtaccccgacaagcgcattgagatcgcatacaaaatccaggacatttttgattgaggtggcagtcatgaaaattgctttctattgcagagtggacggacagggctttggctttgtcctccccgatgaagctgacaagctccgcgagtttttcgccgagcatcaggataagcctgcgcttgaaaatccatcaagcgcaagctaaaaatttttgtcgtgtgcttgacatacgggtggcgcaggccgtggaacgtgatcagctcgtcgttggtgcccatgaggccgttggtctccgagaacgtcttgaacgccctgcggatgtaactggtggtggcgaaggagccgtccggccgcgacacgacgtagctgtccgcgaggtcgcgcaggccgagggccgatgcctcccggagcctctgcgaatcgatctcgtggatctctttcaggaaggggagcaggcccaccggatcgacggggatcgtcctcaagtcgtggttcttggtgtccttgatgaaggagcccctgtccttgacgtaggccaccgagtgcctgaccgtgatgagccccgactcgaagtcgacgtcacaccagcgcaggccgcagacctcgccgatgcgcatcccggtgtgcagggcgagcacgaccgcccgcctgaaggtcgagtccggcatcatcgaggtcaccgagttgagcttcggcacgaggtcggagcgcagcgcgttcctgggcctggcaatgaccctgggcgcgagggcgccgtcgaacgggttcctcccgatcgtgtcgttgctgcgcttcagcaggacggcgtagagccgcttgccgagcttgaatgacttgttgagcgtgtccggcgccgtgcccagggcgatcctgcgcctcgaccacgcgttgacgtcgtcggtcgtcacctcgttcacggggaccagacccagctcgtctcgctcgatgtgcagggcgctgtagtggtagtcgtcgcgggtcgtcggggtgatcctgttcatctccaggcagaagtcgatgaacttctcgagcgcctcggaaagcggcagcgcggcgtagtcatcccgctgttcggcgggaagcccggcgccgatagcggccctcgcctcctcggcctcggcgagttccagctcgacctccgacctgaattccgcgaggacgcgcatcgccgccgcctttccccgcgcgctctgcttcagacagggcacgcgggtgttcctggtcctctggaccttcttcccggtcatctcgtcggccaccgtcacgacagcctgccatttgcccttgttcttcctcacgccgccggctccgcatacgcgtaaggttttattgctgcatttctcgttctgcatgtctgctcctaaatccgcagttgattagaaacaggcgggcccacctgcgggaacccggagaggcgacgattcggggctcctacccccgttgattaaatcatcggctgcaccgcgctcctcgaagccgaaaatatgctatctggacagaccgcgctgagctggtaaaatatgcaaatgcggaaatgcgctacttgcgctatctgcgcgtgttttaacaaaataagcacaggtcagggtcattctgacctcgctgggggtcaaggggtcgctggttcgaatccagtcgtcccgaccagaagtttgcaggtcaggcacctagtgcctgaccttttttgttttaatcaccatgattattttgcttaaagcaacaacgttcccgctcgatgtaatcaccgaatcaaaacgtgtacatcagccaccaaaatcgacatttttcgacatgtttggaggctgatgtacacgaatgcgaaatccccgccgcctaaaagcgccctccacatgtctggactctctatgcttacgctggatagacatcgccggaacgggtatagtatcgaaagttttgtcgttaaccagcgggggagtcctgtgggcatcaaaaagaagatcaaaaaggagcttatcggcacttccgattacccgtcgaataagatctttacgatctccaatttcatcacctttacgcgcctgatcctcaccctggtatttctgtacctgtttgtgacggacaacaaccgcgtcatcgccatcgttatctacgccgttgccgcctccaccgactggatggacggtcagatcgctcgcatgactaagacggtctcatggctcggcaaggtcatggatcccatttgcgaccgtgcgctgctgttcaccggcgtcttggggctggtggtccgcggagagctgcccatctgggtctgcgtgctcattattggccgcgacatctatctgggcatcggcacgcttatcgtgcgccattatcaccgtcgccccatcgatgttgtcttccccggaaagattgccacagcgctgctcatgaccggcttctcgctcatgctgctcgggttccccgttattgacggcctgcatcttttaccttcagcccttacggccttcccgggcctcaacggaagctcgatgcccctcggcatcttctttgtgtacggcggcgtgatcttctccatgctcaccgctgtcatctactccattaagggcggagcggccattaaacaggctctcacgcatcccgaggacgaggacatcgactttctgaaccctgaaatcgaagactgattcgttggggtatgattacgtacggttcattatttgcggcacgtccgcgataagttaggggttgtcatggacaacatggttaacaatatgcctcagaatgataagactgctgacgctacctgcgtattccgcgtgccttcaagcgacgtcaccgttcccgacctcatggccaacgtgcgcatcaccgcccccgttctgtccatcgtcaagggtccgcagactggtgccgcttttgagctcgaggatgacgtgaccaccattggccgcgatcccgcgaacggcatcttcctcaatgacatgaccgtttcgcgcagccacgcgcgcattattcgcgagggcctcggcgctcgcatcgaggacttgggctcgctcaatggcacctgggtcgacggtgccatcgtcaatgcagccccgctgcacgacggttcttccgtccagatcggtacgtttacgctcatctaccacgagagcacgccggagcgcatcgaaaccggtgagtagggcatggccgaacgcaactatctgagtatcggccaagtcgtcaacctacttcgaggcgcataccccgatctttcgaactcaaaaattagatttctagaggatgaggggctcattacccctcatcgtacgcctaagggataccgtcagtactccaaggaggacgttgatcgcctggaggtcattctgcacctgcagaagacccgctatatgccactcaacgtgattaagcagcgcttggaaaacgccacggacctgtcaacgctcgcttacgaggtgggcttgctgtccgatgttccgctcaagacggagcccaaggagactaagcaaaagctgcatcctatcgagaccattcccgatatgctgggcgtcgagatttcgtttatccgctcgctcgccgagaacgacctcattcgcatcatcaagagtccgcaaaatcgtgagctcgtcgatggtcgcgatttcccgatcatccgctactgctccgagctgtcacgcttccatatcgagccgcgcaacctgcgtcagtacgtgtcttccgccaaccgcgagtcctcgatgtttgagcaggtgctcgtgagcatgctcggcatggacacctccgatgacgagcgcgacgccaagctcgagcgtgcgtttaagaagcttcacgacctgacggagggcgtgcacaccgcgctgctcaagaaccgcgtttttgagtcgctcaacgccgtggtcgaggacgccgacatcgatgcactcgatgaggaaatcactcgctccgagtcaaccaaggccaaaaacgaagagataggcgcgccggcttcgcacgaggattccctcgtaaagccgctcaaggtcgtcaccccttcgcaatccggcaccgccaccgcgggcaaataacagctgccgcttatccggcaacccattgaaaggtcatgcaatgtacgacttcgaatctcaaatcgtcgacatccccgactatcccgagcccggagtcatctttaaagacatcacgccgctctttggcaatcccgaggcgctcaaagccatgaccgatgccctcgccgagcactttgccggcatgggaatcaccaaggtcgtgggtcccgaggctcgcggctttatggttggcgtaccggtggctgtagcccttggcgccggctttgttcccgcacgtaaacctggcaagctaccgcgcgagaccgtaagtcagagctacgagctcgagtacggcaccgattcaattgagatccatgccgacgctatcagctctaaagataccgtgttgattctggacgacttggtcgcgacgggcggaaccgtcgaggcaacaggtaaactggtgcgagatatgggcgcaaagcttgtcggttacggttgtatccttgagcttgcgtttctcaacccgcgcgagaagctcacaccgtctaatgacgatgtggagctctttagcctggtgacggtggactagccgttacccttagttactggaaaggaagctacatgcgcacagcaaacacgcacaaaaacatggcacgctgcgctgctacggcaaccctcgcttgtgttttgggcttgggcctcgcggctcctgcctacgccgataccgcatccgaccttgccgctgctcgtacgaagctcgagcagatcggtacccaaactcagcagatttacgatgagctcgccacgcagacgcaggcgctcgatcagactgctggcgagatcacgcaaaagcagcaggagatcgccgatggtcaggccaagctctcgacctatgtcgccggcgagtacaaaaccggcggtctgagcctgcttcaggttctgacgggcgtcgatgacctgagcgatatgctcaaccgtctgttctactacggcaaagtttccgataagcaggctcagaccattcaagaggtcaaggagctcaaacagcagctcaccgataagcaggccgagcaggaaaagaacgtcgccaccacgcaaaagaaggtcgacgagcttaacgcccagcaggctgaagcacagaacgtcgtaaactctctggattcacagctgcaggctgagcttgccgctgaggccgaggccaacgccgcgctgcaggccggcatcaacgccagtaccgccgagaaggccacggtgagcaacgagactgccggtgcgaccgagaacaccaacaacggtggccagaccagcaataacaacaaccagggcggcaacactccggctcctacgccggcacctgctccgacaccgcagccctccacgcctgccccggctccgacgccttctgctccgagccagtccgtcgatggcggttctgttgtctcgcgtgcatacagcaagcttggttgcgcctattcctggggcggaattggcccgaacagtttcgactgctctggttttgttagctattgcctcactggtcgctattgccgcctgggcaccacgggcacctttatgggctggacgcgtgtgtccgatccgcagcccggtgacgttgtggtcaactcgtaccacaccggcatttacatcggtggtggtcagatgattcatgcttccgactacaacacgggtgttatcatcagctccgttgccgccggcatgaacaacaactacattttcgtgcgctactaagtattcagataaagcaaacggatatggacctcgtggctttgagtcatggggtccattcttttgcctttagtgcagtccgctatctagttttgaatactagatagcggcccaatcggtctgcaagatggctataattgaatgggaacgattagaaaggaccctctatgagctgggcacttatctccgattcaagctgcaacctccgcgattggcaaccgatcgcaccccataccacctttgcatttgctcccctcaaaattcgagtgggggagcgtgaattcgtcgatgacctttcgctcgatgttcatgagctcaactgcgctgttcaggcggagacgaatgcctcttcgagcgcttgtcccagcgtgggggagtgggccgagctcttcaaattggcagacaagaccatctgcatgccgatctctgagggcgtgtcgggcagctacaacgcggcagccacggctcgcgatatggttcttgccgaggagcccgaccgacagattcatctagtcaattcacgcgcagctggcggcaaaatggacctcattttcttgctgttcgaccgctatcttgcaagcaatccgaatgtctcattcgaggatgcttgcgcatacttcgatagccttgaacagaacagcaaaatcctcttcagtttgtgcaattacgaaaacctcgccaaagccggacgtatccctaaggcagccggcgtcattgccaacaagctcaatatccgcattttgggcacggcgagtgaggccggtaaaatcgaactcgtcgggcacacgcgtggcgaaaagaagatgctcaacaagatcatcgacactatggaagccgagggctttacgggcggtgaggtcatcatcgatcacgttgagaacgaagctggagcccaggcgcttactgatcgcatagtcgaacattggccctgctccaagaccatcatcatgccctgcaacggcctggattcctattacgccgagatgcacggcctgatcatcggctacggcatgggcgtagcttcgggcaaataaagtccaaccaagcaaaaaaacgggcgggacaaagcgacagatggctctttgtcccgcccgttttatacgtcggctagctattaaacccgttgaacttgagatagctcatcaagtaagccttcgaaacaaaggatgaaaccgcgctgcgcacaagcagcgactcacgcgttacctgatgcgccgtatcgggaaccggcgtctgctcgacggaaaacgccgaacgaatcgatgcctcgagctgatcgaccacataatcaaaggccgtcggggcatcgtagctcaaacgctgaatgttaaagagtgcctgcaccgcagcaataggtagcacctgcttaaagatgcagatagcgatcaggcgggcaatctgctcgcggccatattgctttttgaccggagcaggcaccaggccgaccttcacgtagttattgatcatcgatggcgtaatgacaggctgctcaacgcaaatggacagcggctccatccacagcgcaacatactcaataacctggtcgcggtagagcgtcacattgggcaactggttatagcgcggcagactcaacgtattaagtttgcgcacgatatcggactgaataaatgcatcgggcagcacagtgggctgaatatcctcaggcttaatgctgaccgatgtatcggacatcgggataacgcgtttggcgtggttcataaggatcctccgttcattagctatattgtattctaggttatctagtttttcataccatatagccggcaagtaaaagtggttggacagcacattgatgcaccgtccaaccactttgttttaaagatagcaaccttacataagatatattatcgtacttatccacggagaaacgcgtatacgctcgttgccgctatggctccatcagaaacggcagtcacaacctggcgtaaacgcttggaacggatgtcgccagcggcaaatagacctggcgtgcgggtcgccatggaatcatcagtaacaataccgccgtccggcgccagatcgactagatgctcaacgagctcggaatggggctgcgttccggtaaagacaaagataccaaacgagccagggacaaatgactcggtgtgagtttccccggatgcattgtccttaaaggtaatcgtcgttggcatggcttcgcccgagagctcgacaatactagtttggtacctaactgaaatattatcttttgcaagaactttttgaaccacaccatcgggggcacggaactgatcgcggcgcaaaacgatggtcacgctgctggcgatttctgacaagaacagagcttcctcgcaggcagcattgccgccgccgatgacaaaaacctgcttgccgcgaaagaacatgccgtcgcacgtcgcgcaatacgaaacgccgcgaccgcgatacgcatcctcgccaacaaaaccagcagatcgcggcgtggcacccatgcaagcgataacgctcgaggccgacgtatcgcccaaatcgtgatgcaccgtaaacagcgctgcatcggcatcgtaatcgatacccgtaaccatgctccatgtaacctgtgctcccaggccctctgcatgctgctgaaaacgctcaccgagttcggcgccactcaagagcggaatgcccggatagttctcgacttcattggtcgtggcgatctgccctcccgacatgccctgttcaatcacggtcgtcgttaggttggagcgcgccgcataaatggccgcagcatagcccgcagggccgccaccgataatcgcaacatcgatcggctgatgggtagtcatgaagagacctcctgtcgaaagattggcgttctttgcgctcatacccaaatttacgtgaacatgacactcatgcactacaatgataaatcgcgtaacaaagctgaaggggagttatcgatggatcaaacgcagatgagcaatagcgctcccctgcccatgcaagccactccccaaccggagcaaatgaccgtttcacctgcacaaaaacccctagtaaccattgtgcacgcatcggttggatcgggccacaaagccgccgccaacgcgattgcacaagcatttgaacttatccgcggcaccaagggaatccctgaggatattgaaattgaagtgctcgatatccttgattttggacgtattaaattcgacggcaataagaccgcggcttcttttacgggagccacacgccccatttacgacctgacctggcgatatacgcttacgggacatcttctctggggtggcggcacggcatggtcgcgtattatgttccccgccttcaacgaatatattcgtcgccgcaggcctatagccgtggtcgcaacgcacatcacagcagccaatgttgccgtgggcgcccgcgtaattacgggtatcgattacccggtcatctgtgtgccgaccgattacgaagtcgaaggcttttggccccacaaggacaccgacctattctgtgtagccaacgagtttatggccgaaacgctgcgcccgcgcaaggttcccgagtcaaagatccgcataacgggcatccccatccgagccggtttcgattcagattacaaacgcgaagatgagctcagcaagttcaatctccccatagacaaaaccgtcgtattggtgatggccggtgccagtttaccccaaccatacgtgcgtttccgcgccgcgatggaccacacgctccccttcttacgcagctttgaggacatgcactttgtctttttaccgggcaaggataaagaatacgccacccgactcaagacgctcttcgacgccatgaagctcgaaaacgtcacggttctagactacgtggacgacatggcggccctcatgcacggctgcgacctggcaattctcaaatcgggcggactcaccgtcaccgagtgcctgtgcgcgcatctgccgatgatcctgctgggcaagtcctatggccaggaaaaggcaaacaccacgatgctcaccggcatgggcgccagcatgcatgtcaccaccgcacgagaactcatcgtgacgttgcgccatctccacgatcatccggagtcgctcaaggcactgctcatcaatggcgaagtcctgcgccgtccacacgcagccgaggacatcgccatcgccaccatggagcttgcaggtaagccccaaaaacgtaaacgagccttctgccgcttctactggggaggaaagcccgcgcatatccgctagtcgaatgtccgccgctctgccggagccgcccttatatcattccatgctcaaacattctcgcttcgctgcgaaactgcgcgtggaacgatataagggcggctccggcagagcggctgcgtttacttactagcagctacttcggtatcccctccattagaacctgcaaaggtaaaacaggaaaatataaatacagtaagccgatgcgacaaagggacagcccctttgtcgcatcggcttactagaaaagtaaatattgtttcaagcgagtagccgcccgcccggggcttacctatatcgttccacgcgcagtttcgcagcgagcgaagcgacgcgagaatgtttgagcatggaatgatataggtaagccccgggcgggagggatacgagcgcccctaggcgacgccgctggagccgaagcctccgttgcctcggtcggtttcgtctagttcttctacttctatgaggttgaccgtggggacttcttggatgacgagttgggctatgcggtcgcctttgttgatttggatgttgttggagggatccaggttgatgaggataaccttgagttctcctcggtagtgggcgtcgatgaggcccggcgtattgactatagacaggccctgcttgatggccaaaccgcttcggggctggacgaagccggcgtagccatcgggcagggcgatggccagcccagtagagaccagacggcgttcgaagggcttcagaatgcagtcctcgttggagcgcaaatccaagccggcatcggtgggatgggcgtatttgggaagctcgacggtggggtcgagacgctttatgttgacggtaatgttggacatggaatcaccttagcttgtcgagctcttgcagaaactcatcgacgtctttgaaatcgcggtagaccgaggcaaagcggatgtacgccaccttgtcgatcttggccaagcgcttgagtaccatgtcacccaactcatgggacgtaacggccgtcagcgtgcgagagcgcagctcgacctcgatgtcatcgataatctcattgagcttcttagtgtcgatatcgcgcttgatagtggcgcgcatcaagccgacgagcagcttattgcgatcgaaccgctgcttggttccgtccgacttaatgacctcgattgggtcttcgcatcgttcgaacgttgtaaagcgatagttacacgagcaacattcgcggcgacgcttaatggtgttatttgactcctgcatacgggaatcaacgacgcgggtatgtgccttgccgcatttgggacagcgcatggtacctcctcttaaacgataacaagggtaccatgcgcagcgcgataatgattacgaacgagcaggaaccttaagatgcgcaccggcggcgagcgaaccatgctccagatgattgacgttacggatcatgtcggaagtctcttgcgtggaaaggccttcgattggatattcctcggcaagcgaccaaagagaatcaccagactgaacgcgaatggtctcataggtaacgttggaaacggactcggcatacgcggcgtgacgagcgctaaagaccgacgtagcgaggacaaagaagagcgtaagcgcaacggcaacggcgacaatcgtcggaaccttcagggcaacgcggcccggcgcggctacagcctgctgattgcgagcaggctttacggtcaaaggctgaaagccggagcagccaccctgaacaaccgtaaaagtgtattctgcagacgtctcgagcttaagggcgaggtttccctggaccatattcgttgcgttcatcatgttctcctctcgcgtgttttgctgagaacagttttatcaagccgcgcggacaaaaatgtctagcgcgagaacgaatgttcggttattattatcttcgaacagttgttcctgtcaagcaaaattcgaacatttgtttgacatgggtagagaggatgccctgatggctcgcaaaattaccaagcgtcagcagcaaatttacgacttcatcaaggaatatcagcaggagaagggttatccgcccagcgtgcgcgagatggcttctgccgtgggcctttcctcccccagcaccgtgcacgcccatctatctgccctggaggcgcgcgggctactcaagcgcgatgccaccaaaccgcgcgctctggaactctttaacgaggacggttcctctgtctcaatttctaaatctgacgagaccaccgcacctcgcggaacggtctcactaccgctcgttggtcgcgtcgcggctgggattcccattctggccgagcagaatatcgaagacacatttactatcccgaccgaaatcgccactgatcagggttcctttatccttgaggtgcatgggagctcaatgatcaatgtcggtatcttcaatggcgattacatcatcgtccgtgaacaaaagagtgccatgaacggcgaaattgtcgtggctatgattgatggttcagcgaccgtcaagacgttctacaaggagcagggacgcgtacgcctgcagcctgagaatgacaccatggagcctatctatgcaacgaatcccgttatcttgggcaaagtcgtcggcttgatgcgccggttctcgtaatgcaaaaacgcatcaccatctttgataccgtccgcgggcttacgatgatttcaatggcaggttttcacgcttgctacgatcttgcctacctgtacgactgggatatgccctggtttacccagactgtctttcaagacatctggcgcgccagcatcagctgggtatttttgtttatcgcgggttggatgtgcaccctttcgcgcaacaatatcaaacgtgccgccaaatacgccttagcagcactcgtcgtctggttggcaacaacacttgtctcagttgacgattctgttaattttggcatcatctactgcatggccgcatgtaccggcatcgtggcgttgaccgatcccgtccttaagaagatatcggcgagatggggcatgtccctatgccttgtgttgttcgccctcacctggagtatccccaaaacgatctatcctgtcccctacctggcgtggctgggatttccgagcactgggtttgtttcaggtgattactaccccatcatcccgtttttctttatgtatcttgcaggatacttcgccgcacacatagcgcagggaatcgataagaccgtcccaagctgggcctacgccaatcccatcccggcgctcgccagccttggacgtcacgcactccccttttatctactgcatcagcccactattctgggctttttggagctcgtctactcggtgcgataacgcttgagccgcggcgcgatgcgagccggcagcttcgcaacaatacgaacgccgccctcaagatattcctcgtgcaaaagggttccctgttcatgcaccagcgtgatgagggcgccctcgcgatacgggatatcagcggagagcaacacatcggtggcagccgcctcacgagcaatacggtcgacgagatcgtcgagtccctcgcccgtctgggccgagaacagcacggcctcgggatagcgacgacggaaactcaatcgatcaacgctatcgagaagatcgattttattgaacaccgtaagcgtcaaacgctcgccggcaccgatctcgtcaagaacgcgatcgactgcctcgagctggcgctcgtagtcctcgtcagaggcatccacaactttaaggatcagatcggcaccaagaacctcagacagcgtggacttaaaggcatcaacgagaccatgcggtagcttttgaataaagccaacggtatcggtaatcgtcatgccgcgaccgccgggcaggcgatacgaacgcgtcgtcgggtcgagcgtagcaaacagcttgtcctgcgaaagtaccgtagagccggtcaggcgattaagcaacgtcgatttaccggcattggtataaccggctaacgcgactcgaaacgccggtgactcaatgcggctcttggactggacatcgcgacgctgttcaacctgcttgagctcacgacgaagcgcagcgatcttattacgaatgaggcgacggtcgacctcgagctgactttcgccctgaccaaagcgtgaaccgatgccgccgcgcgtctgctccttggcaagatggctccacataccgcgcagacgaggcaacagatattgaagctgcgccagctgtacctgtaggcgtccctcacgcgtctgagcatgcaggccaaagatatccaggatcagtgctgtacgatcgataatctttaccggctcgcccacggctttctccaaataggattgctgcgagggcgataaatcgtcgtcgaagataacaacatcgacatccatacgatgcacgagcccgcaaagctcctcaaccttaccggaaccgataaacgattttggatacggcttaaccagacgctgtgacaaacgcgccacgcactgggcgccagccgtatgggccaggcgctcaagctcgtcaagcgaacgatcgagcggccatgcattgtcgcgccactcaacaccaactaaaatggcacgctcgggctcgggtgccgtgggaacaagggggaaacgggccattaggcagcctcaatacgatgcaggatgtcctcaacgacctcatcgatcgtaaactcgtccatatcaaaccacacgatacggtcatcgcgcttaaaccacgaaagctgacgtttggcatagcgacgcgaacgcatcttgatgagttcgcgagcctcatccatagaaatcacgccattgaaagcatcaatgatctctttatagccaattgcctgcatcgaagtcagggcatctcccagcccctggtccataagaccgcgaacctcatcaacaagaccctgttcaaacatcagatcgacacgcaggttaatgcgctcgtagagcacctcgcgattacgcgtcagaccaaaccatagagcatgataatgctcgcgcggaacactaaactgacttttttgctgtgcataggagataccatcatcatgcatctcgagcgcacgaatcacacggcgcacgttatggggatgaataacagcagccgattctgggtcgcgctcggcaagcagggcatgcagttcttcctcgccaatacgctcggcaagctcctgatagcccacacggcgatcgtcctcaagttcacccgagggaaagtccatctcatcgagggcggccttgagatatagccccgtacctccgcaaaaaaccggcagacaacccgaaccaatgagacgttcaacatgcgcgcgagcgtcagcctgataaagcgcagcagaatatgccacacccggctccacaatgtcgacgagacgcagcggcgccgtacactcatcgggcgtcatctttgcggtaccgatgtccatgccacgatagatttgcatcgcatcgcacgacagcacttcggacgaaagacgagcggccaaacggtcggcaacatcactcttaccaaccgccgtcggaccgacgatcgcaacggcggaaagacctgccccggaagaaaccattagcgcggctcgcccacaacggagccggacaaataccaggtcttggcaacgtcaacgtcaacatcaacgatcttgccaacaagctgatcgatgctgtaaccctcggggataggcgcatgcacggtctgattcttgggactcttgcccagcaggaccgcgtcgttctttttactcgttccctcaatgagcgccggaaccacagtatgaagttcaccctggttatactcatgtgccgtggtctcgataaccttaaccaggcggttgaaacgcccgagaataacctcatgcggcgtaggatcgtcaatctctgcggccggggtaccggcgcgcttggaatagatgaaggtataggcctgggcatagcggaccgtctcggcaagtgaaagcgtctgctcaaagtcttcttcagtctcgcccgggaagccaacgataatgtcagtcgagagcgcgatatcgggcatgcggttgcgaatgcgatcgaccaggcccagatagtcctcgcgtgtataacggcgattcatctctttgaggatccgcgtcgaacctgactggacggccaggtgcagctgcggcataacagcaggcgtctcggccatggcgtcgatggtctcgggcagcagatccttgggatgcgaagacgtaaagaagatgcgctccacacccgtatcgcccacggcacgcagcaaatcggcaaaacgcggcttgccaaacagatcgcgaccatatgagttaacgttttggcccagcagcgtaatctcacgcacgccctggcgcaccaaaccggtcacctcgtcgacaatctcctcgaaggagcggctcttttcgcgaccgcgcacgtacggaacgatgcaataggtacagaaattattgcagcccgtcatgatgggcacccaagcgtgatactgggtctcgcgatgccacggcatgctcatggcatccgtatcctcatgctcattggtgcggatatgatgcttgccatcaaggaacgcctcggcaatgagctctgccacatgtgcgatggaatgcgtaccaaagatgacattgacgttatcgacgttggtgagcaggccctcgccatcgcgctgcgcgatgcaaccaccaacggcaaccacacgcttgcccgaaggcgaaggcggcaggcttttacaggaattgcactggccgtacaggcgagaatcggcggcctcacgcacacagcatgtcatgaagacaacgatatcggcatgctcgggatcgagcgccatgagacagccatacgaatcaagcagaccgctcacgcgctcggaatcgtgctgattcatctggcagccaaaggtgcggataaagtaggttttaccggcaagaatatcgcgtacggaacgctggtccatgtgcataagtcctaacgatggaagggaggcgaatcgaggcaagcagaagctatgccacaggcttaacatcatccatgacgacgttatccatagcagcccgattgatctggtgaacgtagatagaaaggcggatagccgtgcgcgactccccgttaatgaggatgtcggagaacacgggcgcacaggaaatatcaaaaccggttggaatcaaaaaaccgcgcgcgatagcaacggccttaatggcctggttgacagcaccggcaccgacacactggatgttgacgggcacaccatccttgaccatgccggcgatggcgccggcaacggacgcgggcgatgatttgcttgataccttcaggcaatccatgaagaaactcctgcgtttaaaagtacgttttaactgcaataactgtatcgtaccgagtggactcggtaaaggcactattcctctttggcaagatcgaatgtcacggtgattcgatcacgcgaaacgcgaatctttgggtcgccgcaaaggttgagatagtaccgggcggcaaggtcattaaagtcgcgctccacagcacgcgaaaactgtgccatgtcatccttggcaatacgtagcccacgacgatccttcgcgagatcgacaggagccggcgcatgcgaggatgagtcacgctcgcgcagcagacgcgcagtcacaccgcgaacgggcttaatctgccctgccaaaatgcgatgggccgtgcgctcggacatttcaagacccaaacccgaacaaatacggataaagtcctcggcatcagaggcaaggcctagacgatcaacaaccggaagctcgctctcgtcatcaatgaacaggagacgcgacgtatcgagccgacttgacgcctgagcataaagggtcgcggcaatctcagacggagaaccaagatagacatcgcaaccacgcaactcctcgagcgcaaactcacaagcagcgcgaataatattatgcgggccccgagcacagacataacgtccgtcctcatccttgacggcctggggccagctggactgatcggcacgctcactgaggcggtcggccgcaacgctcaccttaaaggctgaaccaagatcgacaccggacgtgaccacacgggcctcgtcggtgttctgcttgatcgaaaacaatgccatgccacgaccgtgaacgccccaacggtccatcttcatgctctcgagcttggaggtaacacgggcatcgaagattcgctcttgcatatcttgcggaacgcccgaaccgttatccagaaagacaagcgtgcggacgccatcttccttggtcgtagcgagatagactttgtcggcgccagcatcgcgagcattacggacgtagcgggtggtttaaagctggccgctgcgcggccagcggactaaagtcttgaatttggtggctcggcaaagccgagcccttatatggggaggccggagctaaagctccggcctcactaactttcctattagattaagtgagcgatcgaggaatcgcactcccctcctctgccgagttaccgcagggcctgccctgaagttacttttcagaacactccgcaggacgcaagaaacccccgccgcacgaagtgcgcagcgggggtttcttgcatgtccgaggacgttctgaaaagtaacttcagggcgggcccggacgataacaaccggctacaagtcgatgtgcgattccttgatcgggaacggctccgcgaagtggcaggcgcagcagtggcccggtgcgacttccttaaactcgggaagcttctcagagcagatgccctgcgcgatcgggcagcgcgtgtggaaacggcagccggtcggcggatccagcggcgacggcgggtcgccagcgaggatgatgcgcttgcgggtcttctggatatcaggatcgggaaccggcacggcagacagcagcgactgcgtgtacggatggtgaggctcgctgtagagcgtcttccagtccgaaacctcgaccatcttacccagatacataacggcaacgcgatcggagatgtgctgcacgacggacaagtcgtgggcgataaacagatatgcggtaccgaacttgtcctggagctccttcagtaggttcagaacctgggcctgaatggacacatccagagcggaaaccggctcgtcgcagataatcagcttgggcttcagcgcaaaagcgcgggcaatgccgacacgctgacgctgaccgccggagaactcatgcggatagcggttgatgtgctcggggttcagtccaacgacgtcgagaagctcgcggacgcgctcaatgcgctcctccttggtacccacgccatgaatggtcatgggctcggagacgatctcgccgatggtcatgcggggattcagcgaagcatagggatcctggaagataaactgcatctcgcgacgcatgtccttgatctcatgcttgctcatctcggcaacatctttaccctggaagaacaccttaccggcggtcggcttggtcaggcgcatgatggtacggcccgtggtggacttaccgcaaccagactcgccaactaggccaaaggtctcgccaggataaatctcaaaagagatgtcgtttacagcagagacgacgcgcttggaaaaacgcttggcgaacatgccggactcagcggggaactccttagagaggtgctcgaccttcagcagcggagtacgctcgttggtatctgccattacgcctcgcctcccttcttggaatccatgcgcgtacgggacgtctcaggagcgttcttgaggaactcggggtcaccggaatagtggcacgcagaatagtgaccggactcggtgacaacacgctcggggcgctgcttgcggcacttatcggttgcataagggcaacgaggcgagaacacgcagccctcgggcaggttcattagcgaaggcggattgccgtgaatcggcgtaagcggcttcttctcatcgatggcctgctccgggatggagcggataaggccccaggtgtaggggtggcggctctcgtagaagatttcctcggcagtaccgaactcgacgggacggccggcgtacataaccatgatcttgtcggccatatcagcgacaacacccaggtcatgggtaatcatgatgatggcgttgccgttcttctcctgcatttcctgcataagctcaataatctgagcctggatggtaacgtccagggcagtcgtgggctcatcggcaatcagaatatcgggatcgcaggcaagagccatggcaatcatgacgcgctgacgcataccgccagagaactggtgcggatactcattgacgcgcttctcgggttcaggaatgccaacgaggtccaaaagctcggtggcgcgcttgagcgcctcctgcttggagtaaccgcgatgcagacgaaggccctcgcccacctgcttgccgatcttatagaccgggttcaaggaggtcataggatcctggaagatcatcgcgatatcgttaccgcgaatgtgctgcatctcttcctcggtcatctcaaggatagaacgaccgcgatagcgaacgtcgccgccctcaatctttcccggaggcatcgagataagacccatgatggtcatggcggtcacggacttgccagagccggactcgccgacgacgcccagggtctcgccgcgatcgagcgtgtaggagacaccgtcgacagcgcgaacaatgccatcctcggtgtggaaatacatcttaaggtcatcgacctcgagcagatgctggccctcgggaaccggctggtccttcaggtccacatagttcttgttcttcttcatccttatgcgtccttcatcttgacgtcgagggcgtcgcgcagaccgtcacccagcagggtgaaggcgagcaccgtcgagagaattgccagaccgggcatgatcatcatccagggagcggtcagaagatactgctgaccgtcctgaatcatggagccccacgaaggcgtaggcggaataacgcccatgccgaggaaggacagagcggactcggtcagaatggcgccaccaatgttcatggtcgcgtagaccacgatggaggcgacggagttcgggaagatgtgacgcacgacgatacgagcatcggatgcacccatcgcgcgtgcagcgtcaacatagtcgttttccttgaccgtcaagattgcagagcggaagacgcgcgcaatcgaaggccagccgagaataccgatggcgataaagacgttctgaagaccacggccgataacggcgatcatggcgacaacgaacagcacgtacgggaacgccaggaagatgtccgcacagcgcatgatgatcgtatcccagatgccgccgtagaaacccgccagagcacccatgaccagaccgatcagcgtggagatcgcggtggccataatgccgacggacagcgaaacacgtgcaccgtagataacgcggacgagaatgtcacgacctagggcgtcggtgccaaacgggtgctcggcacacggagccagcagcgacgtctgagccatggtggtcgagtcggaagccgtcggcgaaccgagccagggcttagcccacagatctgcggtcagggcaaccacaacgacgatgatgatccagcagacaccgataacggcgagcttgttcttacggagacgcttaaaagcgtcgccccacagcgtgcgggacttggcgggagcagatgcggccttggtggcggtagcctgctcctgagactgagaatcagtttcctgcatgagacgtacctcccttaggccttatccgacggaccgccaaggcggatgcgcgggtcgaggaatgcatagctaatgtcgacgagcaggttgatcaccatgacgacgacgacgatgagcgtaacgccgcccataacgatgggccagtcacgcatgctaatggcgcgatagacctcatagccgataccgggccagttaaagaccgtctcggtcaggatggcgcccgaaagcatgccgccaaagtcgacaccaatataggtaacgacggggatgagtgcattcttaagcgcatgcttgatgatgatcgcgcgattggagagacccttggcctttgccgtacggatgtaatcctggttcatgacgtcaagcagctgcgaacgcataatgcgggcggcataagcggtcgaaaccgaagccagcgtaatggtcggaagcacatagtgcatccaatcctgatactgagagctggaaccgccggcacccgagatcggcatggagaatgcaccgcccgtggcgtccttgagaatgacgccaaagaacagctgcagcaacataccgagccagaaagccgggacggcaacgagaatcgacgtggtgagcgttaccaaaatatcccagaaggaataacgcttaaccgccgaaatgatacccgcaccgatacccatgattgcctcgagcacgatggcgcacgcggcaagtttgaccgtatacggatacttctgggcaaagatttccgtaaccggcagcttgcgctgatacgaattgcccagatcgccatgaagcaggccgttcatgtaatacaagtaacggtccacgagcgacgtttgaacggggtcgccgttctcgtcaaggatcgcgttgccgtcctcgtccgactggaccaggtgatagcggacgcgaagctgaagctccacctcgggggacagagccttgtctccaccgatcagcttgatcggatctcccggcacgatattctggagggcgaacagaatcagcgtaacgcccaaaaacaccgggatgaactgaagcacacgtttaacgatgtacttacccataccactcccctatctagggattaacctaaatgggatgccgatcgccagaccggcatcccaaaattaccatcagccagtttaccccaggttagggagaactgtatgtttcccatgaggtctacgtaaatacttgaccctcacggaagctgcaaactcttaggcgagctcagcggtacccagctcggcatgcttctgcggatcgacatagaggtgcttgatgcgatcggagccgacgatggtgtgcgtgtagaacataatcgggatgaccgggcagtcggcagcgaccattgcgtcggcctcctgcatcttagcgacgcgctcctcgtcgtcaacaatagtacgagcctcgtcgaccttggcgtcgaactcggggttgttgtaaccggagcggttatcgccaccgagggagtcggagtggaacagcggatacaggaagttgtccatgatcgggtagtcggcaatccaacccagacgaccgaactgatagttaaagttctgatactgctcgagcagggcagaccactcaggggtatcggagacagcggtaacgccaaccttggcgaggtcgccgatgatggactccatgatctccttgtgaccgccgtcctggttgtaggaaagggtcacgctaatgccacgatccccgttagcgccagcgggagcaaccttgtcgaggtactcgttagccttgtcgacatcgtaggcgcagaactcccatgcgccctccttgtagccatcgatgcccggaggaacaatgccgtcggcaggggtacgggtacccttatagatggtcttgcagatggcctcacggttgatggccagggagatgcccctgcgcaggtcggcgttgttgaacggctcggccgtggtgttgcaggtcagatagtacgtggaaggctcggcgccgagcagcatgcgctcgccgtcacccatggtgtagccgtccttggacacgccgcgatccttcttggcggcatcgatctgagcgacgggaacgtcgcagacatcgaggttaccggcctggaactccttgtaagcagtctccatgtccttgatgacctggaagtggatgccatcgatcttggccttgtcgccatagtaatcgtcgaacttcttgaggttgatctcctgaccatcctcccacttgccgtccatcatgaacgggccgttaccgaccggtgcaagatagaagctcttgacatcggactcggcgcactcgggaaccggggccagagccgggtgagaggcgacgaaggggaagtcggcgtaagcggaagacagcttgacgacgagggtctcatcgtcggggcaagtaacaccgctgagctcggtagcgttaccggcaagcaggtcgtcatagccctcgaccatagaaaggtgataggagacctcggaagggccgtactcggtagcgatggccgacttggtgttgaccagacgctcccaaccgagcttgaaggacttggaggtaacgtcgtcaccgttgtggaacttggccttcttgatcttgaaggtgaactcggtggcgtcgtcgttggcctcaaaggactcgcaagccagcggaacgatctcgcccttctcggcgtcataagaggtcagagcatcaaagagctggtactcgacctgagtgccctggtcctcctggacgttataggggtcgatgcagaccgggttgttgatgtagaagttcagcgtcgaaccggactcagaaccggaagcgtcgccgcccttcttgccgcatgcggcaagaaaagccatggagctcgcagcaagggtaccgccgacaaaggcgcgacgacccataacgggctggtggaacatagaatcagccatgccatcctccttatgagataggacaaagtaagttcggtcgggcaacgtcaagacagcccaatcgaaccattcaaacgcggtccgccgttttggctggttatacaaagcggaccaacgtattgcaatacagtagcgcattttatgcacgatttggggctaattccggttaacggtcgagattttctttagttgggcgaagtatatgaggatattttgactctgttacaaatatgtaaacaaaatgggtcccgcacttgcgggacccttttcaagtatttatgcggttcgtgattagtagcccacgatgccctgcgggaagaagaacatgcacagcacgacgcacacggcaaacacgacagccatgatgacggtcaggcggtcaaggttctgctccataacgcccgtggcagagctggagttatacagcgagctggcaatcatatccgaaacgccggtacccttaccggaatgcatcaggacgagaatcgtcagcgccacggcagaaacagcccaaacgacaaacagaagaatctggaacggacccatagataagctccttaatagaacagttcaaactccagtactgtaccacaatcccccgctctcccctacctgccactcaaggacggggtggaaatggcagaaataccaaaaagggggttgtccggttgtggacaacccccttgctagaaaacggtatttgttttctcttaggcctcggtggcgagcacgcggcccgtcatctcggcggaaggctccagaccagccatggtgagcatagtcggggcgatatcggaaagacgaccgtcctcgataccggtgagctgtgccttctcatcaacgatgatgaacggcacgcggttggtggtgtgagccgtaaacggatgcttggaaccgtcggaagcaacgtcaaacatgtgatcggcgttgccgtggtcggcggtaatcagcgcaaagccgcccttggcgagaatcgccgggacaaccttggacagggcatcgtcaacagcctcgacagccttaacggcagcgtcgaagacaccggtgtggccaaccatgtcgcagttcgcgaagttcacgatgtagaaatcagcgcgatcctcgttgatggcggcgacgagcttctcggtaacctcgggagcgctcatctcgggctgcagatcgtaggtagcaaccttgggggaagcgacgagcacgcgctcctcgccctccttgggctcctcgatgccgccgttgaggaagaacgtcacgtgggcgtacttctcggtctcggcagtgtgcagctgcttcaggccattggcggcgataacgtcggccaggacgttctcggggaatgtcttggggaaggcgacctcgacgtcaaacgtcggatcgtactcagtcatcgtcacaaagtgcgagagcttgatctgctcgcgctcaaagccgtcgaactccttgtccgtgaacacgcgggtcatctgacgggcgcggtcgggacggaagttgaagaagatggccgcgtcgccctcgtggatgccctcattgtgggcagcgaagggctcgacgaactcgtcgccgcgcggatccttctcgtagtaggccttgatgccggcaacggggtcggtatcggcatcggacgcattgaccatgacgtcgtaggcacgctggatgcgctcccaacggttgtcgcggtccatcgcccaataacgacccgagacggtggcaacgcgagcgtcgcaaccggtctcctcggaaatcttggccaggaaggcgcagaactcgctcatgtagccagcaccggactgcgggtcgacgtcgcggccatccatgaaggcgtggacacgaacggtcttgacgccatgctcggcagccatcttgaccagagcctcaacgtggttcatatgagaatgaacaccgccagggctcataaggcccatgaggtggagagtcttgccgtcagccttgacatcgtccatagccttgacaaaaacctcgttcttggcgatggagccgtccttgatggcattgttgatgcgcgaaagctcctggaacacgatgcggccggcaccgatgttgaggtgacccacctcggagttgcccatctggccgtcgggaaggcccacgtcctcgcccgaagcgccgagcgtggtgtgggggtacttctcgtacaggctatcaaggaagggcgtcttggcagcggcgacggcgttctcgccatcggccggagcaaggccgcaaccatccatgatgatcaggagtgcaggaagatgacgttgtgccatatgtcctactcgcctgccttgacgaccatagaggcgaagtcggcagccttgagcgaagcgccgcccacgagggcgccgtcaacgtcgggcttggcgacgagctcggcgatgttgccgggcttggcggaaccgccatacagcacgcggatgccgttggcgagctcctcgccgaacatctccttgagggtctcacggatagcgccgcagacctcctgagcgtcctcggcggtagcggtcttgcctgtgccgatggcccagatgggctcgtaggcgacgacgacctgcttggggcaggtgatctcaaggccagcaaggccagccttgacctggttcacgacgtgctcgacataggtgccagcctcgcggacctcgagggactcgccgcagcagaagacgggaacaagaccggcggaaacgagagccttagccttcttgttctgatcctcgtcggtctcgtggaagtagtcgcgacgctcggagtgaccgatgatgcagtaggtgcagccagcggacttgagcatgtcgcaagaagactcaccggtgaaggcacccttggcctcccagtacacgttctgtgcaccgagggcgatgggggcagcctgaatgcggtcatgaaccgtggtgatgtcgatggtcggagggcagacgagcacctcgacgccagccggaacctcgggcagagcctgagccagctcgtcggcgagcttggcggcctcggcgacgtcgttgttcatcttccagttaccagcgataagaagggtgcgattaggcatcgagaagcgcctccactccgggcagggccttaccctcgacgagctccatggaagcgccaccaccggtggagatccagctcatcttgtcggccaggttgaacttgttgacagctgcgacagagtcaccaccgccgatgatcgaggtgcagtcagcctcggcgagagcctcggcgatagcctgggtgccgtgagcaaagttgtcaaactcgaagacgcccatggggccgttccagaacacggtcttggcgcccttgacagcctcggcatagagctcctcggtcttgggaccgatgtccataccctcacgatcgtcggggatagcgtcggaagcaacaacctcggggacagcgtcctcgccaaagtgatcggcaacacggttgtcgatggggagtaggatcttgacacccttctcctcggccttcttgagcatctcgccggcgcgctcgacccagtcctcttccttgagggactgaccaacggacaggccctgagccaggaagaaggtgtaggccataccgccaccgatgatcagggtgtcagcggagtcgatgaggtgatcgagaacgccgatcttggaggaaaccttggaaccgccgacgatggcgacgaaggggcgctcgggctcggcgaagatgccggtcagcgtgtcgacctccttctcgagcaagaagccggcgacggcaggcaggtaagcggcggggcccacgacggaaccctgggcgcggtgagcggtgccgaaggcatcgagaacgaagacgtcaccataggaagcgagcttcttggcgatctcgggatcgttcttcttctcacgcttgtcaaaacggacgttctcgagaacgaggaccttacccggctcgacggcggcgacagcctcagcagccttctcgccgtaggtgtcagcgacaaaggcaacgtcgagaccagagagctcagcgagcttcttggcgacgggctcgagggacagctcgggctggaagccggtgccctcgggacggccgaggtggctcatgaggatgacgcgagcgttgtgctcaacgaggtagttgatggtgggcagggcagccttgatacgggtggtgtcgccaacgacgccatccttgataggcacgttaaagtcaacgcggacgagaacgcgctttccgtcgacatcgatgtcgcggacggtcttcttggtaaaggccatgtttgcttctacctttcgtacgtgtctgcctcccattacggcagacgatttcttataaaaagggcgcgaccctagggtgtaagccctataaggccgcgcccttctttagacgctcaacgagctattcgctaaaagctaaattaagcaacgaacttctcgaagtacttgatggtgcggaccatctgagaggtgtaggagttctcgttgtcgtaccaagaggtgacctgaacgagggtctggccgttgccgaggtcagagcacatggtctgagtggcgtcgaagatggagccgtgggtctcgccgacgatgtcgcgggagacgatctggtcctcgttgtaggcgaaggtctcggggatggtctcagcgtaggccttcatggcagcgttgacctcgtcgacggtgaccttcttgtcaacgacggcgtagaggttggtcagcgagccggtcggcgtcgggacgcgctgggcggcaccgatgagcttgccgttgagctcggggagaaccaggccgatggccttggcagcgcccgtggtgttcgggacgatgttctcggagcaggcgcgggagcgacggaagttgcccttgcgctgcgggccgtcgagcggcatctggtcgccggtgaaggcgtggatggtggtcatgatgccggacacgatgggagcgaagtcgttcagacccttggccatcggggcgaggcagttggtggtgcaggaagcagcggagatgatgttgtcctcagcggtcagcgtctcatggttgacgttgtacacgatggtgggcagatcgctgccggccggagcggagatgacgaccttcttggcgccagcgttgatgtgggcctgagccttagccttgctggtgtagaagccggtgcactcgagaacgacgtcgacgtcaaggtcgccccaaggcaggttgttagcgtcggcctccttgtagatcttgatctccttgccgtcaacggtgatggaatcctcgccagcaacgacctcgtgatcgcgagcgtagttgccctgcgtggagtcgtacttcagcaggtaagcgagcatatcgggagaggtgaggtcgttgatagcgacgatctcggagccctcatgaccgaacatctgacggaaagccagacgaccgatgcgaccgaagccgttaatagcaacctttactgccattgtgtctcctttcgtaaggcccccgcgagctacagcgcccgccgttgaggcccacaaactaaccactcgcctaatataccttttttttgacttgaatttcacgagaatgctcgaaattgaaaatcaaatttacgttaaaacgttttaaagaataaaatagcagctaaatccgtatataagtcgatacttcaaactacctgtttgcttcaatgagcttttcaagcctcaaaacgcgatggtacagggcagacttcgacaagggagggtcagccatctcgcccagatcgcgcagcgacagatcgggatagcgctcgcgcaggtcgcaaaagactgccaaggcgtccggaagcgtgtcgcgcaaaccccgctgttcgagctcatcgatcaacgcaagctgatgctgggcggcacccgcacttctggtctgattggccagttcggcattcacgcgacggtttacgtcgttcttaaccaatttgaccgcgcgcgcctcctcaatctcggcaacgctgcgcttggcaccaatcagctttaggagctgctcgatctcctcggcgctcttaatgtagacagcaaaggatccgcgccgcgcgttaacgcgcgcatggaccccaatctgctccaatagatcgcaaagtccccgagcatactgctcgccctgcaccgcgatctccaaatgaaagtcgccgcggggatcggccacgaaaccgccggcgatgagcgcgccgcggatgtaggcaagcctgcagcagggacgggcaacgatgtgccggggaacaccagcgacgagccctcccctgcggtcgagaatgcccagcagcaccagagccttgtccaggtcgggctgatcgggcagggtaatgagatagttacggaccttatgcaagaccgatttacgaacggtgaattccgttttgagcttaaggatgcgatgcgtcagtgtgatcatcgtgcgcgcgacggcacccgtctcggtcgcgaccgtcaaacgataccgcccggagccggccagcgaaagtgtaccgctcacacgcgtcagggcggcaagcgtcgacaaatcgcagtattcacattcgggttcgcagcgcgcgagctcgtcacgcacctcggcggtaaacgacatgcaggcctatgctttcgtgttggcgcgcgacaggtcgcgatgggaaatgctcacgtgatattgggcgccttccaaataacgtgccgtggcctcggcgatggcaacgctgcggtgttgaccgcccgtacagccgatggcgatagaaagctgcggcttgccctccgcgatatagcccggcatcaccgtatcgagcagctgcgtccaggccttccagaactcctgggtcttgggatggtccaaaacaaaatcggagacctttttatcgagaccggtcatggtgcgcatctcgggatcgtagaacggattgggcaggaagcggacgtcgatcataatgtccgcctcgacgggcatgccgtgcttaaagccaaacgagaacacgtgaacgtccatgagctgctggtcggacaactcggagaacgccatgcgcaatttattgcgcagagcagaagtgcgcaagcggctcgtatcgataatcatgtcagctcggtcgcgaacgccctgcagctgcaggcgctcgcgctgaatcgcatcggccgtagtctcccccggcttggcaatgggatggcggcggcggttttcgctataacgacggatcagcacctcgtcagaggcctcgagaaacacgatgtcacagctcatctcgcgctcctcgagcgcggcaacggcatcgagcagctcatcgaacaagccctggctgcgcaggtcgcaggtgacggcaagatgcctgcccacgcccgtattgatgccgacgagttcggcaagctgggcgatcagacgcggaggcaagttgtcgatgcaaaaatagcccatgtcctcgaacacatgcatggcctgcgttcggcccgatccggacattccggtgatgatgacgatatcggggatgcgctccgagcgctccgccgcatccatggcatctcccttttgcatgtgtgcctcctaaaacaagcgcgggacccggccagcggatcccgcgcgatcaattgcctttattgagtataccgccccaagcggatacgaggcctgtcttacgcctcaagcgcagccttgaaccaacttgtaatactcgtggggtgcgtgatggcggtgccgacgacaacggcccaggcgcccgcatcaatcgcggcgcgggcctcctcgggcgtgtgcacgcggccctcgcagatgatgggaagaccggggaattcctcggtcgcctgacgcagaagcggcagatcggggccatcggccatggtgcagtcgatagcggcaacaccatgagaaagcgtggtggacaccaggtcgaagcccatgtcgacagcacgacgaatatcctcgatggtggcacagtcggccatcaggagcacgccctcctcgtgcagcgggcggaaggtatcctcgaccgacttgccatcgggacgtgggcgatcggtggcgtcaatcgccacgatatcggcacccgcagcaacgcaggcgcgagcgtggcgcagcgtcggcgtgatgtaaacgccctcgtgcccatccttccacaggccgataacaggaacctcacagcgacccttaatggcggcaatgtcggcaaggccctggcagcgaatggcggcggcaccgccgagctcgcaagcgcgagacatttgagccatggtctcgggcgtacgaagcggctcgcccatatacgcctgaacgctcacgacgagcttgcccttcagggattgaatcaaaggatctacggtcatgttcgactcaacctttctaaaaacagccttctgagacaccgcaccttgacgttcaaaccgtcgctcacgtaccgaagtacgcttcgctcctctttcacgtcaatctgcggcacctcagaaggcgcacttggtagttatgtttacttcaacgatgcaagaaggtgttcggcggcaccgatgagtggagcatcaccctccagagaaccgataaggatcggcgtgtcctgaagcggatcgagcgcctggctggcatagccctcgtgcaccgaatccttccacgtctgcgaacgccaatcgggaccttggtgaatcacgccgcccgaaagcacgatgacctcagggtccagaatgttagcgagcgagcccaagctggcacccagcgcaaagccggcgtcatggatgacctcggtcgcctttgcgtcgcccgcacggcacaggtcgttcacgtcgcgaccgaccgaaggacggctggggtcgacgcgaccgaagcgctcatcgtacatacgaccaatggaagtgcccgaagcaaccgactccagatggccagaacgtccgcaggcgcagggaatgccagcggcagccgagcactcgatgtggcccatatgaccggcagcaccatggaagccctgcatcacgcggccgttctcgacatatgcgccgccgatgcccgtaccgatgcccagacacaagacggagaacttgcccttgccgacgccccagtgggcctcgcccagagcatgagcctgcacgtcgcccaccacggcaacgggaagaccaaggtcttcgcgcagacgcggccccaactgaacgccggaccagccgggcatgatctcgttggcatacgcgatggcgcccgtcttgggatcgacgacgcctgcggcaccgataccgacaccgaggacctcgacatcgggattcgcctcaagagcggccttgatggacgcctcgatacgttggaagacggcctcgccgccctcctgggcctcggtaggaacctcggcctcaaatacgggatggggcgcactgccgtcagccgggtactccatgatggcggtcgcgatcttagttccgccgatatcgacagagcagacgtacttgttctccatgtcgttctccttcggagacaaaacaactacaggaaatgaaggcggtgttatcgccgcagcatgataaaggtttcccaggtgcccgaggttggggtgaaagtggtcgggcgttgacctaatgggtcacgcccgaccacttgagccccaagatcgagtgcctggggaagctttacaggagaccgttgtcctggaggaccttcttaatcgcctcgacgttctcgccagtcatggccttcaccgggcgcggcatggtcgggctgtcgaagatacccatgaggttcatagcggtcttgaaggcgccgacgccaccggcatagccctggacgcccgaggtgacatcccagatgtgggaaatctcgttgaggcgatcctgctcggccttgacggtagcccagtcgccggcctgagcggccttccactgacgcacgtagccctcgggctcaacgttggcgagacccgggacggaaccgtcggcgccgccgaggtaagcaccgtcgacgacgacctcgtgaccggtgaggatgctcatcgggtggccgttcttctcgttctcctgaacgaggtagcggaacgagatgtcatcacccgaggaatccttgacgccggccaggacgccctcggcgccgagcttggcaaggagcttccaagggagcttggtgtggacgcacacggggatgtcgtaggcgaagatgggcaggtcgagttcctcgtgcaggatgcggaagtgctcctcgacctcggtcatgccctgcagggcatagaacgggcaggtggcgacaagcgcatcggcgcccagctcctgagcgaccttgccgtgctcgatcatgcgctcggtctcggtgtcgatgatgccgaccagaacaggcacacggtgatcaacgatgcgcacggcctcggcgacaatctggcgacggcgctcgtcggtggagaagacgacctcgcccgaggatcccaggaagaacaggccatcgacgccggcatcgatcatacggttgatgctgcgctcaaaggaggcaacatcaagctggtggtcttcggtatcgggaacaacgacgggagggataacgccggtgaatttctgagttgccacaagaatctccttagttgtctggcgggcggccctatgccacccactcttgttggcagtgtccaggccgtctaggccaaagaaaacgggtagaacgtttggttaaagaagtcgacgacttcgttttcgaacgcattgatgcgctcgtgagcgtatttggcataaatgatatgccttcggtcacactcaagaccgttgaatacggcaaactgacccttgggatcgctcacggcgtccataagcgatgtgcccatgagcaccgatccgtgcacccgagacgacagagcctcgaggccaccggggattggattggcaaccgccgtgcaggcaaggcctcgctcgtccaaggcggaaaccgccagcgcaacaccgccgccaaggccctcgccccacgcaaaaatgcgatcggggtccacgccatcaagattacgcgcgaccttcgccaacgcgcagccccaacgaacgcgcctgacaaaagcaggcgaggtaatcccctgctgcagatcgctgagtccaatcgcctcatcgtccagtgcaagcacggcatatcccatggcggcaaatctcgtcatgtgatgccagccgcgcacaggccgatcgatgtcgtggaacatcaggcacagcggcacgcgctcagatactcgggcacgaccaacaggctcaatcaaacgagcgtggaccgcatcgtcaccgagcttaaaggaaacctccgagtaacgggcgcaggggttaacaaagtcaattgccgtaatggccaggccttgaatctcaagattcgaagcgcatgtctctaaatcagaaacatctgcttggacatcaccgtgccagtcccgatattctgcgagccttgacgaaaccgttccaggaattcccacgagcccggggactatcagctcgtcaacattgctctcgcacttagacatgagcctcccctccctcacagaaaaacggaatgatcagatcgtcaaaatcctgaatctcctcgtggccaaagccttcaaagaactcatgacgcttgtcgcaggacaggttgttgtacaccgcaaactgcgttgccggcggacagacgatatcggccgtgcccgtgccaaacagcacggggcacttgaccatgggggcaaaattcttggaatcgaagtacgccagcttggcataggcttcctcgatacgagtcgagtcctcgtcaaaccaacgcgaccaatagcgcagaccctcgtaggcaatatcgtcggcgtccagatcccaaaccaggcggaagtccgacaggaagggatagaggatggcggcgcgattgataagctcgctgttaagcgcgcaggtcgcaatgcccaaaccgccgccctgcgatgcgccgttcacatacacgcgggtaagatcgatgccctcgagctcgcgaacgatacggcacagaatgcggatatcctgatgtaggcggacatagtagaggttggccgggtcgccgtcgataccggcgacgatatggcccgcgaccgtcgtgccctcaaatccaccaatgtcctcggaggggcctccttggccaggacaatcgagagcaatgagcaccatgcccatgcccgcaaacgacgcctgctcaaaccagctgcggctcgcacccggatatccatggaactgaagtaccaatggcacgggctcgtccgagacgggtttaaggcacttggcatgcaggcgcgcgccacacatgccggtataccagaggtcgaaaaaccgacaggttgcggaatccgcaaccgaagccgcctcaatcgcgtagtcgagctcaacggcgtcggcctcggccatgcggtccttccaaaagagatcgaaatccgatggacggggcatagcgcctcgatattcaccaaattgctgttgtagctcctgagcacttggcatggctcgtgaacccaacctttcgaaatcgcaacggaggtgcgcccggcaagggaaccgggcgcacgggagggaaagcgaggctactcgccgagcttgggatgcagcagcgacggcgcagcgccgagcagcatcttggtgtaggggtcctgaggttgctggaagacctgcttggcctcgccctgctcgacgatcttgccgccattcataacgatgatgtcgtcagagatatagcggaccgtctggatgtcatggctgatgaacaccatggccaggccgagctccttcttaaggtcggtcagcaggttcagaatctgcgcgcggaccgaaacgtccagagccgaggtgggctcgtcggcgatgatggcatcggggttcagcgacagggcacgggcaattgcgacgcgctggcgctggccgcccgaaagctggccgggaagaacctcggcggcggagctgggcagaccggtgagctccaagagctccttgacgcgcttctcctgctcggcctcggtacccaggttgtggacgcgcatggggtcgagcagttgctcgcgaacgaccatgcgggggttgagcgccgtggctgggttctggaacacgaccgagatgacgcggcccatgtggcgacggtcctcggcggtacgcttggtaacgtccttgcccttaaagtagaccttgccgctcgtgggggcctgcaggccgcacatgacgttagcggtggtggactttccgcaaccggactcgccgacgatgccgatggtctgtccgggcatgagcttaatcgttacaccctggacggcgtgaaccaggttggggtgcagaatcgagccggtacgggtcctaaaggtgacgtggacgtcatcaaggaagatgatcggctcgacgccgttgactgcggtctcgctcatctacatcacctccgcgtgaggggtcaaaccatttgccttgagcacctcgtcggggagctcggaatagaagtgctcggtgccgggcacgcgcttgaagaccggacgggtgtccaggccaatgcgcggatggctcgagcggggcgcgaagcgatcgcccttggggaaatcgcgcgggctcggaacggcgccgggcacctggtgcaggcggcccgaaccgctctcgatggacaggacggaacccagaaggccgcgggtgtactcgtgaatcgggttggtgagcagctccttggtgggcgcctgctcgataacctgaccggcgtacataaccgtgatgttatgggcaacctcggcgaccagcgccaggtcatgcgaaacgaagatcatggcaaagccgagcttggcctgaaggtcgttaagcagcttgatgacctgcttctggacggtaacgtccagagcggtcgtgggctcgtcgcagatgaccagcttggggtcgcgggtaagggccatagcgatcagaacgcgctgacgctgaccaccggaaagctcatgcggatagctctcgagcgtacgcttggggtcgaggcccacgagctccaggagctcctcggcgctacgggtgccgccacgcttggtgagctgcttcatctgggcggaaatgagcatggaggggttgagcgaggacagggcgtcctgatagaccatggcgatatcggtaccgcgcaggccgaaccactccttcttgctcatcttgagcaggtcgcggccctcccagagaacctcaccggaaagatgctcgtcatcgtcggtcaggcccatgatggccagcgtggtgatggacttaccgcagccggactcgcctaccaggcccatggtctggccgggacggacgtcaaagttaacgtggtcgacgacgttgatgtcaccgtggtgctcaaactggatgcagaaatcgcggaccgaaaggatcggctcaacggactcatcgggcacatggcggtcgttacgcttgagttcgacatcacgcagggcgccaagacgggcggacagggactgagcctgctccttgtaggcgcgaacggggtcggagaccagcaggtcggcctcgcggcgctttgaggagtcggtcggatccagggcggcggagggagcagcggccatggcgtcggtaatgccctcggagaggatgttgagtgccaggcaggtgatcatgatggccaggcccgggaacagcgcctgccaccaacggccagcgagcacgccaccgcgagcgtcggcgaggatgttgccccaggtagcggtgggctcctggataccagcgccgatgaaggtcagcgaggcctcgaagatgatggcgtcggcgaccagggtaacggtgaaaaccatgatcggggcgatgcagttgcgcaggacgtgcttgatcaaaatccacggagccttggcgccggaaacgatgaccgcgcggacatagtcctcgccgtactcggacacgatgttggcgcgcacgatacgggcaatctgcggagtgtacataaagccgatggcgaagatgatcgacggcacggaattgcccaggatggagacgaagacggcagcgagggcaatgcccgggatggacatgatgatgtccaggatgcgcatgatcgcctcggaaacggacttgcgcgaaaccgccgcgagggcgcccacgaccgagccgcagaccagagccatggcagtggcgccaaagccgatgatcagcgagtaacggccaccgtagagcatacgcgacagaatgtcgcggcccttatcgtcggtaccgaagataaatccattgccgggagcctggcgagccgtaaagatctcgaccgggctatagggggcaagaaggggcgccagaatcgcggtcaaggcgaccagcaccagcacaacggcggcaatcttagaagacagcgtcatcttcttccagccaccgagcttgagccccttggaggcagctttctcgagctgctcggtttgcttctctcgaatctttaccataatctacaccgtcctgatgcgcgggttgatgagcaggtagagcatgtcaaccacgatgttgatgatgatgaaggcaagagcaacgacgatgacgacgccctgaaccaggttcgcctcgttgccctgaacgccctgcaggatcgcagtacccatgccggggaggttgaagatgacctcgatgacgacagcaccgcccataaggtaaccgatcttaagaccgagggtggtgaccggggtgatcagcgcgttgcgcaagacgttgatgccgacgacgaccttctcgggaacgccggcgccgcgagccatacggacatagtccttatcgagctcctcgaccatggccgtacgcacgatacgagtcatctgacctgtcagcgggaatgccagagcgatagcgggcatgatcatacgtcccagatagccagccgggttggtggtgaagtgaggtagagcaccggacgccggaagcaccttaaggtaggaagagaacagcagaatcaacagaacggcaagccagaacgacggggttgccaagccggcgatggagaagacgcggatcacttggtccggccatttatcgcgatacagtgccgcgatgacgccgagcaaaaacgagacgaccgcgccgatggcaagaccgatgaaggtcagctgcatcgtgacgggcagggccgtggaaatgcgcttggcaacggagttgcgagcagcaccataggtgcccatgtcaccatggatcagatcgcccatgtagcgcacgtagcgcacgggccaggggtcgtccagaccatacttctcatggtactcggcaaccgcctcgggcgaggcaccgtcacccaacgccgtataggcggggtcggtcttggagaacgacataaggaagaacaccaggacggtgacgcccaatgccatgatcggcagcgccacgagacgccttccaatcaaacgtagaaagttgttcacgttctctcccctttcttttgtcggtaggaccaactggtatatgagtatggatactcattacaagacccgagcgacatcgaggccgcccgggtctttgtttcaactatgaggacgttgccttacgaccgacgccctacatatgactcaagcgagtcttaggccttgacggtcgcgacgcccctgaaggacatgctcgtcgtgccgatgcccttgaagccatcgagggcctcgccgttgggcgcggtggacggatcgtcccaggaagcggagacggtcttgacgtggacaacggggtacagaacagcgttgtcggcgatgatgtcgaagcactcgttccacttcttctgctgctcgtcgccctcggcggcaagagcctcgtccatgagaccgtggagcttctcccactcagcggactccttccacgggcaacgggtctgcatccagacgttgtcgccgtaccaccagttgagcagcaggtcggggtcagcgccgaagcaggacggatcgccaggggcaaggaggatatcgtaggcctcgccgccgtcgatggcagcgtaggtggccggcgaggtatcggtctggatggtcacatcgaagccgagagcgtcgaggtcgttcttgacctgagcggccatgcccttgatctgctcgttgtcggtagtgcgcagggtgatggcgcccggggtgatgccagactcctcaatgagcttcttggccttcttggcgtcagtcttgtacaccgtggaagcctcatgatagttggtgaagctcttgggcaggtagcagctggcagcggtggcaaggccggcgaaggtgttggtgatcatcttctcggtgtcgagcgcgtacatgacggcctgacggaccttgacgttgttccaaggctccttggcgacgttgaacatgatgaagcgggtgccaaagccctggacgttatcgatcttgcagccggcgctctcgagctggtcgacggcgtcagcggtgacgagctccataacgagcgtggagccctcctgctgagcggtaacgcgagcggtggggtcggtcaggatgctgtactggatcttcttatcctcggcagcatactcaccgttgtactcggggttgggaaccagggtgatctcggtatcggagatagagtcgtacatccaggggcccgaaccgatcggctgcttggcgcgatcctcctcggactgggtagccggggtaacgcggatgatggccagacgatccttgagcagggagaagttggggaccttggtcttgaccgttacggtgctggcgtccttggcctcgatggactcgaagggctggaagaacggagcataggtagcggaagcagcgcaagcggtgtaggaggcaacaacgtcgtcagcagtgacctcggtaccatcggagaacttggcgcccttgcggatggtgacctcgaaagtggtgtcgtccacagacttgggatcgtcggtggcgagctcgttgaaggtgctgtagtcgtggtaatcgatgccgtagaggccctcgacgacgtgccagttagcacccaggcccacagcggagccggtgctggcgggatcgaagctggacggagcgtaagcggaaccagcggtgatcacgccgccgccacggttggcggaatcggtggagccggaagcggaaccctcgtcgctagagctgccaccgcagccagtgagaccaaggccggcgacagcagcgacgctgccggtgaggccgaggaacgaacgcctggacatacccttgttgatgatggccatgtcttctcctatcaatagagaatcttactcgggagcacctagacttgcccccgcgcaacttgcggacgatatataccttacctaccgacgaacccaactgaggtgccgcgctcggcgaccgatacatacatacgcttgaacggtatttactaccgttcaccgaattcattgacaaatgattcgccagacagtatgtatcgacgaggtgagatatcagtcttcgtcaacccgcaggatagcagggttgttcaccatgactagtcaaacgttttagcgttaataaaacccgaaaccagcatgcaatcatggcgaaataaatggttgaaaatcacgcaatcatgtatatcagtagtttaggctcgtgtttagctatcggaatggccagccgccgcctcggcgcgctcggcattccacgcaacgagcgcctcgtggaccgccttggcaacatcggcaggtatgccgcgaacttccgcgatctcttgctcgctcgccgcgcgcaaacgcttcatcgaaccaaaatggcgcataagggcacgttttctggtgggtcccacgcctggaacgtcatcgagtaccgaaactgtcatggctttatcgcgcaactcacgatggaatgtgattgcaaaacggtgcgattcatcgcgcacctgtttaattagatagagcgaagcagacccggtcggcagcacgacgggagtctcgtcccaaggcacaaaaacttcctcatcggcctttgccaagccacaaactggtatatcgagcccaagagcctcaagttgcttgatcgcagcggtcaattgcggcttaccgccatcgacaacgagcaaatcggggcgcgagccaaagcgctcgtcggccatgcgctcgggagcatagcgtcgtcccaaaacctcggacatcgacacgaagtcgtttgcctcgtccaattcggcctgaattttaaaacgacggtactggctcttgtcggcgcgtccgttggtaaacaccaccatcgaggcgacggtaaaggttccatgcagcgtcgagatatcgaagcactcgatacgcatcggcggcgccggcagcgccagcgcgctttcgagctccaggagcgcttgattggtgcggtcgtcagcgtaccccgttcgcatcatgtagcgcatgagggcatggcgcgcatttttggatgccatatcgagcaaacggtgcttttcgccacgctgcggcctatggagatggcaggaacgctcgcgcttgcctgcaagccactcccccagcgcctccgcatcctcaagctcgacagagaggtttatctcagctggaatatcggccgtctcgtcgtaatagcgcttaagaaagcccgactggagctcttcctcgtcaacatcaagacccttgtcaagaatgaactcgcaggttcgaaccgttcgaccctcacgcacgacaaagacgcaagcggcggagatggtctcctcgcgatagaaaccgatgacatcgatatcgacactggagggaaaaacgacttgctgacggtcgtccagacccctgatgacctccaaacgacgtttgacgcgtgccgcgcgctcaaagtcgagcgcctcggcggcatccgtcatctcggaggtcagctcatcgacgacatccttgcgatggcccgacaaaaaacgttcgacacgtttgacgttcttggcatagtccgtaggagaaatcgcgccgacacacgcacccgggccgcgcccgacatggtagtcaaagcagggacgcccgttttgcgcgcaaatcatattgacgatgtcttcctcgcccctgtgggactcgacgatacgacgacaacgacgccactccgcacaggatgcggagcagatggggataaccttgcgcagcgtatctatcgtctcacgtgccgcacggctatcggtatagggaccaaaataacgcgttcccggcttatgacgctcgcgcgtatatttgatagcgggatacaggtcgccctttgtaatggcgataaaggggtagctcttgtcatccttgaggtcgacgttaaagtacggatggtactgaccaatcaaattgcgctcgagcaccaacgcctcgtgctcggtctccaccacgatatagtcaaagctcgccaccagctgcatcatcagcgggatcttttgacgctcatcctgcagtgtcacgtactggcgcatacgggaacgcaagttttttgccttgcccacgtagatgacatcgcccttggcatccttccaaaggtagcatccgggctgtgtgggaacgcgcgaaacctgctcggcaagcgttggaatgttgtcgtgaccggccacacgcacctacttgcgacgaagcagcgccgagacctcaggcatcttaaggacgacggcaaggccaaaggtaacagcaagcgagacgacacccgcaacgcaaacgtagccaagagtaatcagaatcgagccgccaagtgccccgacaaagtgttcaagcacccacatgacgccggcgcctgcggcagcacctagaccaccgagcaaaaggccaaagaaaccgccatgcaggatagatttgacctgaaggccacgcaggcgacgacgcagccaccacagcgaacagccgaccaagatcacgtagtcgacaacatacgaaagcgcgattgccggcataccgaagcccagcacaacgccaaacagcagaaccgagccggcctggccgatggcagaatacaggcaatagcggctatagggcttcatgtcgagcaaggcagagaagctcttctgcatcaacacgaccacgccgtagagcggcagcgagagcgctaggtagacaaggtactcggacaccagcgccactccggattcatcgaacttgccagcacagtagatcatgttgagcggacgtgcgaagacaatcaggtacagtgcgaacggaatcaggaagaacagcatctgggcgacgccacgcgaaatgcccgtgcgtacgctgtcgtaatccttctcctgtgcgtcgtgagagagctcggtatagagcgccgtcgaaagcgaggcggcaatcagcgcgtagggcagcgtgtaccacaggcgcgcataggcgatgacggaaggaccagtctcgggctggaccaccagcgcggcagcgttggtgatagaagtcgagacaaacatgcacaccgtggcgagcagcgtcgggataccgagcgcaatcgtctggcgcagcgcggggtccttaaagtcgatatggatatggggatgcacgccgtgcttgctaagcgcgggaatctgacatgccatctgaacaaagacaccgagggtcgtaccggccgcaatcaagatgatgccggcacgttcgccaaactgtgcggacacgggcgcaaaacccataaagctcgcaatgacgatcacattgttgaggaccggggcaaacgtcgaccagaagtagtcgcggtgtgcgttgagaacgcccgagaacaccgagcccaaaccataaaacagaatctggatggcaaagaaacggaacatgaacgcagcggtatccatgctgccgccgtcacccgaaaggaacgattgcgtccagataaagcccggggcgaacacggtccccagcaacgaaatgccacccagcaccaaaagcagaatgccgagcaggttgcccacgtactcgttcgaggcctcgcgaccctgctcacgcctcacgcccatgtacacgggcaaaaacgccgtcacgagcatgccgcccatcacgagttcgtagagcatattgggcaggttgttggcgacctgataggaggacgaaagtagcgacatgccgatagcggccgccattgcccacgtgcggataaaaccggtgacgcgagacacaatggtcaggatggtcataagcccggcggaacgaccaaccgtggagtagtccgacgagcccatgtcgtcagtgtcatctcgcgacgaagaagcttcggatgagggtgtctgaggcgcagattcttttgcaaaatgagctccgcgcttcaattcttcctgcgccatcgctcagtcctctctcgtgatcggggcaaccgtcgccccgcaaaatgcaactaagtcatcgggagcaagctcaagctgatagccgcgcttgccacccgagataaaaatggtatcccaaaggacgcatgtctcatcgatcagcgtccggaagcgttttttcataccgaccgggctgcaaccgccacggacataccccgtcgcggcaagcaaatctttgacatgcatcatggtcagtgacttttcgcctgcggcgcgcgcggcggccttgaggtcgagctcgtcggcaacaggaatgcagcacacgacatggtcgttggacggcgtcgtgcagaccagggtcttaaatccctgaccgggctcctcgccaagctgctcggaaatcgcgacgcccagacctgacgattcatcgccatcgtcttcgtacgtatggagaacataggagatgccggcgctttccagctcgcgcatcgcattggtttttggcgtcttaacagcctttgccatggcacatcctttccctcgcagagcgacgcaaggattaagtatagggccaattccgccgcatatgccatctcgacacacagaagcgccaccgaatcaaaaggaatcggtggcgcgtcggtactacaacgtctctttactgcgcgtcgagctgcgcctggcgctcacggtcacgcttgagcagcggcgccaagaacttgcccgtgtagctctgcgaacatgccgcgacttgctccggcgtgcctgagaccacgacggctccgccgccattgccgccctcggggcccatatcgatcaggcggtcggcaaccttgatgacatcaaggttgtgctcgatcaccagaaccgtgttgcccgcatcgaccaggcgctgcaacacgtcgagtagctggcgaacatcctcaaaatgaaggccggttgtgggctcgtccaaaatgtagaacgtcttgcctgtctgacgacgatgaagctccttggcgagcttcacgcgctgcgcctcgccgcccgaaagcgtcgtagcgggctggcccaagctcacgtagcccagacccacgtcatatagggtctgcagtttgcgcttaatctgcgggatattcccaaagaaagccagtgcttcggtaacactcatgtcgagcacgtccgagattgtcttgccgcggtaggtaacctcgagtgtctcgcggttataacgcttgccgccacatacctcacaggggacatagatatcgggaaggaagtgcatctcgatcttgatctggccatcgcccttgcacgcctcgcagcgaccgccgcttacgttaaaggagaaacgtcccggcgagtacccgcgcgccttcgactccggcgtgcttgcaaatagcgcacgcagatcatcccacaggccaatataggtcgcagggttcgaacgcggcgtgcgaccgatcggcgactggtcgatatcgattaccttatcgatgcactcgatgccctcaatcttcttgtacggccccacgggacgcgtcgaacgatgaatggcattcgtaagcgcgggcgcaatcgtatcggtgaccagggagctcttgcccgatcccgaaacaccggtaacaaccgtgagcgtaccgaactcaatcttggcggtaacgtttttgaggttgttagcgcgggcacccgtgatcttaagacagccgcggccgggcttgcggcgctcatcaggcacgcgaatcatccgtttgccggtcaaataggcacccgtcatggaatcggggcacgccatgatatcagcaggcgttcctgcggcgaccacgtgtccgccgttaacgcccgcgccgggacccatatcgatcacgtagtcggcagcgcgaatagtatcttcgtcgtgctcgacgacgataacggtattaccgatatcgcgcaagcgctcgagcgtcttgatcaggcgctcgttgtcgcgttgatgaaggccgatcgacggctcgtccagaatgtacagaacgcccatgaggccggcgccgatctgcgttgccaggcgaatgcgctgtgcctcaccgccggaaagcgtcgccgaggcgcgatcgagcgtcagatagtcgagtccgacatcgaccagaaaacgcaggcgctccaggatttccttgacgatgcgaccgccgataaactgctgacgctcggtaagctccaggccctcaaaaaactcgagcgactcacgacacgacaggcagcagacgtcgtaaatggacttgccgcccacggtgacggcaagcatctcgggacgcagacgagcaccatgacagctcgagcatggctcttcgcgaatgtatttctccaagcgagtcctggtgttctcgttcgtcgtctcgttgtagcgctcgtacaggatgttgcgcacacccgagaacttagtgtcccactggctgcgacgcccatcgagcttttgatagtcgaccgagatcttcgcgtcgcccatgccatccaaaaacgcacgacgcacccgcgggggcaggtcctcccatggcgtatcggcactcaccttaaagtgtttgcagaccgcggcaaaaatctgcggataatagttggaattgccgaacaggctgccaaagactccgtcggcaatcgactttgaggggtcttcaatcagtgcctcggcatcgactgtctttttaaagcccaggccgtcgcactcgggacatgcaccatagggcgcgttgaacgagaaatcgcgcggctgcaggtcgtcgatggaatgcccgtgctccgggcacgccagcgccagcgaatactccagcagctcgccctcggttccctcgggagcgtcgcggtcgggcagcatgtacacgctcacgttaccgtgcgccagtgccgtcgcctgctcaacggactcggcaatgcgacccagggagttctctcgaatcacgatacggtcaaccacgacctcaatgtcgtgtttgaacttcttgtccaggtcgatagggtcgtcaagcgagcgcacctcgccgtcgacgcgcacacggctaaagccctccgcacgcaggtcctcaaacagcttggcgtattcgcccttgcgtccacgaaccaccggcgccaacacaaacgcgcggcggccctcccccgccgccagcaccttgtcggcgacctgatcggtcgtctgacgctcaatgacacgaccgcactcaggacagtgcggcgttcccacgcgagcaaacagcagacgcagatagtcataaatctcggttacggtgcccaccgtcgagcgtgggtttttggacgtcgtcttctgatcgatcgacacagccggcgacagaccgtcaatcgagtccagatcgggcttgtccatctggcccaaaaactgacgcgcatagctcgaaaggctctcgacgtaacggcgctggccctcggcatagatggtatcgaacgccagtgagctcttgcccgatccggaaagaccggttatgaccacgagctggtcacgcggaatggaaacatcgatatcgcgcaggttatgctcgcgcgcgccgcgaataacgatagaagaatcagacatggaagctccttgcctcctacaacttcaaatcacactgacgatgagtttagcgcactcgacgcgcacagatgttcgtaatacaagattcgcagacgttttgctttgcgtatcgggtgctttgtttctcgaaatgccgggaaaaggttacagtaatctaatactgaacttaatttgctgtaacagaggaacgtccatgaccgaagatatcccccttgaaatcacttcgagtgacatggccaatctgcccatattcatcgccgtccttatcgtggccgctgtcatcgcacgcatatgcgtttcagtcaaacgaaaggaacagccgcctgtttttcgcgccctttggtgcgcgacgctcctcatcccgctcggcatggtagctgcatggattacgaatcaattgctcgtaaatgaggacagttccctatgggtcctttcttattcggcactcggtgctgccgccgtcatacttcttgtcgagcccttggtttcgggacttatcgaccaaaccgatcttgcgacgggaacggttgcctgtatttgccgtgacatccttgtcatcgccgctgtttcagcgctctcgttcgtttcactcgaaattgcctgcaacgaaacgttctatcgcattcccgccaactcattcgggttttccgtcgggctgctcgcgacggttctactctccctttatttgctgggacagcgtcatggaggcgtcatgaccctcgtgcccatcatctgttgcatccttggcattgccgagcacttcgtcataacgtttaaaggcgaagccatcctgccaagcgatatcttggcccttggcaccgcaatggaggtgagcgagggatacgagtttacctttaccgccggaatcgtaacctctctcgccctgctggagatttccctggggcttctttcgcttatccgaccgcgaaagctccgtacgtccacccatgtcttccccgcaatcgccgctaacctctgcgcttttctgctagtgaccgttgtggggctctcgggcttttccagcatcgacttggagcaggcgctggattttggatttgaccgttggcagcccatcaccacatatgcgtctcagggttttatcacttcgttcaccgaaatggtcaacgagttgcccattgagaagcccgaagactatacgcccgatgaggcgcagagcatcgagcaggagctcgccgccgcctacgacagcacgtatggctcgagcgagcagcgcgcggctgccgttgcccagttcaatgaaatcaagccaacgattgttgccgtcatgaacgagagttttagcgacctttcgtgctttgagcagctccaggcggccgggtacaccggccccgcattctacaactcgcttcccgacacacttgttcgcggcaccatgctcgcttcggtcaccggtggcggaacggcaaactccgaattcgaatttttgaccggagcgtcaacggcctttgtcggattaggcaagatcccctatcagctgtatcagatgaatggcgtcaacagcctggcaaaggaccttaaagagcttgggtataccgctaccgctatgcacccgcaaaaccccgtcaactaccatcgagataaaatctatcagcagttgggctttggagactttctttcaatcggcgatttcgaaggtgcgccctgttaccatgccggcgtatgcgactacgccacctacgacaagatactcgacctgcttagaaccgacgaagcgccgcagttcatctttgacgtcacgatgcaaaatcacggcggctacgactatggcaccgttcccgccgaagagctgacaaactattgggtcgagggagccagtgagggcgccaatagcgcgctcaacacctatctcacctgcatcaacgcatccgaccgggacctcgagtactttatcaacgagctccgcaatatcggcagatcggttgttcttgtcttttttggcgaccatcagccgagcgccacaacgactctcaacgacgagctgtaccctcaggaagacacggcaagccacgctttccgtgtctatcagtcgacctatttcgtctgggctaactatgaaatcgccggcaataccgagctcaacgtctacgacaccgtcggggcaaacgagattgcagccattaccctaaataagatcggcgccccgctcaccgactatcaaaaggccctgcttgcaacaaggtcagatgtgcccaccatcaatgtcgccggctatctcggtgccgacgggctgcgctacgacttggaatctgaagacagcccctacacctcgacgatcgataagctgcagcgcatgcaatacctcgagttcgccagcaaagttcagtaagcccgcccattcgcttgggtccatcgtattgcaagcacgctcggcccaaatgcatcgcaaatgactcccgctcgcaaacgagggtacaatgacgctcgtgtcacaccgcggggctccggccccaacatatacaaaggagtcaaacatgggttgcgagcacgcacaggcagccggcgggcaaacgtcgccgtcgcaatttgaggaaaatacgctgtccgaggtcaagcgcgttatcgccgtgctttccggcaagggcggcgtcggcaagtcattcgtcaccggcgccatcgccacggaactttcccgccacggtcacaaggtcggcgtcctcgatgccgatattaccggcccctctatccctaagatgttcggcatgagcggacgtcacgtccatgccctcggcaaccttatgctgcccgaaatctccgagcacggcgtcaaggttatgagctctaacctgctgctccaaaacgaaaccgaccccgtcctctggcgcggtccggttatcgcgggtgccatcaggcagttctggagcgaaacctcatggggccccatcgactacctgctggtcgacatgcctccgggaacgggcgacgtcgccctcacggtcttccagtcgctgcccgtcgatggcatcgtcatcgttacgagcccgcaggatctggtctcgatgatcgtcgccaaggcggtcaacatggccgagaagatgaacgtccccattctgggaatcgtcgaaaacatgagctatatcgagtgccccaattgcggcaagaagatcgaagtctttggcaagagcaagctccccgaggtcgccgagcgttacaacctcgagatcctagggcagcttcccatcaatccggcactcgccgaggcctgcgataagggcgaggttgaaaccgcactgcccgcacgtatgctgccccaggccgtctctgccgtcgaggccattgccccgcacgaaaccgccgaggcctaagtgaacgcaaacgcctcctatgacgtcttggtaatcggcggcggggcctcgggtctcgccgccgccattacggccgcacgcgcaggcaaaagcacctgcatcgttgagcgcgatgttgcctgcggccttaaactccttgcgaccggcaacggccgctgcaacctttccaacgaatcaattgatttccagcggtacaaccaccccgcattcgtcgaatccgtcatgggcccccagcctgagcaagagctcggcagtttcttctcctcgctgggcatcatgacgacctccgaggagggccggctgtatccgcgctcccttcgtgccgaatcggtgcgcgacgcacttctcaacgcttgcaatcacctgggtatcaccttgatctgtggagcaaacgtcgcctcggcattcaaagcccccgagggctggacactccaaatagatcgtcccgcgcgagcactcaaggcaaaaaagcacgacgaccgaaaatcggaactccgctcgcttcggaaggcgctcgccgacacctctcgcaggaacgagacgctgcaggcaaaggccgtaattatcgctacgggcggcagccccgccgacatcgcgaagacgttcaatctttccctcacaccgcagcaccccgtcctctgccccgtgtcggcatcggtcttcggcgaccagactgcgctcaagacactggatggcctgcgcgtccgcgcccgtttgacgctcacccgcaatcacgaggagctctggcgcgaagacggcgaagtgctcttccgaacctttggcatctcgggcgttgccgcctttaacctctcccgtcgcgtccagcgcggcgacacgattctgctcgacgttttccccgacctctccaaagacgagttgctcgatatgctcaaccagcgagttgagttgctcggcggcttttcgccccgcgacccccgctggctcgacggcatgctcgccccgcagttctcacacgttgtctgcgccgcattcgaacagtgccaccccgggtcgcacgaccccatccatctagtctcaatcctcaagcactttaagttgctcgtcgagggaacgacagaggagcgttcggcccaggtcacgcgtggcggcgtgcccatcgagagcgtctcagctcccaacctctgcgtgagcaacgcagcaggcgccccgctttacatctgtggcgaggcgctcgacatcgatgccgattgcggcggtttcaaccttgcgtgggcttggatctcgggcattcgcgctgcaagcagcctatagccgcgcagtctataatctaaacgcattcgggccgtctgggacaccgggcggcctctttcttgcatctaaggagacctcgatgatcgaaatcacccaagtccacgcgtcactcgatgaggccggcgacgaaactgcctgccttgctattggtagacgtgccgtcaaacgagccctgcgatgcgaggattcccagattaaagccattgagctccatcgcaagtcaatcgacgcccgtaaaaagcgagatgtccattttattttgagctttcgagttgagctgacaagctctcgactcgagcaggaggtggtcgaccgcgtcgccgagcgcgaccgctcgcgcatccgcatagtagacggcgaggctccttcattccccaaccctgtcccgaatgcacccaaggggcgtcccgtcgttgtcggcgccggttgcgccggtctcttcgccgccctcacccttgccgcagcgggccttaaacccctgctcatcgagcgaggcgaccccgcacttcgccgctcggaagcgattgatctctttcttaaggagcgtatcctcgaccccgaaagcaatatccaatttggcctgggcggcgcagggaccttctcggacggcaagctcaacacgggaaccaagaatcctgcccatcggctgattcttgagaccttcgtcgaagcgggctcacctcgcgacatcctgtgggacgccaagccgcacattggctccgacatcctccccaccgtcgtcaccaacatttctcagcgcatcgagcagctcggtggaaccgtccgttatcgaacaaagctcgtcaatattcgaaccgatggatctggcgccatcaccggcgttgatgtcaaaccgccgcaagaaaccacaagcgaaacaatcgccacaaagcacctcattctcgcctgcggccattccgcccgcgacgtattcgagcttctcaaagaacataacgttaccctcgcgcaaaagacctttgccatgggtgtgcgcatcgagcatccacagcgcgacatcgaccgcgcccaatatggcccttcggcggggcacccgtcactcggagcagccccctacaagcttgtcgcccatctccccaacggccgcagtgtgttctcgttttgcatgtgccccggcggacaggttgtcgcggcctcttccgagcagggccatctgtgcgtcaacggcgccagcctcaatgcccgcaacgggcgcaacgcgaatgccgccctactcgttaacgtcacacctgacgaccttcccgacgatgatccgctcgcaggcattgaactccagcgcgcctgcgagcgagccgcctatcgcctgggtggctccaactggaacgcgccggcacagctcgtcggggatttccttgcgggacgcgccagcacggcacccagagaggtaaaaccgacctatccacttggcgtgacctggacggcgatcgacgatgccctcccgcagcatatcgtcgaatcgcttcgtttgggaatccccctgctcggtaagaaactgcgtggctatgaccgccccgatgcggtcctcactggcgtggagacgcgttcgagctccccggtcaccgtcatccgcgatcgaacatgccacgccgcgtcgactccgggcctttacccttgcggcgagggtgccggatatgccggcggcatcatgagtgccgccaccgacggcatccgttgcgctaaggcgctgatagcagacatctagtgcacgaactcccgcgtccgaacgacacaggccccaagctccacagggaactcggggcctgttcactacttcctgaatcgtgcaccctggcgttttctgcccgaagcaaaggtagagcccttgcgagcctgcgaacgcaaacgctcgatcgtttcgtcctcagatgcgccctcaagcatcgcccgaatctgaacgacagcatcgcgcagacgtgccgcctcctcaaagtccatggcggcggaagcgttacgcatgtcttcctccatggtctcgacgatccgcacgagctcgtcatgcggcagcccttccagctgctcggcaagcgtctgctcgggcgccaccgtctccggcgcggcgccctcgccgttttcgtcgggcgtatagaacgcaccgtgacccagcgaatcgcctctcgagcgccccttcgagcccacagtcttttcggcctcggcaataaagctcgaaatgtcgttaatggccttgcggactgtcttgggcacaatgccatgctcttcgttatatgccatctgaatctcgcgacggcgctgcgtctcctcgatggcttctttcatcgaatcggtcacaacatctgcatacatgatgacctcgccgtcggcattacgggccgcacggccaatcgtctgaatcaacgaacggcgattgcgcaagaaaccttccttgtcggcgtcgagaattgccaccagcgagacctcgggaaggtccagaccctcgcggagcaggttgatgccgacgagaacatcaatctttccctcgcgcagcgttcgcaggatctcgacacggtccatcgtcgctgtatcggagtgcatgtaattgaccttaatgccggcatcaagcagatggtcggtcaggtcctcggccatgcgcttggtgagcgtggtcaccagcacgcgctccttgcgggcaacgcgctcgcgaatctcgtcctcaagatcgtcaatctgtccacgaaccggacgcacatcgatcttggggtcgagcagaccggtcggacgaataatctgctcaacgtcgttctggctaacccgcagctcatagtcgcccggcgtagccgagacgtagatgaactggggaatcctcgcctcaaactcatcgaaacgaagcgggcggttatcgagtgccgaaggcagacgaaaaccgtgctccaccagcgtcaccttacgcgagcggtcaccttcgtgcatgccgcggatctgcggcaccgtcacatggctctcatcgatgatgcagagcatgtccttaggaaagtaatcgatcagggtaaacggtggctcgcccggttttcgaccgtccagatgacgcgagtagttctcgatgccgttgcaaaagcccatcgtctcgagcatctcgagatcatagtcggtgcgctgctgcagacgctgtgcctcgagcagcttatcagtcgccttgagctcggccacacgcttctcgcactcttcactgattgatttcagagccgctttgaccttaggcttctcagtcacgtagtgcgatgccggccacacgggaatggcctcgtactcacgtagcatctcgccggtgacctcgtcgatctcggcaatcagctcaacctcgtcgccaaagaactcaaaccgcaacggatgctcggcatagggtggatacacgtcgacgacatcgccgcgcacacggaaggtgccacgtgccaaatcatagtcattgcgatcgtactggatatcgataagcgcatggataaagtcatcgcgctcgagcggcaccttcttgtcgacgttcggagctaggcccgcatagtcctcgggagagccaatgccatagatacacgagaccgatgcgacgacgatcacatcgcgtcgagatagcagcgatgcggtcgcctgatgtcgcagcatctcaacttcttcgttaatcgaggaatccttctcgatatacgtatcgctttgcggcacatacgcttcgggttgatagtaatcgtagtacgacacaaaatagaccacggcgttgtcagggaagaattccttgagctcgctcgcaagctgagcggcaagcgttttattgggagccataaccagcgtcggcttccccagggcctcaatagtcttagccatcgtgaaggtcttgcccgaaccagtcacgcccagcaaaacctgatagcgatctccgtccctcacgccctgcacaagcgactcaatggccttaggctgggagccagcgggctcgtatggagacacgaccttaaacggtacctcagagccctcaacgccaaaacgtttaagctctcctccaacacgctcaacttcaaattccgccatggatactcctaactcatatatctgcagtatacgcaggcggcaggcatagtcctatacgaaccgatcgggatagagggtcttgtagcgaacccaggcattattgacacgaatcagatacgcctgcgtctcgggaaaagtgattgcattatgaagcgacgtgctctgctgcgcccatccgtcgacattgcccatgccggcgttataggcggcaatggcactgtcagtcgacccgttaaaatacgttagaagatacgaaagatacgcacagccaaactcgatgttcgtagcgggatcgttaaggtcgccggctgaatactcgctgccatcgacaagacccttggcaatcatatcctgggcagtctcgggcatcagctgcatcaatccccgtgcgccttgattcgactcagcctcgggatcccaattcgattccgactttatgacagcgcacaccagatacggatcaagattgtgcgaaatgctcgattgctttacgtacgcctcatagtcaattggatacaaaggcttaaagaaggcggcaggggcatacgagtagacgagcgaaataaggccgaagacaaacataacggcaagtggcgccacgcgataccacgtaaagaaacgtgtcttaggcatcggcctcctccctatccactacatccccgaagccatggcgcgcaagccatgcgtccagttgttcaaagagcgagttatcgcctgccgcattatcgatgaccgtcgtagcgagattgcaaagcgaagcctcatcagattggcatgcagagcgcgcatcaaaatcagaggactccataccacgatgaatggcacgctcacgacgaactgctaaaggagcgctgataaccagaatttcatcagccaggccaaaagcatcctcaaaaccagtcggggcagaaacctcgacaaccgcaaagggataacggggggacgaaaccgtgcaacaaaccggatcaagaatcctcagtgacagctgttcgatgagaaccggatgaacgatgccattgagccgcgcgactgtatcaggagaggcgaaagctcgagcagcgaggacattgcggcgaatgccgccctccccgtccagaatgtcccaaccgaattcttccgcgagggcattgacgatatcggagcctggcacatacagcgatttggcaagctcatccagatcgataagcatggcgccatgagattcgagatagcggcaggcagtcgacttacccgaagcaatattgcccaagacaaaaacggtaaacatcaagtcctccctaacgccaatgggagttattatcgcgcaaatacaaaagaaggactcaaaatacagccaaacagtaagagaagctaaacgaaggcgagttcgtgtattacaaccctctattaaacgcaaaaaagggggaggccgcgcggcctcccccttcttcaagtcatgcgacggctcggtgccgtccaccggtcagcggcgccctggcctcccacgggctgaccccgcagtactctcggcgcgatggggcttagcttccgggttcggaacgggaccgggcgtgccccccatgctctggccgctgaccggtgggcggcgcccaccgttacggtgtccgggtgtctctctcgcgtgccctgggggccgcatggcgcataggaaagatgactcgggggcatcctcgtgcccggaccgcgcatgagcgctcagtcccgcgggccgcgaggtgcggttccggaagagctcgggcgattagtgcggctcggctgaggacgtcgccgtccttgcacctgccgtctatcgaccaggtagtctacctgggcccttaccggaaggagaactaatccctggaacggcttcccgcttagatgccttcagcggttatccgcgccgcacgcggctacccggccgtgccgttggtcgacaaccggttcaccggaggtgcgtccaccccggtcctctcgtactgggggcagcctccatcgattctcctgcgcccacggaggatagggaccgaactgtctcacgacgttctgaacccagctcgcgtaccgctttaaacggcgaacagccgtacccttgggacctgctccagccccaggatgcgatgagccgacatcgaggtgccaaaccttgccgtcgatgtggactcttgggcaagatcagcctgttatccccggagtaccttttatccgttgagcgacggcccacccactcggggccgccggatcactagagcctgctttcgcacctgctcggcttgtgggcctcgcagtcaagcccgcttgtactcttgcattcaaaaggacggttgccgaccgtcccgagcggaccttcgcgcgcctccgttaccctttaggaggcgaccgccccagtcaaactgcccgcctggcacggtccccgagccggttgacggcctcgggttaggacgccggtcgcgcgagggcagtattccaagggcggctccccgggggctggcgcctccggatcgatgcctcctgcctatcctctacacgcgggaccagcggccaatgccaagctgcagtgaaggttcacggggtctttccgttcagggaggcggggctgtccctcccggaatcgtccaaataggtgttgccaatccatcgccgggttcggcggggcgtgggggatcgcccgctccggggccgagggcccgcgggccgaggccgccggggaggccgcggccgcctccaccgcgcccccgccggcgctcgtcgaggccgagaacaggcaggtcaggttcctggccgcccggatatcggaggccctcgacgaggccggggccctcgaggccgagacggcggcgctgctcgagggcgacgagacctacgtgtgcctgctcaccgtgcccggcatcggcccgaggaccgcggcgcagctcgcggtgtcggtcgacatcgggaggttcccggaccacgaccacctggcctcgtactgcggcatagccccgagggtgaggagctccggcacgtcggtgaggtcggtcagggcgtccaggcgcggcgacgcgaggctcaagtccctgctgatcttctcgtgcaacagcctggtgaggtcctcggggcgctacggcgagtactaccgggcctgcagggcgcggggcatggggcacgggcgggcgctcaaggccgtcgcgaggaagcggctcagggcgatatacgccgtgatgcgcgaccgggtgccctaccgggagtagccccgacggttgacaaaactataggaacacccaacgactacataaagcgccctcaagcggatgtgcttgagggcgcctcttgcttgactagctttcgatgtagtccttcagcttgctcgagcggctcgggtggcggagcttggccagggtcttggactcgatctggcggatacgctcgcgcgtgacgccaaactcgcgaccgacttcctcgagcgtgcggggatgtccgtcaacgagaccaaagcgcagctcgataaccttgcgctcacgatcggcaagcgaatcgagcacctgggtgagctgctcctgcagcatggagaagctggcggcatcgggcggaacgatagcctgggagtcctcgatgaagtcgcccagctgggaatcctcttcctcaccgatcggggtctcgagcgacacaggctcctgcgaaatcttctggatctcgcggacgcggtcggcgctcatgtccatctcagcaccgatctcctcaggagtcgggtcgcgacccagatcctggaggagctggcgttgcacgcggacgagcttgttgatggtctcgaccatgtgcacgggaatacggatggtacgggcctggtcggcaatagcgcgcgtaatggcctgacggatccaccacgtggcgtacgtggagaacttaaagcccttctggtagtcgaacttctcgacggcgcggatcagaccgaggttgccctcctgaatcagatccaggaacagcatgccacggccgacatagcgcttggcgatggagacgaccagacgcaggtttgcgctgatgagcgcctgcttggcctcaagaccaacattctcaatacgcgtaagtcgacgcatctcggagcgtgtgagttcaatctcgcctgcatcggcagcctcgagcttctcggtagcctcgagaccggcctcaatcttcatggccagatcgacctcttcagatgcggtcagcaggtcgaccttaccgatctccttgaggtacatacgaaccgggtcgccggtcagcatcaccgtggaggcatcgatgccgcgcacgcgcgaacgcgaacgggacgtgcgcacggtgcgcttcttcttgctcttggaagagcccatctcggcatcggcctggcgggccatcttaagctcgtgatcgtcaagcgagccggaatcgtgcttgtcatcatcgaaatcgtcggtatcgttatcgtcatcgtcgacgtccatcggggcgtcgtcgtttccgctcgcggagataatctggatgccgctgttgcgcagcgcggaatacaccgcgttgagctgctcatcagtaacatcgatatccttcagggcgacctgaatctcgtcctcggttaccgaagtcctgtttgagccgttgcccatgagctttgcaacgtaggattccagcccagtacccgtgctctcagtcttttttggcacagattctcccttcgtagtccacaggactcaatactttagcacacacgtagacctctatacccaaaataaagacatgatataggcgagaatacgctggttgaccacaacatctaggcctgatcggcacctgcggtctccaaaccgatcaaacggaacgggtcggccacgccaccgatcgacttttggagctcgcgctggcgctgtgaatcttgcaccgcctgcatcgtcagcacgcgacgagcctcatcgtcgagtgaacggtcctgacgcaacttggcctgcgcggctcgcatgcgacgtttgatggtgtagagctcgagcgtatcgagcataaagacgatgttcgtctcggtcgggtgcttgctcgtcgccgagatgcgcccggcgctgacaagcgacgccgcctcgggacacaccgcccgcgccgcatccatacatgccgcaggatcggttcccggcggcgttgccagcacggcccacgcaatggactcgtgacgcgggtcaacccactcgatagaacaaatgcgatcggcatacgtgcggaacagatcggggtagctcgtgagcatcgtcagcagctcgcgctcccccgccagggatttccgctccagatcggtcaaaacgatcggcatcgacggagctgccgccacgcttgagctatcggcaacgggcgcagcgctttccatccccgctggcacatcgattggcggcagatcctcgtcgacctccaccggcgcggccccataggcatcaagcggaacgtagtcgtacgggtcctcctcgaccggtgcggacaccggcggcgtcgcacccgcggcccaggcaccgcgagacgtcccctgcgaaccagacgcccgaccgcccgcgatgcccgcgcgctcagcttgcgcgcgttgacgctcgtagttctgctcacgccggcgctcggcatcctcacgcttggcgacatcgcgaaacacgcggcccgaactcgcgcgcacggtctccaggtccaaacccaacaggtcggcaatctggataaagtacgtgtcgatcatatagctgtcacgcagcggatagatgagcgtcagcgcatcctcgagcgccttggcacgaccgcccggtgtggtaatgtcgctcgactcctgcagcgaacggtagacaaagtccatgaggggctcggcggcatcgatgcgcgcctgcagcgcctcgccgccatgcgccgtgatgaactccatggggtcgttgccatcgggcagcaccacgcagcgaagatccatcgaatcctgctcgataaactgaatcgcgcggcgagcggccttttgaccggcggcgtcgccatcgaacatatatacaatgcgcttggcaaaacgggtgagcgtcttaacgtgatgttccgtcagcgctgtgcccagcgtggcgacgacgtttttgatccctgcctcccagcaggcgatgcagtcggtatagccctccaccacgatggcggtatcctgcgcgacgataaactccttggcccagttaaagccatagaggtttcgctttttatgaaacacactcgtctcggccgtgttgaggtacttgggctgaccatcgcccatgatgcgcccgccaaaggcgatattgtgaccctgctcatcaaagatgggaaacatcacgcggtcgtaaaaacggtcggcaagctgtccacgtccacggctcacggccacgttggcgtcgatcatctcctgcggggtaaagcccgcctgcgacagatgcgacaccagcgcgttgcgacccggcgcaaagcccaggcagtagcggcgacagacatctccgcccatgccacgactggcaaagtactcgcgcggacggctgtccttaccgcgcataagcatggtgtggtagaactgagccgtctcggcgcacaggtcatagatgcgggcacgcttggtgccgcgatcgcgctgcgcaccggtatcgtgcagctcaatgccggcacggtcggccaaatagcggatcgactcgggaaagctcaggttctcgcgcttcatgatataggtgaagacgtcgccgccctcgccgcagccaaaacagtgccacacctgcgtagcagggataatgtgaaacgatggggtcttttcgccatgaaacgggcagcagccccaaaactcatggccgcggggcttgagctcaaccgtttcctgcacgatggcaaccaagtccgacgccgcgcgtacctgatctttttcctcatcgctaatcacggatgctcaccccctgctcacccaagttatgacgaatatcgtcgatattaccctcgacggtcgcgataagctcgtccagcgaatcgaacacgcgagacggacgcagccagcgcgtaaacgccaacgacacggaggcgccatacaagtcgcccgcatagccaatcaagttggcctcgagatgcgccgaggcggcatcatcggcataggtcggcggcaggccgacgttaacggcagcaggccatacggtatcgtcgaccagcaccagaccctcatagacgccatcggcaggcacttggatgccgtcgggcacctggatgtttgccgtgggaaagcccatatcggagccctcgtgacggccagccgccacaacgccgcgcagcatatagggacggccgagaagctcggcagccagctccacatgaccctgacccagctcatggcggatgcgcgtggcgcagatggtctgcccgttaacgcagagcaggtcgtgaccgtaaacgtcaaccccacgctcagtgccccaggcgcgcatctcggcaacgcccgaagcgccgccgcagccgagcctaaagtcgctgcctacacgaatggagcgaatatcgacaacgcgcgacaacagcgccagaaacccgacatggtcgagtgccgccacggcgggcgtaaagggaacggccaccaccgcatcgaccccggtttgagccagggcatgcaggcggtcggccgtcgtcatcaatttttgggcgggcgacggactcaccacgacgtccggatcaggatcgaaggtgaccacgaccgctttgctgccgtgatcatgtgcatcgcgaataaccgcttcgatcagctcttggtgcccacgatgcacgccatcaaacacgccaatagcgatcgacgcggcacccaagaactcgcacccatcaaaagcatcggcagaaacgatacgggcctcatccaactcacccgcgaaaaagatacgcgcgagctcgtggggcgtcagcatcatcgaacaccgccgatcgcctgcggaaaaacgtgctccatcacaaagcggccgccctcgatacgagcaagcgccttcaatcccccatcgagtacgagcgcgaacggcgccttcgccgtatcgaagtccgcaagcgcgcgttcaacgggaacgcggcggccacaaagcaggtcgtctgcaagattacccggcaaatcgacacgcgtggcacctagggcggcgatgggatccagagcgaaaccggcagcggtctcggcagagagctcctctaccgcatgacaggcgccaatggaaaccacgccggaggccgtacggcgcagcgcggaaatatgtgcagcacaatcgcaggcacgacccagatcgcgagcgagcgcgcgaatgtaggtgcctttgcttaccgaaaacgccacggtccagacgcacgtatcgccctcgccgcccacggcgatcaggtcggcggcatagacctcgacggggcgcggaggtaggtccaccgcattgccctcgcgagcagacttgtaggcgcgaacgctattgaccgagatagcagaaaacgccggcggcacctgcatctgcggacccagcatggcgaccaagcgctcacgcgcataggcaggatcgcggagctcgtcggcaacagccaccgtgcggaccgcctcgccctccgcatcatcggtattggtctcgacgccaaacgagatatcggcaacgtagcttttggtatcaagcgtaagcatgcccagcagacgtgtggcctgacccacgcccaccaccatgacgcccgatgccatggggtcgagcgttccggcatgaccgacgcgccgctcatggagggcgcgtcggcattgcgaaaccacgtcgtgggacgtgcagcccaccggcttatcgacggcgagcagcatattcaattgagaaggcgtacgacgagccatgtaccatccaaaatgttagagctcgacggtcaccgaagcgggatcctcccccaccagctcggccagcatgggaagtgccacggcgagcgtctcgcgaatcgttccgttgttggaaaagccggcggcggcatgatgcccgccaccgccaaagttggcagcgatctcggacacatcgaggtcacccttggagcgcaggttgccgcgcaccttggtatcgccgtcgatgccctttaagaacaggcagacctcgacgcccatcaccgaacgcaccacatcgaccagaccgtcacattcatccgaggtgacgccgcaggcctcaaggtcgctctggaaggcatagctatacgccacgcgcccgtgcgcgaccgtcttgatacggcccatgacaatggacttgaggtgcaaaaactcgacgcgcatgctctgatagacctcgagtgcgacacgagccggattggcgccatgcgccaccaggcgcgaagcagcatggaacgcggcagcatcggcgttctggtactggaaacgaccggtgtcggtcaccaagccacacagcaggcaggtcgcaacgccatcacgtgcgacaatgccgcaattgtccaaaaagcggtcgatgatcatggcgcaggctgcggcgccgacgcacctcaggctcagctcggcaaattcctcgcgcgccggatggtgatcgaagcacaccacatgcgacgagcggcggagcacctcggctgagttgttcagacgctcgacgaccggcacgtccaccgagatgaacaggtccggattgccggtatacgcagatgccggcaccagacggtcggcaccctccataaagcggtagatgcgcggaaccgggtcatcgtctgccagcagcagggcaatgtccttgttggggaaaaacttcataagcgataagcccagacccagcacggagcccagggcgtcaccatcgggagacgtatgtcccgaaatcgcaatggaggacgcatcctcgatgagctcgaggatgcgtcgctgaatatctgcagactcgcacgatgcgaggtcggcggaattactcatctaaagctgcctcctgggcggcatccgctatgggatagccgtcctcgtccttttcgatcgcaagcgtggcgggaacgttttccagcgcacgcgtgatgcgctcggcctcatcggtcgagcgatcgatgcgaaaatcgagctcgggcgtgacgcgccaatcgagcgagcgggccaacaggctacgaatgcggcccttggcgctggcgagcgcctccatgacctcatcgtagcggctcgcgtcgcacgacacgtacacgcgcgcgaacgaacggtccaccgcgacctcgaccgcggtcagagtgaccaggtcgagacgcggatcggaaacctcaaagagcaggatataaccgagcttctcgcgaagctgctcgcccaaacggcgggttgcctgcgtttgcttcatagcgctaccccctactcggtacgggcaacctggtcaatgcggtagccctcaatggtgtcgccaggcttgatgtcctggaagttctccaggccaataccgccctcggagccgctcttgaggctcttggcctcgtccttgtagtggcgcatcgaggcgatcttgccgttgaagaccacgatgccgtcgcgcaccaggcgtacggaatcggtcgcggcgatctcgccctcttcgacgcggacaccggcggcgataccgaccttgggcaccttgaaggtgtccagaacggtcgcagtacccgtggagacctcgacctcggtgggcttgagcataccgatgcgggcagcgtcgaggtcctcgaggcacttgtagatgacgtcgtagcaacggatctcgacgccctcgcgctcggcagcggagcgggccttgccgtcgggacggacgccaaagccgatgatgatggcgttggaggcgtcggccaggacgacgtcggtctcgttgatggcaccaacggcggagtggatcgtgttgatgcgcacctcagactgatccatcttgtcaagagagtcctgaagggcctcgatggagccctggacgtcggccttgatgatcaggttgagctccttgacctcggcgtcggcgatggtctcgaagaggttctcgagcgtgacgtgcttcacgcggctctgctcctcgatacgggccttgagcgaacgctcatcggccagggcgcgagcctcgcgctcgtcctcgaacacacggaactcgtcgccggcgttgggcacggactgcaggcccaggatctcgacggcgtcggaggggccggcctcggtgacggcgttgcccttgggatcgagcatggcgcggacgcggccgtaggtaagaccggcgaccagcgtatcgcccacgtgcagggtaccgcgggtcacgagcaccgtggcaaccgagccgcggcccttgtcgagcttggcctcgaggacgttaccggaggcaaaggtgtcggggttggccttgagttcgagaacgtcggcctggagcagcacggtctcgagcaggtcgtcgataccgatcttctgcttggccgagatgttgacgaacatgttctgtccgccccactcctcggggatgatgccgtactcggtgagctcctggcgcacgcggtcggggttggcgcccggcttatcgatcttgttgacggcgacgacgatgggtacgccggcggccttggcgtggttgatcgactcgatggtctgaggcatgacgccgtcgtcggcagcaacgatcaggatgacgatgtcggtcaccttggcgccacgggcacgcatggccgtaaaggtagcgtgacccggggtatcgatgaaggtgatcttgcggtcgttgatcatgacctgcgaagcgccgatggcctgcgtaatgccgcccgcctcgccggcagcaacgccggtgtgacggatggcgtcgagcagcgacgtcttgccgtggtcgacgtgacccatgacggtgacgaccggggcgcgcggcttaaggtcggcgggatcgtcgtagaacgagaaggtgttctcctcctcgggggtgatgatcttgatctgacggcccaggtcgtcggcaacgagctcgacgaggtcgtcggacatggactgcgtcatcgtaagcggcgtgcccagcaggaacaggcgcttgatgatgtcgttggccggaacgtcgagcgcctcggcgagctcctggacggtaactccctgggagaccttgatggcgtcgagctcctcggggttcacgccctgggccagcgcctcctcaatcttgcgctcctcctgagccttagcagcctcgcgctcgcgcttctccttgcgcttcttgcggcgaccggtggactcgcgagaggcctcctcgacggcggcgcgggcctcctcgagcaccttctcgcggctgtactcctcggcctcacgagccatgcggctgtagtggtcctcatcgttgccgtgaccgcccttgcgcttcttgcccttaccctgcttatcggggttggggaagtccatgccggcagcgacgttgttgctggcgttggtgcgatggctgtgcggacggctctcggaggcattgcgatcggagttgttgtcggaggcgttgcgatcgttacgacggccaccgcgacggtcgttgttgccgctacgacggttgccgcgctcagaggcgcgctcggccttggccttctcctcggcgtccttcttctccttgagcacggtctcctgtgcggcgatctggtcgagcagcgagcggaagcgcgaaccggagtcggaagcggggacggcgcggcgctgggcctcgcgggcagcctcctccttctcgcgggcaaggcgctcctgctcagccttcttcttggcctcggcctcggcacgggcggcctcctcggcagcctgggcggcggcgaactggcggcgctcctcctcgcgtgccttctcggcggcgatgcgctcacgctcggcctcggcagcgcgcgctgcctcctcggcggcggctgcctcctcctcggcctgcttgacggcctcgacttccttggcgcgggcctcgatcaccgaggcgagctgcttgcggaccatggcgacgtaagcgtcctccagggcggaggaagcggacttagcgggaatcttcatttcggcaagatgacccatcagttccttggaggtcatgccgaactctttggccagggtggacacacggacttttgccatatgacttcacctaccctttctggcaccttgggtgcctagagactgaacgagcgtggaagacgcgccgggacccgcccggcgcgaacgcgcgctagatcaggtcctccgcatcatcgaaggcgtcggtgtcgtggacaccgcagaaacgggagccgggacgagcctggttgcggcactggataccgtcctcggacacgtactcgcagcggcggacgtcctcgtcctcctcgtcaccgatcaggtcggcggcgggctcctcgtgaacgggaacgttcttgaggatgtcggcggcaagcgtctcggacttgatgtcgatgtgccagccggtcaggcgcgcggcgaggcgggcgttctggccctccttgccgatggcgagggacagctggtcgtcgggcacgatgacgccggcgtaggccttctcctcgtcgatgaggacgcgggtgaccttagcgggcgaaagggcgttggcaacgtagacggcaggatcggcatcccacaggatgacgtcgacgcgctcgccacggagctcgcccacgacagcgcgaacacggctgcccttggggccgacgcaggcgcccacgggatccagacggtcgtcgagcgagtggacggcgaccttggagcgctggccgggctcgcgggcgatcgacttgatctggacggtgccctcatagatctcgggcacctcctgctcaaacagacgacgcatgagctcggggtgggtacgggagatgacaatcggcggacggctgtgctcgccacgaaccggctgcaggttggagttggggtcgcgaacgtcgatgatcacggccttgatgtgctggttgtgcaggtagcgctcgcccatcggacgctcgttgcgctcgttctcgtaacggcgctggtcgaagtgcggcagctcggcctcgacgccctcgcggatcttgacaatcgtgaagtcgggtgtggactgcagcacggtaccgctgatgaggtcaccgatgcggccggagaactcctcgtagatctgctcgcgggcggagttgcgcacgatggcgttgatctcggccttggcgtgctgggcagcgatgcggctcgtgttcttgggggtgacgtcaatctcctcgaactcggtgaagttgccctcctcgtccatggaatcgtcgatcggctccaagcggtagacgtagatcttgccggtggtgcggtcgatggtcaccttggcgccccactcaagatgcaggatctcggcatagctcttggcgagcgactgctccaggcggtcgatcaggtagagctggtcgatgtgcttctcctggcaaagctccatcagggcggacatcatgtcggatgctgccatcttactttccttccttcgcgggcttgaagtcgtaggtgggcttcaacttgcactttttaacatcagagaaatcgagggtaacggactcgccgccctcgagctcgagggtcacgttcgtctcggtggcggcggcaatcttaccggcgtacttgcgacggccctcggtagcggtggaggtgagctcgcagttctcgcccacaaagcgggtaaagtcgcacgggcggcgcagcgggcgcgccatacccgggctcgacacctcgagcgtatagctcgaagagatggggtcgagctcctcaatcacatcgccgacccacttggtgttggccgtgacgtcgttgagcgaaaggctctgaccctcggcaccctcgatacgcacgcgcacgcagggggccttggtggcacccacgagctcgacgtcgacgatgtcgacatcgtgctggggagcgacggcctcgagcgcgtcgatgatcgcctgctcggtcttggtcttgaccattgcggcacctccatccatacaaaaaagaagcggggccgaaaccccacttctttcaattacaacttcatttgcaagcaaactataccaatagctgcggaaacgtgcaagcacagtacgaatctgcaggtcagcgtgcgcacagcttctccacaagaataggacaattgaccgaagacaccatggcaggtacatgcaaaacgagggacggcccaaacggaccgtccctcgtttattgcatgtcagctttgcgcgcagcgcttacttgaccaccaggttgaccagcttgccgggcacgcagatggccttgacgaccgtcttgccctcgagccacttggcgacggcggcctcggcggcagcctgcatctcctcgttggaggcatcgcgggcaacgtcgacgcggccgcggaccttgccgagcacctggaccacgatctgcaccgtgtcctcaacggactcggccaggtcgaactcgggccaggcggcggtgtaggcgttgccctcgcagccgagggcctcgtgccacagctcgtcggcccagaacgggcagatgggggcaaggacgctcacgatatccttagccacgccgtagcacagcgccttgtcgcgggcggtaccctcggtggcgttgaggtaggcgctcgccgcgttgacgagctccatgacggccgagatcgcggtgttgaactggccgcgatcgaagtcctcggtgcacttggcgatggtgcggtgacgctcgcgatagagcttcatcgcaacctcgtcgagcgcggacttgtcgaaggccacgttggcgtcaccggactggacgagctgccaaacgatacgccaggcgcgcttgatgaagcggttggcgccctcaacggccttgggatcccagtcgaagtccttctcgggcggagcgataaacaggatcgccaaacgcatggtgtcggcgccgtagggctcgatgaccgagctcgggggcacgacattgcccttggacttggacatggtgtcgccgttctcgtccttgaccatgccctggcacagcaggttggtgaagggctcgtccacgctcagcaggcccaggtcgcgcagcgccttggtaaagaagcgactgtagagcaggtgcagaatggcgtgctcgatgccgccaatgtagttatcgacgggcatccaacggtcggcggcctctcgggagaagggcagcttggtgttgtgcggatcggtatagcgcaggtaataccagctggagcaggtgaaggtgtccatggtatcggtctcacgcttggccgggcggccgcacaccgggcaggtggtctcgtagaactccttgcactcggcaagggtctcgccggcgcccaggtcaaggttctcgggcagcgtcaccggcagctgatcctcgggcacgggcacgatgccgcagtgctcgcagtggatggccgggatggggttgccccaatagcgctggcggctgatgagccagtcgcgcagacgaaactcgaccttgcgacgaccacagcccatggcctcgaggtcggccacgattgcagcctcgccctcggagtgcttaccaccgcgcatgccggtgtacttgccggactggacgagggtgccctcggcagcgtgagcgcaatcccagtcgacggtctcggcatggaaggtatcgatggtctcgccgctggcctcgacggcagcgcgatcgtcatcgtctaggatgatcggcacgatcggcaggtcgtacttacgggcaaactcaaagtcgcgctggtcgccacagggaacggccatgacggcaccggtaccgtagtcggcgacgacataatcggcaacccacacggggaccttctcgccgttgacggggtttaccacatagcggcccgtaaaggcaccgtgcttctcgagggtgccctgggcacgctcgacggcagagatatgcttggagtcctcgacgatcttggtgacggcctcctcgtactccgtgccctcgacgagctcatgcaggccggcgtactcgggagccaggacaaagaaggagacgccaaaaagggtgtcggcacgcgtggtaaagacggtgatcttgccctcatcgccctcgatgggctcgccatcctggtcgcacagggtaaagtcgacctcggcgccctcggagcgaccgatccagttggcctgcatctgcttaacgcgctcgggccagccggggagcttctccaggtcgtcgagcagctcctgagagtactcggtaatcttgtagtaccactgctcaaggtcgcgcttctcaggctcggtgccgcagcgccagcacttgccctcggtaacctgctcgttagccagaacggtcttgcaggtggggcaccagttgaccgggttcttcttgcggtagaccaggcccttttcccacatcttctcaaagatccactggccccagcggtaataatcggggctgcaggtcttgaccatgcgatccagatcgtaggagaagcccatgcgcttcatcgtggcgagcgcctggtccatgttcttatacgtccaggcggcagcctgcgtgttgtgcttgatggcggcgttctcggcaggcaggccaaaggcgtcaaagccgatgggatgcagcacgtcatagccgcgcatgcgggcctgacgggccatggcatcgccgatggtatagttgcgcgcgtggcccatgtgcaggtcgcccgacggatacgggaacatctcgagcacgtacttcttgggcttgctgtcgtcggtgtcgacagcaaagaggttggagtcctcccaggccttcatccaccgggactcgatggcctgcgcgtcgtaaacaggaatctcgtccttatgatctgtgcaatcgcacatatcagctcctttgttatctcggttggggcggggcgttcttacctttgctcgctgctgcggacagtcctgctcgcacgaagagcacattaagtgctcttcggctcgtgcggaacttgcagcgagcaaaggtaagaacgccccgccacatcgttaactcgcatgatgatagcaaatacaacaagcgagatgcctgcgacttgcaggcatctcgctttatctaaataacgtggttgggaatcaacctttgtctgaaactcgttctagcacgaacgggttttccaggtgccgcagattgccgtgaaagaggagcgtcgcgtactttggtacgcgagcgacggtttgaacggcaaggtgcggtgcttgggaaagccgcttagcggtagctgacgctttgctgggagtccttcacgacaacgtcgtgggcgccgccttcgacgatggaggtggagctgaccagcgttaggcgtgccttttcctggagctcggggatcgagagggcgccgcagttgcacatcgtggacttaaccttgtagagcgtgccgcccacgccgtccttgagggatccggcgtacgggacgtaggagtcgacgccctcgacgaagctgagcttcgcggcgccgcccaggtcgtagcgctgccaattgcgagcacgcgcagaaccctcgccccagtactccttcatgtactggccgttgacgttgacgcgctcagtcgggctctcgtcaaagcgggcgaagtaacggcccagcatcataaagtcggcacccatggcaagggcaagcgtcatgtggtagtcgtagacgataccgccgtcggagcacacgggcacgtagacgccggtctcctcgtagtactcgtcacgggcgcggcagacgtcgatcagcgcggtggcctggccacgaccgatgcccttggtctcgcgggtgatgcagatggaaccaccgccgataccgaccttgatgaagtcggcaccgcagtcggccaggaagcggaagccctcggcgtcgacaacgttaccggcaccgaccttgacgtcctcgccgtagttggcgcggatccactcgatggtgcgcttctgccactcgctgaagccctcggaggagtcgatgcacaggacatcggcaccggcctcgatgagcagcggcacgcgctcggcatagtcgcgggtgttgataccggcgccgaccatgtagcgcttgtcgttatcgagcagctcgttggggttagtcttgtgactgtcgtagtccttgcggaacacaatgcccatgaggtgatcgttatcgtcgacgatgggcagggcgttgagcttgttgtcccagataacgtcgttggcaaccttgaggctgatgttcttgtcacccacgatgagctgctcacgcggggtcatgaactcggagaccttcgtctggtggtcatcgcggctggggcgatagtcacggctggtgacgatgcccaggagcttacccttgggagtgccgtcgtcggtgaccggcatagtggagtgaccggtcttctccttgagctcgatgacctgctccatggtcatgtcgggggtcagcgtggaatcggactgaacgaaaccggccttgtgatccttgacggccttgaccatagcggcctcggactcggcgctctgggaaccgtaaatgaaggacaggccaccctcggtagcgagcgcgacacccatatcgacgcccgagacggactgcatgatggcggaaaccatggggatgttcagggtgattgccggcttctcaccgcgcttaaagcgggttagcggcgtcttaagagaaacgttgttggggatgcactgcgaggacgagtaaccagggaccagcagatactccgaaaacgtgtgggactcaccgggaaagaacgtagccatgtttctcctttttccatgcgaccggtcggctgcaggcctcgtaggacccagcccaaccttgggcgcccaatactggggaagtatcttaacgcactttgactgctacaatgcatgatttaagaagagcacacgagggtttgacgcaggctttgcgtttgcccagcaaacactttagcggggagacgtggagcgtatggagtacaagacgacggcaaagttggtcattcaagcgtgcgacaaagatctgccgggcgtgtttggacacggctgcgtcttgctgctgcagggtatcgcccgcgagcactcgctcaaccgcgccgccaagagcatgggcatggcgtattccaaggcctggcgcatcgtgaacgaggccgaaggtcagctgggctgcaaactcatcgagcgcgacggcgcccgcggatccaccctcacccccgccggcgagcgagccatagcggtctacgaggagctgcgggccgacgtcaacaacgtcatcgccaccaaagcaagcgacctcatcgcaagcattaaagagtagtttacgaagggcattgtctagggcggacgctacaaccagggggttgtcggtgccggcgaagaggcggatggtgcccccctgcttgctgcgtggagccgaaaggcgcgttgttgcgccgcctgcgggcgatgtgcgaaactccccaggcaaagcatcgaacagctcgcccgcgctacgttcgataagatcgaactctactgccgggccaaagccgtgctcgagaattcccgttgcagccacatggtcgggatgcgaggtcagcccgggatagcgcacgttgcgcaccatctcgttcgcggccaaatattcagccagcgcacgggcgcgatcgaaatgtgcctgcatgcgggtgtcgagcgtgtcgagcccgtgctctagaannnnnnnnnnnnnnnnnnnnnnnnnnnnnnnnnnnnnnnnnnnnnnngtcgagcgcggccaatccgcaccactcgagcagcgcatgcgcgcactcggccgcagcgtccacgcgatggcgcttgagctgcgagcgcgcgaccgaagcggcaacgagcttgcgtggagcctcaccggcacacacacggtcgagcgcctcaagggacagcacagcacccagccgcagcggatcgcagccaaagacgtcagccacggtgttgtccacaaccagcagcgcatgggcctcacgcgccgcccgacccagcgcacgcagatcgggcacacgcaggccaaagccaccgattgagttcacaaaccaccacaggtgcggtccctcagcatcaaacgaagcatcaaatccctcggacgcagcagaaaacgctgcagccgatggctcccccaccagcacaacatcgcggccatcaaagccacgagcaaacgcatcggcaaagtcgtccgcaaaggccaccaggcggtcaccgggacgcacgattcccagcagcgacagcgccgccggtacatgcgaggccgcaacaagacgcgcctcacgcgcgccggctctcaaagcccaggtatcttctagctgctgtacgcccatacggtaccgtcccttcagaaacaaaaacccacgatacggatgttccccgcatcgtgggcaacggctgcagtatagcgccgatatgcgacgaatcgcctagatgttgagcgcgtggtaggtcacgctcgcacccggagcatcaacggacacgccataggtctcgggatagatgcgcgtcgaaaacacgagcgcgccatcgttcacaaacacctcgaccgacgagacatcgccaacaatgcgcacgttacgaacctcgttgacgggctcccagcgcacggtacgaccgcagccggcagaagcgcgaccctcatcggtaaatcgcatctcaaagcgcgagggcagttcgccctcggcgggaataaacgccagcttaagctcgctatcaacggtcgcggtaaacgcgccgtcgacaccgtcggcaacaacgtcaaagcaggtatcgcctgcaacctccaacgagccctcccccacacgcaccgaggcataatggtgctcgatctcgcgagccggttgttgcagcaccacgccgccgtcaccggccgtaagctcgcgcggcaccgtcatgcagtgctgccagcccgccaccagagtcggtgcgttgtcataggtcggctcatcgggcatgcccatccagccgatcagaatgtggcgaccatcctcggacgtaaactcctgcggcgcgtagaaatcaaagccggcatcccacaggcggaactcgcccagctcataagcgtcattgccacccgtaatgtcgcccgttacaggcatgtagcccgctgcatacacattgccgcggtcccaacgaccgccctcaagaccctggggagagaaggacagccacttcgccggtacaccgccatccggctcaagctcaaggtatcccgggcactcccacataaagccaaagcgctcgggcgtagacacacgactctcgagctcccaactcagcatatcggccgagccatacaccaggatctcgcccacatcgcgcccggcaccctcgccgtgcatggcgcaaaatcgactatcgacatgcggcccatccacgcgacgacgcgcgcccagcaccatgtggtaacgcccgtcatcatcgcgccacaccttggggtcacgcacgtggcaggtcaaatcctcgggataatcatcggacgccagcaccacgcgcttttggctgaactcccgaccggcaaggccatcaacgctctcgacataaacagtatcggcgcgacggccggtattgacgtagtcgtacgtgccgtccgcatcggaaagcttaacgttgcccgtatagagcacgcgaatgcagccgtcctcggcaagcgcggagcctgaatacacgccatggcaatcgaacggctcgtcgggcagcagcggggcgccaacatattcccagttcataaggtcgcggcttgtggcatggccccacatctttacgccaccgttcacatcaaacggggcatactggaagtacgcgtgaaacacgccgcccgcttggcaaagaccgttggggtcgttgagccagcccgccggcggcataatatggaagcgctggccatacgcgccatggccgcactcagaggcggcagcgtcaacagcggcaaccagctttgcaaggtcgcggccaagtgcattagacatatcaaagtcctaacggatcgaaagtaacaaggcgccagagatcgacaccggatacgggaaacgcccgcgagcatacaacccgcgggcacccttcaatcaaaagctcttaggcctgctcggaagccttgggctcgtccttgtacaggacaaacgagacgccaaaggaaaccagcgcggcgaccgcaaacatgatcgcgtactgcacgggctgggccaggcacagcaggataccgaagatacccgtaacgcccgtaccggaagcggcgagcgaggtgagcgcgcagaccagggcgccgcagccgccgccgatgcagccagcgatgaagggcttaaagaagcgcaggttcacaccaaagatggcaggctcggtaatacccatgaaggcggacagagccgaaggaagcgctaggcccttgatcttggcatcgtgggtcttaaaggcaactgcaagcgcggcgccgccctgggcgatgttggcggcactggcaatgggcagccaataggtcacgccgtactgggcaagctggcccaggtcgatggcggtgtacatctggtgaataccggtgacgaccgtgggggcatagaacaggccgacgataaaggaaccgatgccaaagggcagggtgagcagagcctggatcagaccgaggacggcattctcggcccacacaaagacgggaccgacggcgataagcgtcacgagcacggtcacgaacacggagacaagcggggttacaaagaggtcgaacatctcgggaacgatcttgtgcagacgcttctcgaggaaggcaaggatcgcgcaagcgatgacgatggggatgacgtggccctgatagccaacccactcaaagctgtacacgccggggatgacggtgaccatggtctgcacgccctcggaggcgaccgtgtaggcgctctgcagcgaggagttgatgaacgcgccgccgacgacggcgcccaggtacggattagcgccgaaagccttggccgcggagtagccaatcaggatctgcaggatgccaaaggacgtacccgagaccaggtcggcaatcttgtagataaagttattggtgtcgagcgcgataaagccgttggaggccataaagttgagggcgctcataatgcccagcagcagacccgaagccacgatggcggggatgatggggacaaagacgtcgccgagcaccttaatggcacgcataaagatgttctgctgctgtgccgcggcctccttggcctcggccttggtggcagcctcgactccgctgagcgcaatgaactcttcgtagaccttgttgacggtgccggtgccaaaaataatctggagctggccctgagcctcaaagacgcccttggcgccgtcgatattctcgagggcctccttgttaaccttcgcgttatcggcaatcaccaggcgcaaacgcgtggcgcaatgcgcggcagagacgacgttgtcggcgccaccgatattgtcgagcacctcttgggctgatttgcggtagtccatgacttccccttcctccaacgggcgcacgtgcacccggccatctttgacacttacactgtaatcgatttcagtttcatatgtgtgtaatcgttttcatagtagggtgaacggtacgaaatagccggcgaatggtagttttgagacaaaaactggggactcaaaggcaggcagacgcgtccaaggcctagacattcatgagctgatgcccaagtttgagcgtcttgagaccgctctccccttcctcgccatcgagcgtattgagcaacatattggtcgcctcgacgccactggtcaggtagccataatgcacggtgggaatgccgcccgtcagcgcgcgcaaaaacgcgttgtcgccaaaaccactcacgcggtgtataccctcgcccatgccgcgaacctcatcgatggcacgcagcgcgcccgccgccatggtatcggtcgcgcaggcgataaacgaaacatcgggagcgacggaaagcagctcacgcgccgcaccatagcctgagtcgagcgtaaacgagcccaggcgaatcaaggcggcatcgagcgggttgcccgcggcgcgcaagccggcctcaaaacctcgacgacggtcgaaaccggccgcgcggtcctcatccgtaactccgatgtaggcaatcttgccatccaagcgacccgcaagcgcatggcccagctcaaaggcagcctcgtaatcgtcgtgatagacacatgccgcgccctcgacatgttggccgatcaacacaatgggcacgcggcacgactcaatcgcgcgacggtgctcgtcggtgatcatggttgccaccagcacaatgccatcgaccgggtggttttggaataaatcgaggtattcgagctcacgatcggccgcgttgtcggtgttggcaaggagcatctggtagccacgacgaccgagcacctggccaataccggcggtaatgcggctcacggattcggagttgatcttaggtacgatgacgccaatgagcttggtggaaccggtgcgcagcgcgcgagcctgactggaccgcacgtatccggtcagctcgattgcatgcttaatgcgctcggccttgtccgccgagatatatccaccgttgaggtagcgcgagacggcggcgctcgaaacgcccgccagctcggccacatctttcatctttaccacgagcacccctgtcattgaaatcgctttcaccatgatacccatgcggagcgacatgcgtgtcgcaagacaggacgtcacggtcaatttagctgtcgtagcacgggcatcgcagggcttcaactaaaaacttcgaaatataagtgccgaatcagttaaactgccgattcggcaccccgttacatttgcacacagtggcatgcaaaatccaactcgaaaacaactaactcactttggaaagacgtatcgctgtccactgccaattccgaaggaagaattgccggcagcgtcaaagcccccatgggcgaaagtccagtaacgaccatcagatatctcttagcgtgaccatacgccatggaaatcgcattggagagaaaaaacggtgcctcattcgaataaccggaaatgacctgaggaatgattttgatacccaacgcaagctcaaactttgtgaccgttttcagcgtcatgttgggctgagaattcaacaatttcgaaagcgactgaagactcacgcccatacgttttgtcagctcgcttttactcaagcccgagcgctgcatctcgcgatgaacaatatactcaatatctagtgcttgctcataggcacgggtatcgctcgtttccgtttccgcgtaaaagtctagatttgcatactctcccttgcgatttcccttctcaactttaggaaacccaagtcgataagcacgcagacgaaaatagatgctgttcttttccaggtaagctctggcatcgtcttcgctcatcagcaagaaatggacacctctcgatttgagacggtcaatctgctcggacgccgtaagccacggctttgtattagcggcggccattagatctccgttcgcgctgattggctcgagatactatgtaagagcgtttaactgggcgaatcacctagatatgactgttacgccgaatactcttcaataaagcctctcttcataggcgtaatgaagaaaggcggccatccggaaaacaaccgcctttctgtaggacgcaggcccgtaggttggttgcgtcaataccgctagattcgccctagtctcctatagggtcccaaaaggtcaatccagttaaaaacggcaggcagcccaaaacaacatctttcatgaatctccagacctatcgagcccgatcgaactcggctatccaaccagatacggcccgattacatcgaaaatttcgcccaccttagttgcagggttttgcgcagatggcttaatgttacccagttccctatggtacgcgacgaggcgcccagcacgctccaatgcttcgcctcgcctatcatccactgccccaaacatcccgtccaggttcttgcggtactcgatgcccaagttcttcgacatctcctgcgcgagggcatgctggcagtcggacgcggacatatgcgcggtcgtgtagcgaaagtgcaaaagcggccacagctcgaagcaggggttcgaccacaacgcatggaaggtcctcgaaccatcggagagctcgtcacatttgcgcttcatcgcatcaaagtcggacgcaggaaagtcatccttgtcatacacgagccacacgtgatcgaacgtctcgggcgcatagcgacagtgttcgacggcgaagtcaagcaggtcaagcgtgtgtctgccggtccccttaacgacaatggcaaccttgcgctcgttcgccgcgcccaacgccgcacgcacgccctcaaagtagcgaggctcggtctccttgccctcgctcactacaagatgacgcgtcatctgaaccatgcgcgagcggccctctcgcttgccgctacgccagcccttcgacttcttcaccaccatgctaatcccactcctcgatgcgggtgaggtacggatcggcgccgtagcgaccggacaggtattgcttgtcgaaagccgcgttcttgcttaccagattaccgtttgcctcgtggatatcggcgagagaccacagttggctcgcctccccctcgccgcgtgcagcgaaccatatctcgtcacggcggaacacatcgtttcgcatggttgacacatcctgggacgagaagatgagctgcgcgccactcttattgacctcaggatccttaaacagcagaatcacatagcgaagaagcttcgggtgcagtttggcgtcgagctcgtctaccacaacggtgccaccacgctcaagcgctgtcatcagatacgcagccaaccccatgagcttctgggtaccggcagattcctcggataaacgcagctcgtacgccttgcccctcaccttgtgcctcacgaagacgcgctggccgcgccactccggcgccctctccactctgaagccatcaatacgcacatcaacggcgcgcaaaaaacgcgtgacctcgcgcgagtcgccctcgtcgagcatttgctcgagcatccgctcaaggtaggaactgttgtagttgagaaacacagcgtcgagaaaccagctggccgcctcctggaccaccggcgcatcgaagttgatgcaaaggaacgataggtacggcaggctcgggttgaacctcgcagccgtcacaagcttacgcagtgtggggccgagttcaacctttgtatcctcgcgctcgaacagcatcgccgtacgcgacgctcccaatttacgccgccacagcccttcggacacgatctcatcggcgtgtacagacagaacatagcggtactcatgctcgcccgcgcggtaatagagctcgaactcggtgggctcggcagcagacacgtcatcaaattcaaacgccgaacaacgggctatcaaagggcgatcacccgctggcgcatcagcgctggcagacagcaatctaattggtctggccaccgccgaacgaacgtaatcaagagcctcgagcaggttagacttaccaccagcgttgggcccgtacaccgcagccaccggaaggaaactctgcccgtcggagcactcgatgagggaacgctcaaactccttcatcggcgtcgcctgcatggaaagctcagcctcgtcgcgataggaccgatagttcttaaaggtgaactgacaaagcatggtactcaacattcctttcattattttgaaaagatatatcagagtttttctttgattatagactttaagtagtctaaatcaagtgcttgctacaccaatgacagcaggcgcaaggtgccaaaccgcccatactcgaccatcccattgccgaaatggcgtttagctaacacgtcacacattacatgcatgaaaaaagggcaacactctcttacagaaagcgtcacccttaaagctcccaaagagctttaatattgcgctatatactatacaccttaatgaagtgaagcagaaaagaggccccaactcgtactgcatcgccctagcggttgacgagtgccaacgcataaaagcactctacatacccgcgcccgcagcgacccgaaagacggcatcgcactccacgaggacacattagtcaagcgtctcatacacaaattcgcaaacaactatactaccaatattcgaagcagcccttatcaagacgttatcgggagtcatctttaaagatacctcaaactaatcgaggcttatgagtccccagaacccctaccgtttccgggctctatcccaatttctcatgtagatcctttatggtctgagcttcatttaaaaagacctgatcaatttcagcgttgaggtcattgacgtaatcctcagcgacctttttataagtgacattcttaaccgaggagtcaatctttaatttcaggctgaatctttgcttgagctgctcatccaacagccagcgaaataacttgcgtagagaggtctggtcgcttttcgcaaagtcgatgtccaactcttccggagcgtcttcaaagtgaaggacctcattgccctccgagttcatacgcaacgtaaccgtaatcacgtgttggtcggcaccggcgttcagaacgattccgttagttaagttttccataaacaatctccctgtcggtaaatgcatattccccgccctcaagagtgtccatactcacttgtgtccacaccttaggcggtttgacctcagcaatatccctaagctcatcgcaaaagggattacccacgtaggtacgatagcaaccgccatcgtattcgcgataaatcgattgccagggcaaagtacgaacagcaatgttggcattatgggtggacactatgacaattttatttgctttcgccagctggttgattctatctacgataacctcgttgataaattcattgcccatacttgcctcaggctcatcgaggatataaatggaggcatcatcgtcgaacagggcatgggcaagaacaatcatcgccctctccccgttagagggctcatagctcgaatctcccccacaagacacataggaggtaacgcccagacagtccttaagcgaggcaattcccatctcatctgtcatcttgttaacctcggctattttcgaggccaatgccccacacggagttttggcggtatccgatgcattgccgattgccgcaaccaacgattttagattcttggccttcaccttatcgcgaagataagagaccttcgttccctgcgacggatttattaagtattttcgatgttgtacaacgtcgcccttttcagccagacgtccgagtaccactttttcctcataaggctcgttttgaaaagaatcggaaatcgaattcaaaatggatctcgcctttttgtagcttaaggcaaaagccgaaaacccggttccggaaggctttgtaggactccccgttcgcgcagtgatgtaacttttcattttcttgactgtaaaacactcgagatgaagtgcgtaggcgtcaacgaaaccggatcgcacataggattgcgcgttcatacatactctcagaacagcagatctaagttcactgaattcgttagaactcaagcaagcctcaacaatcttgttgttaagaatattattagcgctagatatcaatgtcttatagtcatcgataagacatctcatcgcgtcaaggtccggttctacaggtgcagaagccaaggcaaatccgaagcgagccgtgtcctttttctcgacactgtattcttcccagctgatgtaattgctaaaaggagttactgccggttcattccacgctctgatgccagcgaatttatcactcgcgtcgtcgacgccgagtttaacaaagtcctcctctttgggattcacgttcaccatttgtttatacttgtcattgttttctgacgcgtaatacgaagagacatcggtccaccccttcgcccgaaaatgattctctatcttttttagaagcgccgtcttccccgtgcctttggcgccaaagacgatggtgacgtcgttgtagacggggaaggtaagcttcgcatcgtcatcgaacaaagtgatttcaacctgctctgacgttttcttgtccataatggatttgagaacttcaggtgtctttctaagcaggagcagaaactggctgaagctcttgacctcaagtttaatctcaggaagggagcactcacaatacttgctccagtctttgacgtccgagccaatcaggcaatcgaccccatcggcatacatgatgccagcgcgcttaaggtttgaaggctcgaaaaagaacggggtttctactggaaaactcgctttcagtgcttgattatcggcgtaaggcagtgccttatctttataagacttgcccttgaagggacggtaatgagatatcacgatgaaatcgaacccttgtccgacaaatgcgccggcaagcttatcccaatcaagaacaaaatcatcaggatgtgtgcattgaaccaggccattacagacatcagaaaactgcttcgcatgcacggggtcagcaataacgattacatggccgacaaccctagacttgcctcgaatatcaagctctatgcccggccagagatcgattcccttggctgacgcttcagctacgcattgcttgaatattgaaaggtcgaagaggttatggtttgtaatggcggcgataccaacctggttgcctgctaaggcctcagccaagctggccgggtcaatatcgcgccctccatcgcccgatttcgccttgatggtatggcaatgcaaatcaatcttcataccagattcctctcatacgatagtgtcgagaaagttgatgtaagcccgattcgaagcgagtcggtccgcatcccaaacctgaatatcattagatatcctatgccgcccctatttcacctgcaagctcgaagatggccccaatcatccgtcctgtcccaatccactttgcacccacaccggaagttcgaacttgacgctgagcaaatccttgataaccgtaccgttcgacatcgcggcgaggccctaacactccgcaccacttccaacacgcgtctgaagaacgtagccccgctgaggttgcgcaggacagcctcaactgtgagctcgcccccaatttcgttattagctggcagcagccgacactcccctgcccggaaacagcccccccccggaacgctccacagacatgcaccccagacgccgagggcgatcacagcccccgggcaacaccagcgacccgcaccactcccgcacgaagatcccaccagtcggccttaccttggcggcaaacaacccgggcgcacaaagcgacccagggcacctccacccaagaaaggatcttctatgctcaaagacggcatcgcatacctactcaagtttgcacccaaggaagcatacatcgacgacctaataaacggtcgcctctacatgaacgcggccggctactatcatggcctgcctggcgaacagggcgatccgctcgaagcttccatggctcccggggtgcgcctctacagatatacttccctgcccatctactgcatgtatacggtccgcgagaacgatatcgtcgacaacgccgtgaaaatcccgaaacgcatgatccaggagttcggatgcgaggacggatggatcggcattgtgcagtacgacagcttcgcgcgcctcgccgacagacacaccaccgacgacggaagcatctacgcccacggtcccatctcctacggcgttcccgggccaaaactgatacgcgagatctttgagggcatcccgcacaatctcgttatcaaaacacccaagtacgcatatcagaaggagtatcgaatcatcgggtcgcgaccggtcgaatgtcgccttttaccagacgagaatcacctaggctgcaaaattgaaaaatacgaccacgcagaacttgacctaggcagcagccttgcggacttttcctggaaggtctcggtggcgagtctcgaagaagcgcgagacggccttatgctggatttgccgcatcaggcatagtcaacccaacgcgattcacaacgtcaccgggcaaccaaccatccctcccctccccaacatcccccagaaagttcgctgatgttgactggggttcccgtaaaataatccccaataaaatatgtgcggagtgcaggcctggagctgccttcggaccctattgactgctcaccgagaggctccgctatgaaacgacccctttactacctgctctgcgcgatcgcgtgcacgtccatggtcggcgcgacgatgcccatggcagccatcgcggaggcaattcagccccaagagaccaccgagcagcaggcgcaagccgacgccacgagcagcggcacagacaaggctgaagacggcaccaacacaaatgcgacagcagattccgcagaggacagcaccgcaacatctaccggcaccagccagaccgaccccgcggacgccaacaccacagacaccgccacccccggcaccgccgccgcaaccggcgcggccaccacagcccccaccccatccctccgagcccgcaccaaccccacgcccgccgcaatctccaccacgtcacaaaccacctacgcccactccgccacggcaacccaaaacggcttcaccttcaccgtctcgtggaacgacgcccccgcgggcaccgcgacgatcttccacgtaacccaggccaacggctcgtcccaggccaaggcgcgcatggacgtgcccacctattgggacggcggcagccaggaaagcgtctgcgacccgtcgcgcccggcatgggccagctactgcagcctgggcaccgcgggccacgactttacctttgacttcacggcatcgggcacctaccgcatctacttctacttcatggacaacgacagaaacgacccccaaaacgacaaggggatctactacctgcgcaccacggcggaggtgaccgtaaacgacgccgcccgccccagcgtcacgcagatcgtcaacagcgccgtggcccagtgcaggcaacagacaaacggctcggaatacgacatggcgctgtggctccacgactggacgctcgaccagctggagtacgaccacagccttaactggtgctcggccgaaagcggcctcacgcgccaccagggcacctgcgagagctaccagcgcatctactccaagctccttgacgccgtgggcatcgccaacggccgcatcaccggcaacggccacacctagaacgccgtaaagatcgacggcaaatggtgccagatggacctaacctgggacgacaccagcgacaactggtacggagatctggaccagagccatctgtactttggcctgaccgacgagctcatggcaatcgcccactccgaccacacggcaaactatcagaaggacggctacgcctaccgctcgaccgacctgtccaacaattactttgtgcgaaatggcaaggccgaagaatggacagagaagtacgccgaccgcattcagcagcacctagatgccaaggaagagagcttttccattgacgctgataaccagtcgttcccgccgagcatctcggggattcagaggtgacgcataatttctttcgcaaattgacaaccgcatagcggaacacggcccgcgccccgtcatatggattccagcggctaaacaacaaatcattgacgaagggagcacgggacgcgtctgcgatcatcgtaccaaccgacgaggagtcgctgcgcaaggacataaagaatctggtgaggaagaccgtcgaggagacgaccaacgcgctgctcgacgaggaggcgtccgagctcgtcagagccgagcgctacgagaggaaggcgggctgggaggcctaccgcagcgtccggtatgccagaaagctcgccattggagccgggaaggtcgaaacaagtgcgtgaggatgctcggtgcgctcggggaggtgttccccggggcccgccaccggcactgcgcggtgatttctaccgcaacgtgctggaaagggttcccgtgaccaggcgaaaggccgtagcgcatgttgaaggcgatccacgcgcaggaagcgcgcgaggcatgcggcaggaaggccggggaggtggcggacgagttggagtcgatacggctcggggcgggcacgaggacggagcgcgacgggttcgccgagacgcttgcctacacggaattcccgccggagcactggcgccggatcaggacgaacaacgggatcgagcgcatcaaccgcgagaccaggaggaggacgagggtcgtcggggccttcccggacggcaattcggccctcatgctagtgacggcgaggctgaagtacattgtggagcacgagtggggcaagaggaggtacctggacatgtccaagccggaggagatggacgagctgaggggaaagcgaagggctagaagaggacagggccgaggacggctaaatcaatttgcgaaagaatcttgactgtaccaggtgacgttagaaaactttagcagcatgtctaaatcatattgtcgatatcctttccttgcctatggcaaagcgtacatgcggcaacgtcacatagtcatggccgttccataaagtaaaaggttctggggcattcaaagccccagaacctcaccgtccgacttctaggaagggacattttttcttttcgacggctggccgtcggcggatttacatcaatatatccggcgcgattgaaatcataaatcacattaaaacagtgattaacacttatttattcaacgcacaggaccactgcacgagaccagatctaatcaacgcaaaataatgggaggaaaatttacgtgcaaggtatacaggccatttccaattattatatgcaagctgagcaaccccattaccaaccacgagcgcccagacacccatgctagtaaaggaaattaagacatacgacaatacaaaacccgcaatagccgaaactatataagccggaagataggggatttcatttgtactgataatgtaattacagcacaatgaatgatggttccaaaccgcaagataaacaaccaaggagaaataaagaagcccgtcgggggagaagcctttcttaactaggaacaaaacggggaagccgacaaaccagacaccgattgtgcatacaacaattaaaatccaatatagagacagacttttttcaataatttttcgtgcagtctgaacttcaccaccagcataggcagactgaaacatcggaataaaagatcgaacgtaggcgctggcaaacccgtaaattgcaccaccaacttgaataattaacgaatactgagagtttacctccacgccaagaaaataggagcagagcagggaactcaactgagtggaagcatagcagcaaagttgaacaacgccatccctccacgccaaataagccactgaagtaaacgtttcttttatttcagaaatagaaacacccgcacaagcgctatttgcttttttcatcgcctctgagtgaacctccagaaagcgaccgcaaaaaaatctcagtacaatgtcattaaacagataaccgatggcagcgccaataatgccaaaacccataaacagcaaaagagcagacaccacaagctgcccaatgcgaccataagactttgccctgctttcagcggaaatatccccgaaccctctcaggcaggtcgtgtaatgaaaaaagaatagattaaaaaacacgtcaaaacaaaaaattagccatgcggcccagcaagaaatgggatcaatagcactcgaaattgaagaaatgtaggcagttccaactgtagcggtaagcatcaggacaacgcaagaaattaatgcgtaaacaagccgggatgttttaatcaatttgccaagaagctcatagtctacagaatcaccaacttgagatgaatcgtagccgctcttgctaatgctacgtgcaccgctaagacaataaacaatatttctcgcaaaagttggcgtaaagccaaattcaaatagcagcgttaaattgcctattgcaacaaaagtgtaccagagaccaagttcagcgctagataagtaagcaagcagaaacggaagaaggaggaagctgctccccattgaaagaacagtacttacatagttccatataatgtctgccttggtagttttaattttagccattatttagccatctccaaaacatcctttgatggcaccccggattgacaaggccccttatctgaaaaggtgggcagcgccataagcataaagaaattacatgctggatataacattccgcattcaacaaacccaattaaggaatacaagaccaagccaatgaaagtcacgtgggccgaaatacgcgctttatttatcgctacgcaatagaaagcaacaaacgcggtaaatgggatcaaaccgtattgaataagtaatcgacaataagcattatcaagcatgactcttgtttggattaaataaccgcccgttgcagacggcagcgaaactatggccgttaagtcattaccaaaaacagtcagagggtagttttcaaaataataggcggaataaaaaatccggttggtcattaaattatcaagctggacaagccatttattggcaccatgggaccacataataggcagggctatactaacaatcgccagaaatagcggtaaaaaactaaatagggacccatatggttttgaacggcgactcctgaatgaaatatccgaatacaaggccattacgaaaatgccagctgcagaagtttttgaatcggctacgaaaaaagcaattacaaagcataagatacccacaagaccgcttttgcctttcagctcaaaaatagaagcagaataagcaataaacaaaagctggccgaaattattaggatgggcaaaacccatcgaatttcgaacaaaattgctaccgcgcgacattaatacagaaggaatagcaccgatactattgagaccaacaaccatcaatagcattaagacggaagataaaagaataggccttgaaatgtaagattcagggacgtcttcagcacagagacaaagcagagccaaccaaataatctgaggagctttatttgatttcagcgaccagacgcaaattataattaatagcaacccaacaagtacttttacatgggaagtcttttgtagtaaaagcttcaacagtagaaacgctagggcacataactcaaaaaccagcgaaagcgctgcaagagaaatcccaaacacattggcagcatttactgatccaatataatatgaaaatgaaaataaagccaaagcgaagctgaacagtacggcacccgcatttacccgtttaatctcagtccaggatctttcaacattaatcaaactcaattaatataccccataaacaaacttagtgaagccaattgcagccataactcgccttgcaagaagaaggcggatcgtaatatgattcttcatttcagagattaaacggcgtgaataacggtgagagtcaaaaccttccattaaatagctgaaatacggctggcagaccatattagagacaggcatataaagctgattcgattccaaccgtgcaagattacgaatcaaagataagacttccctgactgcagattgcttgtaaagatcgttcaaatccggattcacgagacaaagctcgtatagttttatcaataaattatcgacaccctcgacagccgagatatcagtatttctcgttactgaatcactattgttgacatagcaatagaccgccgagtccactacttttacactttcagccagacgataagcatctaccataaacaaagcgtcttcaccgaaacgaatgccatcttcaaatttaagaaaaccattccggaataatgatttcttaaatatctttccccaaacgcttcggaatacaacacctttagtaaagctcgaaaacggaactttattaacattatcccaaaatgcaaggctaagagagcatgctgttttccagtcgatgcttatagccttgcccgaataatcgccatgctcattcagtagagccccgataaccaagctacagccatctgaggattcaagcaacagcctaactgcatttataggcagcatatcgtcagcatcaacaaatgccacccaatcaccggaggcctcatcgatacccctattacgcgccacgcatacaccactattattttgactaatcagcttaatccggttgtcgccctcagcaatagccataactagctcagcgccacgatcagtcgacccatcatcaacaataattatttcaatgttgctcacactctgacgctgaagactatttaatgtcttttgaatcgttttttcagcgttatacatcggcacaatcacgctcacgagaggattgtcgaccaaggaagattgacagcaatttacctgcttgcttgttgacgtcataaacagacgcccccccccgcaagcttatttggacgacccatagaaataattgcgtcaacccattcggcaacattaaaggagcactttaaaaatttatcagaaatatcagccgcatctggaacgccaaatgaacagacacaaggtaatccgttaagctgggcttcaattgcggcaacaccaagtccctcaaacgtagatggaaatacaaaacagtcaaatgaagacagaatgtctttaatatcttttctttcgcctgcaaacaagacactagatgagatacccagcttagccgcagattcctgaagactcttgcgtagggggccatcgccaacaatcattaatttacagttggatttaactgttagcagttccttcattatctttaaaagaaaaatatgattcttttgactagtcaaacgtccaacagtaccaataagaaaatcttttgacgaaaggccgaactcttccctaattactaccctgctgacaggatcgtactccatgtcattaaaatttaaggcatttggaagcacctgaaaattatcgccccagaagaatgaacccgcttcttttgaacacgcaagcctaacattagaattacgtaacgccgcacggcgattaaaacggcttataacttgagtcggcaaaccgcccaaaaaacgagaactgtgagaatgagcaatgcggacagagacattcgcccgttgagctgctcgcaagacatccgcatataaaagatgattaaagttacaccaaaccgcctggtaacgatttggttcatcttgaaatagatggtctagatactcaaagcgcttaatgggcctatcaatatccgggcaaatgtggatttcggagttcatctcatgaacgaatgcaacatctgataaatcagacgttgcaagaaattcaaacgtagcatatgagctaagggcctttatatacctaccaacaacgatttcggttccacccagcccatttgaaaggccagatactaaaaccctaggcttattgtggtctaaggcagacgaaaccattaaaaagccttccttccaaatctaagtaccgacagaacagaggagatgaaccaagacagcttgggtccaattactggcgcaagctttttccgcatttcaacacggaacttcttagcgggtgacaaccaggtgcctgaataatggtgaatagaatatgtatcatcagtaatttcaaacttgccactatgactgtctaggggatcaaaataagtagcagggtatgcagtgaaaccatttaactgctgaaatgaaccatctctcttaagagcacaactcacttccaggtaatcagttagcaccctcggagaggtatccatagagttgcggccttttcgcatctcaaatctcatagattcatataattttgcgacatcgctcatgacatggcttccggcctcagaacccatgatgaggccgggattcaagaagaaattattcttcatgaatcccgcaaaagcctcattatctaaaagctcgtccagaggcttcaggacttcgacatctgtatcgagaaggattccaccctctgaatacagtattctgtagcgcgcataatcgctgacaaacgcccatttttttgaggcatatgcctcacgacaaaattcacattgatttatatcgaaattactttcgtcccatctacgaatttcccaatcaggcatgatcttcgaccaagactcaatgcattttctttcaagttcaggaagctcacttccaccgaaccagatgtagtgcagaactttaggaatcatcaattccctttcgaacaataggctacttctttatgatttttttaaccagacgcttcatcgggtcataaattccaagcttttcgcatgtatgcctagcaaagcgctcggcttttacttttccggaatcggggaaccacttgttcataagctcctcaccatccagattcgccacatcagccatgaattcatcgcgacgcggattcagcttcacggacttagtaagttcacgaacaccttctactgcagcctcaacatcaatctccttcatacgggcatagcttgaggctcgatcaagcaattcttgtccctcatcgctttggatgagaactcgagtgacgcctcgattgtcgtcgaactctttcgagagtcgataaacatcgaagaaatcccagcaagtcaaatcagtaacgcgataacgctttttaaacgggcattcgtaacaaatgggtcgatctgaaagatcagcaaaaaaggcccttaggtaaggatctgtttcgacaccttcactgtacagccgttcaccatacagagtctcaccttcgagctcgcacatatttgaatagcgatagccaaaccgtgatttatctctaaaaagaacggtctcaccttttacgccaacctttgcgtcaagccattcgacctgccgcgcgaacacagcgcgagcggggttcgcgcggcagacgaagtctgccacgcgtaaatttgccggcttgccgcccaaaaatcgaagcaggccttcgcattgacaaggggtaccaataaagagaacttcacgtccagtttttagttgttgtttgacctcgggatacgcagggccaacaacgctctgaacatatttactgttgcggaagcgccaaagttcatcaacgctttccacagaaaaatgtccgaccttaagtcgcccaggggctccttcggctcgcacaagctgttcaccgcgcaaataacctgcgccaaacacaataccgccgttggcaatcacggcctgagcaagggcagtgaaggctccaccagaagtgctttcagcaagcaccttttgatcattatgctggactagaaaggctcgttgggacttaggctcgtccttatcaacattaagcactgggcaagccttttcgcataatccgcaatcaatacactggtcagcattgactacggggtactcgcagccctcggcgtcatattccattgatatgcactgcttgggacatttttgagcacaggcagcgcaaccgcagcatttacttttgtccgtgatggagatcatactgttccctacaactcaagagctgatttaagccaattggccgattcattcctatacacattaagtcgttgacgtactgacacaaagtcgatttcatttgccattgcggcacggaaagcatccttcgattcgcaaatacgatcggagtttccaaggacacgcaacaatgtatcaatacgtgagttcgtagactgagcacccatattctcgtggcgacggaacgagaagaagggcacttcaaaaatatttgagaaaacgcttccgtggaaagagtcagtacagacatacgaagcatgggcaatcaagttgacccactcagccggaccggcttcccaaggataataatccgcgtaatcgtcatcagccttaacatactcatcgggatgagcaatggcgacgatcttcaaattatgctgcttggcaagctcttgggcacattcacgattccatgcattcttacccatgaaatagcagaaaacatagagctcgtcaggaacgtcaatcgaagaggaacaagcaaggcttgcccactgatctctagccagcagcatcgtagggtcgcatacaacagagcatcggacgcccgtagctttctctaccaaatccgctcccgtatcctcgcgaacagaaatggccgaaaaatcggaaagaaaatcttttgttttacgaagatatttttcagaaagggaagatactccaaaactagtggaataagacaccttgcggacaggaggccgcacgaaagatagtgtaaagtacctaccagcaatgttaacaggcagccaaagctgatcgctgccaacaacaacgctgtcatagtcagccacaagcgccccaagttcttcaaacgaagcggcttgaggagtaaaactaaaatgtgttgactcgaaagatgaaaatgcacttttcctctttgccattttctttccaaagtcagcatcaagcttctgcttgatgcgatgctttacaaaacccagctttgcacgataaagatctacatcaaatagatgctcaagatagtaatcattgcgtccttcagaaatagcatgacccaggccacgtttatcaatagtattgacttcaactcccagttcctcaagggcacgctgggtcgcgtacgcctgaagaacgctgccaaagttgattttgtcatgacacgacgcgactgcgactcgcttagaacatgtaatagtcaagctatccccttaatcaacagaacctaaataggtcatataacaatccaataacactctggccgcagcattaatttcaaatacctgcaaaccggcatcgtcgccaggcgcgaagacctctgtgctcaactcaataagtctttcggcccactttatacaggagctagaaagtgattcaaattgcatcatggatgtaacagcggtctcagaggtaacggcatcagacgcaagaatgggtgtatgcgatgcctggcattcgactccgaccattgggaggccttcatacaggctcggcaggcagaaaacatcaaatgctcgatataaagatgctgcgtcgcttctagtgcccaaaaatcgaacagaatggctaatccccagacaatcagcttggtcctttatctgttcaaccaacggaccagaaccaaccaaaactaaaacagcatcattacgaatctttaaaacctgattgaatatattaagcaaatatgagtgattcttctgctctgtaaaacgaccaatgtgcccaattagaagctgtccgtcagcaacaccaagcgatcgccgcgtccttaggcgatcctcatcatctggcgcgaaaacagacaagtcgacagcattacgcatgactacaaattgagaactcgatccaaataaccattcaccagcgaatttactacatgcaaaacggtgagtcggataccggtttgattgcgttttcagcacggccttcagggcattcctggcatactcacccttaccactcgtagaatggctatgggcgatacgcacggggacacccgccttcttcgcagcacgaagaggaaagaccgaaagcgcgttgatgtgactatggacaatcttccagccctcttgcttaaagagacgctgaagctctcgctggtattcagctacatgctgatagggcggtatctcaaagaccctgccaccgagcgattcgatctcgtcacggggaacaagcgtcgaatcggaatcaacaagaaagtcaaactgcactttactgcgatcgatgtgacgatagtaattcataacgacagcttcgacgccgccgccaaccatcttgccaacaacctgagccaccctaaccggttcagtcatttagcaagcacctccaccggtaaagacctcaacgaccgtgaggagaacaatcttcaagtccgtgatggggccgcgcttggcgatgtactccaaatcacggcggaccatcccgtcgaagtcggtgtcgttgcgatcggtcacctgccaccagccggtgatgccgggcttaacggacagtcgctgcaggtcgtactcggtatattccgccacttcgttgggcagcggcgggcgcgggcccacgacggacatctggcccaggaacacgttcaggaactgcgggaactcgtcgatggagtgcttgcggatgaacctgccgatcttggtgacgcgggggtcctccttcatcttgaacatggcgctgttagcgctactgtaaaaacaaccaatttcgccatcgcactttagccgattccgccggcctcgcgggccaggaaggcgttcatcacggcgtcggcgtcgctggcgataccggccttgacagcctggttggaaacgaagctcagagcctcgtcacgagaagcgaagtcctcggcgacaaagacattctcgaccttcacgaagtcggcagcctcggccttgggggcctcgacggcagcggccttgggggcctcaacggacctggctacaggagcggccttctgattcttctcgaaatcgtacttcttgaaggccacgaacaggatgccaccgaccacagcgccgatgaggatcgcgaggacccacagcggaccgttctcgacaacgggcaggaccaggaagccgccgtgaggcgccggatcgtgaacgttgaagaagatggtcaagatggaagcgatggaagaaccgagcatcatgatgggcatgacgggccagatgttcttggtcatgaacggaatggcgccctcggtgatgtgggtgcaaccaaggatgaggttgacgataccggcgtcatgatcctcctggctgaagtacttcttgccgacaacgacggcgaaggtggtgatcagcggcggaacgatgcaagcggcggagacggcagccatgaagttggtgccgaagttgtaggtctcggtgccgacgccagcttcgagagcggtaccgagcaggaaggtgccagtagcgtaagcagccttgttgaccgggccgcccatatcaaaggcgcacatgcagccgatggccaggccaaggatcaccggaccggagttaccgaggctctgcaggaaatccatcataccctggttaatggcagccatggggccggaaataccgagcatgaccaggccgacgatggcggtagagcacagcggatacagaaagattgccttcaggccattaaggctcgcgggaattttagagaaaaccttctcgagcagcaggatgacatagccagcaaggaagccgccgacgatgccgcccaggaagccgaagcccacgccggcgccaccggcgtcgatcatgccggtctcggcgttaacaggcaggccctggatggcaatcataccggcaacgaaaccggggacgagcgccgggcgcttgccgatggattcggcgatgtaggcggaaagcaccggaaccataaggttcatggcgatgccgccgatgatcttgagcatcgcagcaaagctgttgtagtcggcagccgtcgaatcaaaggacgtgatgccccacaggaacgaaatggcggtcagaacaccaccggcaacgacgaagaccagcatgtggctgacgccgttcatgaggtgcttgtagatgacgtggccgatggactccttctcctcgacctcgtcctcgacatcggcggcagcggcaaccgtgtcgtcgcccttggcggcgagcgcgcggtcgatcagcttaccagcagtctcgacagacaaggccttggaaacaccaacggaaaccatgggcttaccggcgaaacgctcagcctggacatccttatcggctgcgacgacgacggccttggcaccggcgatctcgctcttggtgagctcgttctcgacaccgacctggccatgagtctcgaccttaatggtcagaccgcgctcggcagctgccttctccagcgcctccttcgccatgaaggtgtgcgcaatgccggtcgggcaaccggtcgcggcgatgatgtcaaacttagccatgtgtccctccttcttgagtacagcgcccgcgggcgctcccctacacgcgcttcgatgcgcgtttttccacaactgaaagataccaacctaccgtccgcgtgagaagagacaaggcgcaattctccggtgaaaggttctttcataaccgtaaacggcaagtgaaagtttaccatcaacacttgaaacggcaaggtgtatcttgtaattgaaaatgcccgtatactatggcattgcaaatcaagttagattttcatgccaaccaggagccatccatgaccgatagtagcaaaagcgcactttccctcattagtacccaccagggatacagcgagtccgagcagcgcattgtcgactatatattggagcaccagtccgaggcgccacgcctcacggcggctcagctctcgcgcgctgccgccacgtccgaggcgaccgtttcgcgtttctgccgcaagctgggctttggcagcttccgcagctttcagttttcgttggcgcgcgacttagagagtcagcgcaacgagggcctgaccgacgaggtctcgctcgacaacatggagcagagccttaaaaatatcctcgccgccaaggtgagtgagcttaatgcgaccatcgacggcattgatcacgacacgttggccgcagttgtacacgcgcttaagaatgccggcgttattgagtttgcggccgtaggcaacaccaacgccgtcgcgctcgacgcgacgttcaagttctcgcagctgggccttcgttgcatggcaagcaccatcagcgagacctcgattggttttgcgctcacgctgcgccccggtgacgttatcgtgctgatctcaaactccggcaagtcgcgccgtctgaatcgcatggcaaaagcggctcgcgactgcggcgcaaccgtagtcgtcatcagcagcgacagcaaatccccgctcgcgcgcctggcagactacacctttaataccgtcaaccacgaagcactactgacaacgggcgacttcgcgttctccaagatgagcgccacgatgatcatcgaggtcatctacaacttcctgctgcccgaaatcgaagacgcccgcgagcatatcagctactacgaagagctcatccagccggataaggttgtggagtaaaatgcgtagtgggacaaaaatttcagtctattttgtcccaccaacaccgctgatacgacctaacctcgagcttcttcgagcatctgctttgcgtgcgccaggctagcctcggactgatcgccgctcaacatgcgggcgatctcggcggtacgcgcttcgccggttacctcgtccaaatgcgtctggggaacatcgcctggttccttgctgacaacataatgcttgtcggccatgacggcgacctgcgccaagtgggttacgacaatcacctgatgcgtagaggcgagatctgccagcacgcccgcgagtgcacgcgccgtggagccaccgacaccggcatcgacctcgtcaaacaccagcgtatcgacaccgtccgcgttaccgaggacaaccttgcttgcaagcatgacgcggctgagctcgccgcccgacgcaatgcggcgcaggggacgtggcgtcaagccggcaccgctgcggtatagcagctcgtagctcgaaggaccaacgggcgtccactcagcacggggaagatcgcgcgactcccagacgagctcggcactacccatctccaagcgcgccatctggcggccaacctcgtggcagaagcgcggggccgccgtattgcgtgcgcgcttaagtgccttggcagcggcaaacaactcgcgctcggcgctcccgagtgcctcacgcgcctttttgatctgctcatcgccatcatcgaccagggacagcagctcttgcgagcgatcgcgcatggcaaaaacatcgtccatggtgggaccccactgacgcaacaggcccttgaggtcggaatatcgctcacgcatgcgtgcgagctcgcgcgggtcgaaggcgacgccatcgcgataggtacgaagctcgttcgcgcaatcctcaagggagatacaggcatccgaaagcgcatcggcaatgtcgcccagtttgcgatcgacggtagccattcgggaaagttctgccacggcgctgttcacggcgtcgagcgctcccccttcggaggcaagcgatgcatgggcatcgttagctgtggcaaccagtacctcggcatgttcggagcgcggcagcagttcctcgagttcctcatactcgcccggtttggggtcgacctcgccgatgcgctcgagcgcaaagcgcgcttcctcgacgcgactcccccgcgcacgtgaggcctcctcgacgcgacggacctccttggcagccgcgcgcgaggctttaaagcaagcacggtagtgctcgagcgcctcgagcgcagagcgtcccgcccaggcatcgaccatcgcaacgtgatgcgccggatcgagcaagcgctggtgctcgtgctggccgcacagatccatcatcacgccgacgcgctccgaaagctcgcgcacactggcaatgcgaccgtcaatcttcacgcggctgcggccctcggcagaaaggctgcgctgtacggtgaacccctccgtgtcgtgcggtccgtcgaagagtcgcgcctcgacgctcgccagtgcctcgccctcgcgcaccgtcgacgaatccgcacgctcgcccaaaattagcttgagggccgagagcagcgcggtcttgccggcgccagtctcgccagtcaggacagtcaggccggcactcggcaccagcgtcgcctcgcgaatgagtgcaatgttataaacctgcagctcatcgatcatgacggactccgtagaatacgcggctcaccgagttatagaagctctcggggccgtaatccagcagcaacacatctccgggcccgcggcgcaccgccacgctctcaacggtgccatcgcaggtaataaactgtccatcgatagcgatcgccggaacgctcgggcgatcatcggacataaagatttcgacgacatcactcggcgaggtcaaaaaggcacgagcctgaatggtgtgcggcgcaatgggtacgcagaccatgcccgtatagtcggggctcacgatggggccaccggcactgagcgcgtaacccgtagaaccagtcgccgtggacacgaccacgccgtcgccacgcagacggtcgatatgatggccggacaccgtgatgtcgaactcgaccatatcggacagcggaccgcgggtaagcgccatgtcgttgagggcgaaggtgcgcacgacatccttcgtaccgtcttcgcgcacggacacgatatccgcggcgatggtggcgcgacggctcacgtgcagctcaccggacagggcgtcgctcacgacctgcaggatgtcgcgctcctcggggctcgcagcagttagaaagcccaggtgaccataggaaagaccgaggataggaatctcacgatggttgaggatgcgggcagcgcgcagcaacgtaccgtcgccgccgagcgtaatgaccagatcggagccgtcaatatcaggcgtgctctgaatcttggatcgctggtcggcagcccatgcgacctcatagccctggcgagtcagccaaagctcgagcatcaggccgctctcgaccgcctcttgcttgtagtaattgggaaccagaaagaccttcatagcgttgcagctttctcgctcataaccgatacctgggattgcagctcgtcttgcgagcgatcgccggggtcaaatctcgtgccgtacaggaaaaactcaacgttgcccttggcaccatgaatgggcgacacgcacacatcgaccgggaacaggcccttggcagcaaagagttcaaccgccgccacgagtgtatcgcggcgcacggcgggatcggtcacaatgccgccctcgcccaccagcgccgccggagcctcaaactgcggctttacgagcgtgcagaatgcnnnnnnnnnnacccgtaggcgccaggcacgccagtaccgcatcgataatgttcgcgatgctggtaaacgagacatcacacacagccaggtcgatagtgccggcatagccaagctcaggcagctgcgtcacgtttgtgcgctcatgcagcgtcacgcgatcgtcctggcgcaacgaccaatcgaactgggcgcgacccacgtccaccgagacaacggtcgcagctccgcgcttgagcagacaatcggtaaagccgccggtagagcagcccacatccagacaggcaaggcccgtcggattgatgccaaacgcatcaagcgcgccttcgagcttaagaccgccgcggccaacatagggaatgcgcctcttcacatgcagcggcagccccgggatcaccttaaggcccggcgaagtcaagcgctcaccgccactcgagaccaagccggccataagagtgcgaagggcatccgcgcgatcggcgcagatgccctgtgaaatcagttcgtcatcaagacgcacgcgtttcatgaatgccatcaaccattcgtatccggagatgcggcctagctatcctgggattcgtttgccgcatcctcatcgtattcctgctcgagcttgtcggcctcacgcggcgtcaactcaaacttgtcgaccatatcgaccgcgcgggagcccagctcaatcgcttcgtcaaacaaatcgagcgaacgctccaaggaggtatccttggagcgaacggtagcgatgatctgatccagacggtccgaaatctcatcaaagttacggacagaaccctctggcatggctactcctcgacggagtcggcctcgacggcctcagcagcgtccgcatcctcggccaacacaccagcctcagcctgggcaaccgcaaccttagcggcagcctcggcagcctgtgcctcctcgcgagcgcgatcctcggccagcagctcctggtataggtcctcgcccggcagctcctcgctgcgagcgatcttgcccagcacgccgttgacgaacgacgcggaccggtcggtgccataggccttggcaagctcgacggcctcgttgatcacgatggcgtccgagacctcctcgtcggtgaggaaacgcatctcgtaaacggcgatacgcagcagattgcggtcggcaccgggcatgcgcataagatcccagttcttggcaacggagcgcagagcgcagtcgatgcggtcgatatgctcgtaggcaccgcggcacagctccagcgcataggggtcgaggggacccttcgagatcaggaaatcaccctcgaggacgcgctcgagcgggctgtccgtggcctcggcctggaacagcagctgcagcgcctgactgcgggcaagcgtacgcccgcgataaaccttaaggctcaaaggttactccttggggaaaacgaggccgtcgatgcaaacgtcaacacgctcaacctcaacgccaacctgggcatcgatggcagcgaccacggcagcgcgaacggcctcggcgagtttcttgaacggatagccaaagaacaccacgacacgcacggtgagtgcgagcttgtcgccaacgacctcggcctcgacagccggctcggaagccggggccttggacgagagcatcatggagacaaggttggtggcaaggtccttgacgccaacggaggcgatgccctcgacatccgacacggcgcgcgagacgatggcggtcaaaacatcgggcgaaatgccgatgccgtcaatcttgatttcctggggcatgagtcctcctagaagagttggttgctagacgcgggagacgaacttgccgtcgcgggtgtcaaccttgatgacctcgccctcgttgaggtacatggggacctggatgacagcgccggtgtcgatcgtggccggcttggtggaaccctggacggtatcgcccttaaagcccgggtcggtctggacgatggtggtctcgatgaacatcggcggggtcacgcccatgagctcatcgtcggcgaagagcagctggcagatgtcgttctcgcgcagccacttggagttctcgcccaccatgtcctcgggaacgggaacctgctcataggactcgttgtccatgaagatgtagtcggtgccatcgttgtagaggtactggaactcacgggtggtgagcatgacgctctcgaacttggtgccggcgttgcaggtgttctcgacgacgcggccgctcttgatgtcgcgggtcttgtagcgcacaaacgcgccgcccttgcccggcttgacatgctggaactcgacgatggtgtagaccttgtccttgatacggagaccgaggccgttcttgaagtcggcggtagaaatggtaggcatagcgacctttcttgttatgggcagaacgcacaagcgtccaaattacatacgacagaaattatacacttgcagacggcgcctgcggcgagcgcataaaaagagaacgcggggcgtccgaatcgattcggacgccccgccccaaaaatctatcgaaatgggctagcaatcgatgacgtgcaggtcgtgcggggtcttggtgaaaggctcgtagccgttctcggtgaccacgccgtaatcctccaggcgcacgccgcccacgccgggcaggtaaacgccgggctccatggtgacaaccgagccgatcgcgatggtgttcttgctgcggttgaagttgggcagctcgtggatgtcgataccgacgccgtggcccaggccatgattgtagtaatcgccatagccggcatcgccgatgatcttcttggaaagcttgaagatgtcgttaccctcaacgcccggatggatggcggcgacgcactcctcgtgcgtgcggcgcacgagcgcgtacaggtcgagctgctcctgcgtgggctcgcccatcacgacggtgcgcgtcatgtcggagcggtaatcgcagtagcccgcgccgtaatccatgagaacgaaatcgcccttctcgatcacgcgatcgctcggcacggcatgcgggttggcggtgttgggaccgctcgccacgatggagccgaaggcaaggctgtcggcgccgttggcgaacataaagttctcgagctcgttgcgaacctgcttctcggtcataccgggcttaataaagccgagcatatgctggaaagcggcatcggtgatcgactgcgcatggcgcataagctcaatctcctcggcatccttgatggcgcgcatcttgcggatgtcgtcgtgcatcagcggtaggatgcaggcgacggaacggtcctccaggccgcgctgaataccctggtagaagttaatctgcatatcgtcctcgacagcacagacacggcacttgttagccgcaatcttgccggcgacccagccggggatggtaccctcgtccatgtcgtaaacccaggggctgccggcgggcgtgttctcctcaaagctgttgaggtagcgcgagtcggtatggaacaggcactggtcggccgtaataaacgccgcgtgcgggaattcaaaggtgtaatcgaaaacgcccttcacgcccgtaagccaacgaagattggcctcgtcgcgcaccacgatggcgtcgtagccacgctcggccatcagggcacggacacgctcgatacgaccggcaggaccggcagcaaactcagacatgcagattcctttcttgttgtctctatatagacgggacgggtctcaaccgaacgacggaatcgcatgcgatccgcaaccgattggaaacccgcccctcaacatgatacgaaagaggatggaagtcaataaatcttagagaagttctttacgagaagccaagtaggcgtgagcatggcgcttaagaacctcgtcctcaacgttcgttaggcgaatggcgccgagtgccgcgggcagcggcaacatgctgcggttcgagcgtgcaaactgctgcttgcggaactcctcgatatatgcggcagactccagatcgaaggcaagttcctcgataccaaagtcctccaagcagtcatcgacctcaaagacgtaatcgatatcgaaatcgcaggcatcatgtgcaaggcgtgcctcaaagcgaatgccctcggacaacagctggtaggcaggggcctgcgaagcggcatcgcccaagcaggcgcgcagggtacgctcccccgtcttgccaaaatcgagcgcatggcgagcgctcgggttcgtggccatcagtacgtccttgcgggcagtctgagaccattgaacggcattgacgagcgcgacctcctcgcccgcgagaatctcggggacggtctcagtaaactgattccaacgggacttactgctcgaaagcatggtgccaacaagtaccacatagccgagcttgaggtcctcggggtccgcctcgcgaacaaggtcgaggtcacacacgaccaagcccggttcgggacggaacgcgatagcgggaagcgcattcgacgacgaggcaatgagcggcttcatggtcgtcgcgaccgtgagcatggcgtcaaaggtcgtcggcagcagcgcgcactcggttcggccacaccactggttggcgcaccagctaacaaccgagcaggttgcggcatcgccaacggcgacaaccagatcgtcgcaggtaatgccgttggcagacaaggcgccaaagatagcatcggcatcggccagcgtggcaccagcaggcgaaacctcaagggagaactgcgacacggcaaaaccggcgtcgaccagcgcatgctcgacgacctcatcaaaacgttctgacgaggcggagttccaaaccaccatcgcgcgcttaggcttgcccacagccgaggcaaacatacgcgacagctcatcgaacgcgcccaatccgacacggacatcgacgctgcggttttggaaattgatcagttggcggcgaatcatagcagtccacgctccaaaagcatctcggcacaaaggtaggaaacgtcctcgaaggacttgttgcgaatatcaagggtaatatcggcggcctggcgatacagcggacggcgatgctcaaacaagcgcgcggcatgctcgggcgagcggaaatcggggcgcgtgtcggaccgacgaatctggcgaatcgaatcctcaaagtcgccctcgaggtacacgcacgtacccatttcgtgcatcagctcaatattcaccggcgtctcgacgataccgcccccgcacgaaaccaacagactgcgctcgctttggagcgaacggagcgccgaggtctcgagctcgcgaaaacgatcctcaccctcggtctcaaaaatctcggttaccgacttgccgcaacggcggacgactaggcggtcggtatcgataaaacgccgcttgaacatagtgccgacgttgcgcgcgagcgtcgatttgcccgcgcccaaaaagccgataaagaagatatggtcgcagccgtgtttggtgtgctgggacatgacgagacctattcctcgcagggaaggtcgcgcagggcccggcgctcaaagatacggaagatctgcgtataccacaggtcctgcgtggcctgcggctttaccaggatggtatcgacgccggcgaagttgccgctccacacgtccgtgtagagctgatcaccgatcagcaccgcctcgtcggccgtggcgccgaggcgcttaagacccgccttgagggcaaacggcgccggcttcatggcatggctgatggcctcgagtcccagctcgcgtgctgatgccatgacctggtcgcgatgccagttgttggacaccatgcacagcttaaagcctttggcgcgggcggtatcgagccaagcggaaaccgcagcgggaacctgctcggtgtcacgcggcaccagggtgttatcgcgatcgagcagaatggcgcgtttgccgtcggcccaaagggtatcaaggtcgatgcgatcgaccgaggcaacgtaacgtttggggctaaaaatcctcatgctaattccaagactgttgatgctcttcgtaggtttgcgagaagtactcctcgtcctgcgtaatgtagaaatacaggtcatcggagtcggtcggctcaagcgtggccttgagtgcctcgagcgacggagagcagatgggcgtggatggcagaccctcatgcttataggtgttatacggactatcgctctgcaggtcgtcggcggtaacctcgccaccggtgacatacatcatggtcgcatcgctgttgagatagcgcagaccatcgagcttgccggcaagacggttgtagaagaccgaggccacgtgcgcgcgctggtcggcgttgaggccctcgcgctcaacgatagaggccaagttgacgatgtcgtagtcggacatctccacaccgtagcgttccttgatcttggcttcgcagctcgcaaagtcaagcgacttgtactcggtcttaaactgatcgagcatagcgcgaatcacgtcatcgaccgtcggcgaatcgcccaacgaataagtcttggggaacaagaaaccctcaagcgagtcgttggcggcgcccttaaggaagctatagtcgtccacgtagttggaggccttagcctggttgaggaagtcttccttagagatgccatcgtaggcctgggccacacgatcggcgacttgatcgaccgtcaggccctcagggattgttagcgcattggagcccgcgttgggaccttccatgagctgctgaacaaccttggtcgcgtccatgagtgtggtgaacaaataggtaccaggcttgagcgacatatcggcgttgagctttttcaccgccgcatagtaatccttgggattctcgacgatatggttctcggagagaatcgaggcgatcgtatcgcccgaagcaccgtcgggaatggttaccgtaacctgctgaccagccgtgaccttcgtatcctcaccggcaaagaagcccttgacggccggcacgacaaagaaaacgatcgcgacaagcgcaagcaccgccaccacaacgccgatgatcatgggaaccggagagctcttcttttgagcaccgcgacgagtatgcgtgttgtagctcgagcgggtcgccggagcaacgccatgcgaaccgcgggcgtgatgagaatgcgattggggggcctgcgttcgctgggtaggtgcctgctgcttaaagcgggtaccgcctgcaggctgggccgtacgagcagtgggctgctgagccgcgtgagaagccggatgctgaaccgaacgagcagaaggctgctgacccgtccgttgaacaggttgggccgaacgagagaaggactgcaccgggcgcgcggcaggctgagctgcgcgctgcgtcggctgtgccggacgctggccaggctgggcagggcgcgacgccggctgacgtgtacgattcggctggcgcggatcggaagcactaggcatgcgaaacctcctcgtttttacgatcgagccacgtctgcaaaaaaaggctggcggcaatcatgtcgatcttgcccctcatctgcttttcgttgaggccctgctcgcgcaggatacgcttggcctcttgcgaggacagacgctcgtcctcaaactccagcggaagatcgagctcgtcggcaatcttttgcgccacggcggcaacgcgctcggcttgggggccgggctcaccgcccatggtcaggggacgtccgcttaccaggatgtcgggctcatagtcttcgaccaggtagcggaacgtcttggccataccggtgacctcggcggccgggagcaccttgacgggcatcgccatcttgccatcacggctcgagacggcgatgccaatcctggtctcccctatgtccagcgcaagcgcgaccacagtgacttcttagattcttaggcgccgagcgcggtcttggcggccgcgagggcatcggcgatgccggcagcattcttgccaccggcctgggccatgttgggacggccaccaccgcgaccgtcgaccagacccgcgatctgcttgatcacattaccggcgtggaacccggccttcacggcgtcatcggagccggcagcgagcagggccggagtgcccttctcagtcacgctggcgacgacacaagcgacagggccggcgaccttctggtgcacggtatcccatacgttgcgcaggtcggcagcctcaaggccctggagctcagcaacgacgagcttgtagccaccgagctcgacagcaccctcgatggagctggaaatggcgtcggaggaaccaccggtcagagcctttttgagcttgttggacgtctcgcgcagctcgacctgcaggttctccacacgggcgggaacctcgtcgacgcggcacttgagcgcagcagcggcggcgtcaacgagtgccaggcggtcggccatatagtcgagagcacccttagaggtcacggcctcgatacggcggacgttcgagcccgtagaggactcggaaataatcttgaacaggccgatctcggcggtgttagcagcgtgcgtgccaccgcagagctcgcgagagaacggctggtcctcggcgcccacggagacgacgcggacgacatcgccgtacttctctccaaacagagcaacagcgccggcagccttagcctcgtcgatgcccataacacgggtcacgaccggcttggaggcgaagatctgctggttgaccaagtcctcgacagccttgagctgctcggaggaaagggcctcgaagtgcgtaaagtcaaagcgcaggtgctcgggcgtcaccagcgagccggcctgggagacgtgctcgcccaggacctgcttaagggcagcgtcgagcaggtgcgtggcggtgtggttgcggcgcaggaagccacggcgctcggcgtcgagagcggcggtcacagcggcaccgacagtcagcgtgccatcggcaacgtgcgcgacgtgggcatacaggccgttgtggttcttggtgtcggcaacggtcagaacaacgccctcggcggaaagcttgccggcatcgccctgctgaccacccatctcggcatagaacggggtgcggtcgagcacgacctcgacatcctcgcccgcggctgcggactcgacggactcgccgttgcgcacgatggcgacaaccttggcgccctcgatcacatcgttgtcatagccgtcgaactcggtcgctgcgaccttgtcggaaagctcgacccacacgtcgttgaagctaccccaggcgtcgcccttggcgttagcgcgggcgcgggccttctggtcctccatgcaggcagtgaagccgtccatgtcgacgtcgtggccagcggtgccggcgatctcgacggtcagatcgatggggaaaccaaaggtgtcgtgcagcttaaaggcgacatcgcccggaagcacagcgccctcggcaagcgctgccagggcctcgtccaggtacacgcggccgttgtcgagcgtcgtggagaagcgctcctcctcggaggcaacgatacccttgacgagcgcgacgttcttgagcaactcgggataggcctcgcccatttgagcgttgacctcgtcgatgaacttggtcaggaaggcgccctcgatgcccagcaggcgaccgtggaacacggcacggcggagcagacggcgaaggacgtactcgcgaccctcgttgccgggaaggatgccgtccgagatcataaagtcgacagcacgggagtggtcggcgatgatgcgcagggagcggctggcgccggagtagtcatcggcgtcataggtcttgccgctaatctcctcaccgagtttgatgaggtgctgcatcagatcgccgtcgtaattggcggtcttgtgctgcatgatggcagccatgcgctccaggcccatgcccgtatcgaggttgcggtgcggcagctccggcatggagccgtcctcctggcggtcgtactgggtaaacacgaggttccagaactcaaggaagcggtcgcagtcgcagccgggcttgcagtcggggctgccgcaaccgacctcctcgcccatgtcaaagtagatctcggagcacggaccgcaggggccggtggggccagcggcccagaagttgtcgtcctcgcccaagcgggagatgtggtcctcggcaacgcccagggagcgccacacgtcatgggtctcatcgtcctcggtaaagacggtaaagtacaggcggtcgagcggcagcttgaactccttggtgatgagctcaaaggcccaggcgcaagcctgctccttggagacgccgccaaaagagaaatcgccgagcatctcgaagaacgacaggtgacggccgtcctcgccgatgcagtcgatgtcgttggtgcggacgcacttctggcaggagatcgcgccaatctccttcatggtcttcttgccctggtagtactccttaaactggttcatgccggcgttggcaagcagcagtgaaggatcgtcggggacgagggacgaagaaggatagagcttaagaccgcgctcctcaaagaagttgaggaacttggagcggatctcggccgtagtcattgacgggtagtcagcactcatagagggaatctcctcggtttcacatcgaaacagttcaaacgtaacgatattaccatcccgccgcgcaagtgcaaaaaagagggtcgccaaacagcgaccctccagcgaaagtgcacgttatttagtactgcgcgatcctttgaaaaaggactgctgtataattgcatataagattcacccggaaggagcgatcgatgaaaagcaaacgatttgtcctgaatgcacttctggttgtagcacttttagcgctcttggccttctcatgctggtacgcaaaccaaccatcatttggatacgtattgtatacagtaatgtccggcgataaggcttattacactctacgcgcaattgacgttctctttttctatgtagccggccccttatcaatcgctttggtcgcgtttcttgtcatttacaacttcaagaaacgttaatagaacctatttagaatccgaatcgtccatggagccgtcgatgccggttttggtgtcgtcgttcatattgaaatcgtcgtctttggcgaagggattcttgaaaaagcccgtagcatcgggctgaaggcccgagagcttcatccagggattatcgagctcgggtttgggcatggcctgggcctcgggcgcagtctcgttaccgatgagctcggactcatagatgaaggtgtcgtcgccgagcgcgtcgtaggcggcgaccgggttgccatcggcatcgcggtacggcgtgcccttaaacacggctccgtcataggccacaagctgacggccggtctcattctcgaagtagtacacgaagatgcccttgagggccgcacaaagcgggatggcaataatcatgccgatgggccccatgagtgccgaaccaataacgagagccgtaaggctcataatgggatgcacctgcactgagctctgcatgaccttaggcgaaatcacattgtcggtgacgttttgcgcgaccatcgtcacgatgagcgtccataacgccaacatggggctgaacataaagccgagtaccgtggcgattgccgcgctcacccagggaccgacgaccggaaccaagtgcatgatgccagtgaagatagccatgagcgccgcatacggatggccgataatcaggaagccgataaaggcgaggaaaccaccgcagatggacgtcacgaccataccgcgcatgtagccgccgacagagcgagaaaggatggcgaccataaagcggtacgaggtctccttctcctgaccgatgatggtgcaaatctcgtgatgcatgcgagggtagtcgcaggccatccagtaggcaagcaccagaccaaggaagatcacgaacaactgcgaggccgtattggtgatgagcgggaacacaccgcggccaagctcggcagcaatctgagacacatacttcgatgccacggtaaccagcgacgaaagattatcgtccaaatactccttgagcggcgtgttattgagcgtcttggcatgcgagatcatctcgttgagatcgccacccgcaacacgaagctgctcgggcaggcggctcaggacttccatgatctgaccaaagagaatcggcgacaagatgaaaacgacaccgacgagcacggcaacaacaacaataagcgcgataagcgaaccgatgccgcgattcacgccatggtgctcgagccagttggtgatcggggacatcacaaaggcaatgatggaaccaacagcgagaaactcgataaccggcgccaggatgcccataaggttaaagatgacagcggcgatgacaatgcagccgacaacagcccaaatgcgcagcgtcagaatgcgggtgtcgcgcagcacgcgatcggtttgttgggggtgctcactcatgaacgaatcatcactccgtcggggtcgatcttgtcctgaatcttcttaagcgtgcggcgcagcagacgcgaaacctgcacctgagaaatacccagcttcttggcgatctcgatctgggtcatgcccttcagaaagcgcagctcgatcacctcgcgctcgcgcggcgagaaatcacggatggcttcctcgatcactaggcggtcatcagtaaagtcgagctcgttgtcgtcgtcggcgtaacggtcgagaatcgaaggggcatcgtcggaatcggacgcaccaggagcctcgatgggcaccgaggtataggccgaagacgattccatagcctcgaggacctcatcgacagtcacatctagatactcagcgatctcctcaaccttgggcgaacgctgcagctcgttggtaagtttgtcagtagcctggttgaccttggccgagagctcctgcagacgacgcggtacgcgcacactccagcccttgtcgcgaaaatgccgtttgatctcgcccaggatagtgggtgtcgcaaacgtcgtgaactcgagtccgcgctcgggatcaaaacggtcgatagccttgagcaagcccagatagccgacctgcatgaggtcgtcgagcggctcgccgcgattcttaaatttgttggcaagaaaccttaccaggttcatatgggacatgacgagctgctcacgggcgtccggatcaccggtctccttgtaacgacgaaacagctcgcgggttttctccttgtcccaagcggtcttgccgctccgggaacgttcggtcatattagatatccgccttgaggtcgagggaaagcgtcaggggcgccgtagtcttttcgtaggagtcgcacacgctcgcgaggatgagctcggcatacaccgcagcctggtcgtcttcatcgaccgtagcctggtcgccaaaggtaatagtcatgccaacgtgggtctcatcgacatcgaatttgatggtgatgtcatcgcagtcgaccgcggtgcaaccaaagatgaaagcctcctcagcagccatgcggatgtcctcgatgcgatcgacagacatagagcacagggcaccaacgttggctgccgtcatgcgcacaaggcgagcgagacgcgggtcaccggcaacggtcagcgtgatagggcaggttgtttcgctactcatcgcaggactcctcagaggtctcggcgggcgtataggtgtaatactgagccggcttggatacagacttctgaccatcatcgtcgcccgcggcggcctcgtcctcgccaattaggacgcgnnnnnnnnnntcttccgatcttctaagctctgctcggcctccgcagcggcagcggcgagcttgcgatcggcgtcggctgcaggagccttcaccttattgaagagcttctgcacagcaccggcggcagagtcggtcacgctcgacacagcattgctggcctcggccatgctgcccgtaacctcggaaatgtcgcgaaccacggcttcgacctctacgagattggaggtaagggcatcaactgccgtcttgctcgacttaagcagcggctccatctgggcaagcgccggcgtaagctcatcgacagcgccatcgagctttgccaccacaggctgagcctcggcgatggtgttgttgaggtcgttcacggtcttatcgagcgagtcgacaacattgcgggtcttgcgcagggtaagcgcgagctcagcgatggcccacacgccggcaacggcgagcagcagcagggcgatttgaatgggactcatacaagcctcccggaagaatcgaaatacagacgcttttcatggtaccccaaaggggaccgaacatgccaagagcagcaacgtgggacaaaattatcagcagctacctcggtgcattcccgctgcggtctcgttcgctttgctctacgcgccactcttcccagccgcgcccggcaggctgccaaaatgcaccgcgttccaagccttcgggcaaatagcgctgatcgacccagccttcgggataatcatgtggatacttatacacaccgtattcatcgctgcccgggcgatggcgatcgcgcagataactcggcacctcgcgaagcccactagaatggatatcggccagcgccgcatcgatcgaagcctcacacgcgttggattttggcgccaagcacacatagagtgcagcctgagccaggttaatgcggcactcgggatagccaatgacctcggcagacttaaacgcggcatgcgccaccaaaagcgcctgcgggtcggcgttgccaacatcctcagaagcgtgaatcataatgcggcgagcgataaacttaggatcctccccagcatcgatcatgcgcgcgagccaatagatcgtggcatcggggtcactaccgcgcatggacttgatgaacgcactgatgatgtcgtagtgcatgtcgccgtttttgtcatacgtaaagccgcgacgcgggttggcaatcttcacgtcatccacggtgatgggatagcgctcccccgccgcaggcgctggcgttccctcggtatcggaacgcgtgacggcaatctcgctcgcaagctcgagcgtcgtgagcgccgagcgagcgtcacccgctgccagcgtgcaaatggtcttgaccgtatcctcatcggccgagaactttccgttcaagccctgtggtgcctcgagcgcacgctcaataagcgtggcgatatcctcatccttcagatgttcaagctccaccacgcgcccgcgcgacaacagtgccgagttgacctcaaagtacgggttctctgtcgtagcgccaatcataatgacggtacggttctcaactgcatgcagcagggcatcctgctgcgacttagagaagcggtgaatctcatcgatgaatagaatggtgcggcggtcgtacgtattcaggcgcgtcttggcctcatcaatcacacgacgcaggtccttcacggtacccgtgacggcgctgacctcaacaaactcgctcttggtatggttggcgataatgtgggccagcgtcgtcttgcccgtaccggcaggcccgtacagaatcacgctcgaaagcacgtcgtgctcgatcgcggcacgcagccatgaacccttaccgacggccttttgctggcccacgtactcgtcgagcgaattggggcgcatgcgcaccgcaagcggcgcattctgaaaggaacgctcgcgcgtcgaagcagaaaaaaggtcgtccatagccatcccgtgtatcaatcaaaaacgttttccactaacagtataccgaattaatacgaactaccgttcgttaatataggtacggtgcggaaactccagaccagggaacagcttgctcgtcagctcgcagaaataaccgtccgtcatgctcgcgatataatccaccacggcttgatccttgtcgtcctgccaggcataggtgcgatcatagtaggaaagctgctgctcaatgcgcgaaatatggtgcttaaagatgtaagaggactcgtcgccactgttaagatcccgcaggcaacggtcgtagagctttacgaacgcctcgcgcagctccgcctcggaatcgccttcgataccgcccttgctatagatcttctcgtagttctcgcgcttggctcggcgaatttcctcaaacaggtcctcgctcatcccgatgcgcggcttaccatagctgtgctcaacgatatcgatggaggcatgcgtgaggatccaactgttgtaggcaccgccccggccatcatcaaaagcgtcgggcgaaagcaggcccgccgcgatcgcatcctgacggtcacgaccgacgtaggcaagaatatccgagatgcgaacgacgcagccctcgagcgtcatgggacgcagatgctcaattgcgctatagcccgtggcaatgcaatcctcaaccgtctggtcaaactggtcaaaggagcccatgtccgagagctcaaacacacgttgctcgtactcgccgttatggcatagcacgccgtcgagcgtctggagcgacacgttgcggccgtacagtgcgtcgagcacgcggaccgactgcacgttatggaaaaaataacgccccgtacgctcatgatagatatcgttgaggaagcgctcgccggcatggccgaaaggcgtgtgtcccaagtcgtgacccaggccaatcgcctcgatcagatcgcaattgagccccagggcgcgaccgatatcgcgcgcaatgcgggagacgagctgcacgtgcaaaccgcggcgtgacagatcgtcattgcaacggaagctaaagacctgcgttttgcctgcataacgggtgtacgccggaagatgaagtatcttttcagtatcgcgcataaacgccggacgcataagcgtgcctttgtcggcggcgcgatcaatacgacgaatgacctgatcgtcgttgcaacgatacgggttgacatagcccgaagcacgatcggcggcaatgcgctcgacaagctcgggcgacaacgccgagggaatacggtccatgcgcgccttaatgacggccgtttcttgattagttgccatggcatgctccttaagaaggatgcgcaatcggttacaaagtgcagcccacgacctcgattatggcaaaaatcggcactaaaaacgggagcaatggcagggagcgcgattttgtgaagaggcaggagagggccagggccaggagtgcgacggcaaatgccacgatgccacccatagggtcgagcgtgcaaagcgcgaagagcgccttggcatcccccatgccgatgcccggcgcgtggcgaaggcgccgccagagcgactcagtgagcacaagggcaaggtagacgatgaccgcaagaccggcgtggtcaagcgctgtgttcaaaccgaggtcgagccaaacgcccgccaacgccgccacggcacatgcgccggcaagcccattgggaaaccgtcgctctagggcatcaattgccacgccggcaaagatgcaaatccaaaacgggatatagaccatcggactcctcctcgagctgcatcgcaaaagcaaaaaccaccacaaaggtgcctgtcccctttgcggtggttttggtggtggttatttggcgccttgcatgacctcgtcaagggtaacgttgacggcgtgctgggtaggaacccagtcgaccttcaggaacagcgcggccaccgtgatggggatatagctgaacataaagatcgggaaggtaaacaggttagtcaccagacgccacttttgcgcgcagtgaatgtgcttgtactcaaagatagtcgtgagcagcgccaggataaagaaggtctgatacatcatggcgaaggtcataatgagcgaagcggcgcacgcctgcatctcgacttcggtagccaagaaaccatgcgaaaggccacccacaatcaagaacgtcgcattagcgagcatcgagatcagcgatagcagcatacccggggcgatcgtcatgaacatgtcgtaggcggcaaagcgatgatagcggaacgtcgacttgaccagatgcttaccgtaggtaaagaacacctggtaaaagcccttggtccagcgcatacgctgcttccaggatgccttgaacgtcacgggttgctcgtcaaagaactccgccggcgcatagccaatgcgaataccgtgaatagcgcagaacgtagtgaactgaatgtcctcggtcagcgtgtggaactgccaaccgtgcatgccctcgataacgcttgacgagataaggtaacccgaacccgaaacagcgcaggacgtcttgcagatattacgcgcgttgttgaggaagcgcgcctcgcgtagataccacgtggcattagctgccgagatccacgagctgccgaagttcttggaattgcgatagctcgtgaccacatggaagccctggtcaaaggcatcattcatcttggaaacgtaatcgcgggagataacgttatcggcatcgaagataaagtagccctcaaacgtgtcgggatactcgttgagaatgcggtcgaagccaaagtccatgacccagctcttgcccttgcgggccaggtcattgcgctcgtaaacaatggcaccggcctcgcgcgcgagctgcgccgtgttgtcggtgcaggcatcggcgaccacgaaaacctcgatgagctcggacggataatcctggtccttgatggagcgaacgaggttggcgatcacggcctcctcattatgcgccgcaataaaaaaggcatagcgatggagttttttggccttgggaggcgcgacctcgccacgaagagcaccaatgacaaagaagaccacctggtacagaaagcagaccgtgagcagcgtgacgacaatctggttgaagatcacgatgggtgtgttggtttgtaaaaaggcgagcatgcaggctcccagcaacgcgtaacgtaaacaatcgtatatcttaccgcaggcttaccgagttcaagaaaccacctaatactggctaggcttcgagaagaccgagctgcggaacgatttcatctccaacggccgtgcgaccgagcgagcgcggagccagatcgtcgagaaccgcagcgagatcccacggcaactcgtcgcggcactcaatgcgctcccccgtcacgggatggtcgaacgccacgcgccaggaatgaaggaactgcctggtcaggccctggtcggcgcgcgcatcgcacttgccgtagagtggatcgcccacgcaggcgtggttgatatgacgcatatgcacgcgaatctggtgcgtgcgaccggtaaacagatggcactcaacgagcgtatagccgtcgtcaaaacgcatggaatcgaagcgctcgaggaccttaaaggtcgtaatggcctggcgggcgaaaggatcgtcagaaaccgccatcttgacacggtcgcgcgtcgatcgggcaataccggtattgatggtgccctcgtccatggcgatgtgcccgtggacaagcgtgatatagcggcggtcgagcgtacgcgtgcgaatgagattttgaagcgcgcgctgggtgtcgtcgtcttttgccgcgagcataaggcccgaggtatcgcgatccaggcgatgcacgatgccggggcggtcctcaccctgcacggtaccaagatgatcgataccgcagtggtagaccaaggcgttcgcaagcgtgccgctctcgtggccgtgggcgggatggcacaccagcccgcgctgcttggagagcacaatgagatagtcgtcctcatagcgaatgtcgagcgggatggcctcgggaatcacatcggtgggatcgtgcggctcgggcaggtcgaccgagatgcggtcaccggcgcgtacggcatacttttttgacagacaggtctcgccgttcacgattacggcgccgccctcgatcaaatgcgcgcaggcagagcgcgtggggcagccgtcgttggcacccagaaagccgtcgagacgctggccagagcaatcgtcggcaacaagaatatggatgtcggccattaacgctcattcctttcgcgaatcttgcgggcacgctccccacgctgcttggctttgcgcttagcgcgggcctcatcacgggcattgagctcagcagtcgcatcgacctcgcgagcggcgggactcaagaaaatgtaaccgataagcgccagcacaacaccgaccgtaatgccgatatcggccacattgaagacgggaaagtcgatgaaggtggtggcaataaaatcggtcacgaagccaaaggccaaacgatcgatagcgttgccgatagcaccgcccgcaaccatcgccatgcccacaacctcaagatgggcgagatgaggtgcacgaacgaggtacacggcaatagcgacaatgaccgccagcgccagcacggcaaacgcgatgccatgcccctcgcccatgctaaaggcagcgccgatattgcggacaaacaggaagtcgatcacgccggggatgacggtcacatgcagtgcatcgcccacggcacgaaccgcaagcttggtcaactggtcaacaagcagcacaaccagcgccaccccaccagcaacacccaaccgccaacccaaaggcggcgtcatatccccagtacgacccaaatcaatcccctgccctcagaacaatcggattccgttgaacgcaattaaccatcttatattgccatacgcagagcgcacgacatatccaccaacgcaagcgaaataaccagcacaaaacgaaagcgacattccgaaaaacagaatgccgcttaaatatgacacaggtagtcgttggggacgttcttgtttgactagtcgtttaagaacgtccccaacgactaggtccatagaaacgccgcattaccgtcatcaacagcgaaaacgtccctaagcgagcaaggtgacgtgaaagaggagggaagcgtactttggtacgcgaccgacgattgaacgtcagattgccgcttaggagcgtttgcagcgtcggtaggttacggcgttctacgaacgccgtaacctacagcgcgtcagcgcagcgcttgcagatatgtgcgtgaccgttgtactcgccgacggtggtgcggtaattccagcaacggtcgcagcactcgccctcggcagcctcgatggcaacggagagctcctcgccctgggtcagctcaacatcggaaacgatgtagaactcggccaggtcgaccgccttgtcgccggtcagcagcgcgtacatctcggcgggaacgaccgccttgacgcggacctgctggctcttagtgaaggtgccgacggagcgggcatcctcaagggccttggtcacggcgctacggagctcgagtgaagcctcgagcacgccctcgaactcattggcctcgtcgaccgtgataggcgacttataccaatcgagcagcgcggcgtacttctggtggtcgacgcagccggcaggcgcgtaggccatggcctcgtcgacggtgtaggacaaaatcggctgcagatcgcgcatgagcatcgagaagagctcggccagcacggtctgggcgctgcggcgctcgagcgagccaggcttgtcgcagtacaggcggtccttcagggcgtcgaggtacacgttggaaagctcggtaaccacgaagtcataaagcgcacggtaagcgcgcgggaactcgtagcaagagtaagcgtcgtcgacctcggcctgaacctgggtcagacgggcaaccatgagcttgtcgagcggcagcaggtcggcaaaggcgacaccgtcggtctcaggctcaaactggccctcgagctcggaaagcaggaagcgcagcgtgttgcggaaacgacggtaggcatcggacgtacgggcaagaatctcgtggtcgatggacacgtcggagctggtgtcaacggaagcaacccacaggcggatgatgtcggcgcccatctcgtcacagaccttattggggtcgatgacgttgccgagcgacttggacatcttgcggccctggccgtcgagcgtgaagccctgcgagacgaccgccttgtagggagcatggccgttggcgcccaccgaagtgagcagcgagctctggaaccaaccgcgatgctggtcggagccctcgaggtacacatccgccggatactccagctcgggacggtactcgcagacggccttccaggagacgccggaatcccaccacacgtcgaggatgtccttatcggccttgaggtgatggccgccgcacttggggcagacgcaggcctcgcccaggtagctctcgggagcgtcggtgaaccaggcgtcggagcccttctcgtggaagagcttgatgacggcgtcgagcgtagcgtcgttcatgaccttctcgccgcagtcggcacaggtgtagctggggataggcacgccccagttgcgctgacggctgatgcaccagtcgggacgctgctcaaccatggcgccgatgcggttggcggcgtgagccggataccacttgacgttctcgcgaacctccttaccagcctgctcgcgcaaaccagtcttgtccatcgagacaaaccactggtcggtagcacggaagagcaccgggtgcttgcagcgccagcagtgcggatagctgtgcgtgatcttcttctcgaggaccagggtgccgcgctcgcgcaggaactcgatgatgtgcgggttggcctcgtcggtatccatgccgctgaaggggccgccggtgccaaactcctcgccggtgtagaacttgccgtcgtcatcgaccggcatgcaaatgtcggtgatgccctccttgaggcaggcgaagtagtcgtcgacgccgtgaccgggcgagttgtggacgataccggtaccgtcatcgacaccgacgtaatcggccaacagcgcaacgccctcgacaccgtcaaagatcggctgcttatagtgaatgtgatggaaggtctcggcgggaaccacatagggcttgccgtcgaccacaaccggggtgtactcccagccaaactcctcgcagcacttgggagctaggtcctcgagcatgacctcggcgcggccgtcgtgctcaacggcgacgtaggcggcaccgggcttgagagaaactgcctggtcggaggggatggtccacggcgtggtcgtccagatgataaagtcaaccgggccgtcgaagttctcgaggccggcgggcttggaggtcatctcaaagcgcacgaagatggacgggctcgtctcgtcggagtactcaatctcggcctcagcaagtgcggtatggcagtgcttgcaccagtggacgggcttgtgaccgcgatagatcatgcccttgtcgaacatggccttgaaaacatcgatgtcggcggcgtcatgctggtgatagagcgtcagataggggttgtcccaatcgccgagcacgcccaggcgacggaagccggccttctgcagctcgatgttctcgacagcgaacttattgcaaagctcacggatcttagccgtggaggtctggttgaacttctcggtgccgagcttctcctcgaccttatgctcgatcggctggccatggcagtcccaaccgggaacatagggaacctcatagccctgcatcatccagtaacggttgatcatgtccttggagatcttgttcatggcatggccgatgtgaatcgggccgttggcgtacggaggaccgtcgtgcagcacgaacttcttgtgaccctcgttcttcttcagaacctgctcgtagaccttgttgtcctgccagtccttgagtcgcttgggctcggacttggaaagaccggcacgcatgggaaaaccggtcttgggcagattcatcgtctgcttgtactcgtttgccacggtacccctttcatgtcatgggcgcacacgcccgttgggcaccaaaaaagcgcccgtccctacaagctgggacgaagcgccacaaaacgagctgtacgcccgcaaaagctcttcgtttaaccacccagcttagatgccctcgcccgcgtattcgcgcgctcgcatccgttactcggctggcctgtatcgacgaccatctcggcgatatctactaagacgtgtctgcgcggcacgtccgttgggaccgcagctccggggtgattttcatcggtcgcatgcacgggttctcagcgcttcccgctctctgtagcatgcggacggccgactactcgtccccatcaacgcttatgcggtgtatgctagcacgttccgcgtcggcaaaaaaccctcaacactggttttatacgttcgaaatttctcgctattacaagccttcactaggagcaaaatacctgaaagcactttatcgaacgaaagaaggctgctatgcgcacaattggaatgagcgactacaccgttggcgaggattgctttaccaagctgccaactgcactggcggagtacggcgcgaagaaagtcgccatcattggcggcaagcgagccctggctgcggcgctgccgggaatcgaggcggcccttgaaggtaccgatgtcgaggtcctggagacgcgcgtctacggtaccaacagtacgcgtgccaatatcgccaaggtcgtaaactcccccgcctgccaggaagccgacgtgctcattgcttgcggcggcggcaaggcgctcgataccgtcaagacggcggccatcgagctcaagaagatcgtctttaccgtgccgacgatctgctccaactgctccgccgcgaccgccattgccgttgtctacaacgacgacggctcgctcgagggctattcgtaccccaaccgccccgcgcacatcttcatcaaccccaagatcatcgccgaggcgccagcagagtacttctgggccggtgtaggcgatgccctgtccaagcagcccgaggtcgagtacgccacgagcgccggtaatttggagcacaccgccggtcttggcctggcactcgcccacacctgctccgagccgctgtttacctatggtgtgcagggtcttgaggatgtgcgccagaatctgtcgagcgaggccgtcaagcagatcgcgctcgacatcgttgtcaacacgggctatgtctcgaacctgaccaaccagaacgattattactacaactcgagcgtggcgcacgcgttctacaacgccacctgcagcattccgcgtgagggcacctacctgcatggcgaggtcgtgagcctgggcgtgctggtactgtttgcctatacgggcgataccgagaaccttgagcgctacgccgcctttaacaagcagatggggctgcccgtaacgcttgagcaggttggccttaccgaggcagatatcccggccctgtgcgaatacgcgcacgccaccaacgagtggaagcaaggcaacccggagcccttcaccgacgaaaagttcgccgccgccatcaaggccgccaacgcctacggccattctatcctggcctaaccgaccaaaaccgccacaaaggggacaatacctttgtggcggttttttattgccgtaacatgctcgagtcgaactcgctagccgggataacgcggtagccgtggcgcaggagcaggtcaacgaagacaccgttacctgttgtgagcgtgccgctgaaggatccgtcgtagatatggcccacgccgcacgacggactgcgatcctgcaaaatgcacgcaacgatctcggacgggccgcccgcctgctcgcacatgtcgagcgcacgttgagcgcccaggcgaaactcgcgatcgaccgaggcaccctcgcaggtacggacctcgccgttcacaatctcggacggcctgcgcggcgtgggcaggccgccaaagacctcagggcacaccaagaggacctcagtccctgtacgctcgcaggcctcgaccaactcgcgacgatagttgtcaagcccgttatacttgcagctctcgcccatcaagcaggcgctcaccacgatcttcatttccatccctctcaagcaaaacgccccatttgagaaagctgctcaaatggggcgtcggcgtttactggctcgaccgcggcgttactgttgcttgggcatcagcggattctcgcgcgtgaggaggttcatgaactcctcacccgtgatggtctccttcttgtacagataacgagccagctcatggagcttgaacttgttttccttgaggatctgcagggcgcgatcgtgcgcgtcctcgatcagcttagcgacaatcgcgtccacacgctcggccgtaccaggggcgcaggtgagcgacgtgtcctgattgagatacgcgttctgcacggtaccgagcgccatcatgccaaactcgtcggacataccaaagcgcgtcaccatgttacgggcaagcttggtggcctgttcgatatcgttggcggcaccggtcgtcatctcgccaaagatgagttcctcggccgcacggccgccgcagtagacggcgagcttgtccaagacctcctggcgtgtcgtcaggaagcgctcgtcctcctcgacctgcatggtatagccaagagcaccgctcgtgcgcggcacgatggtgatcttggtaaccggcgcggaacccttttggcgggcagcgacgatagcatggccgatctcgtggtaggaaacgacctgcttctcgtggtcggaaagcaccgtggacttacgctgttggccggcaatgacgacctccaccgactcctcgaagtcgtcctgggttgcacgcttgcgaccctcgcgaacggcgcgcagggcgccctcgttgatgatattggccaggtcggcgcccgaggcaccgggcgtggcgcgggcaatcgcggtcagatcgatcggcggctcggtcttcacactcttggcgtgaagctcgaggatgttcttacggccggtcagatcgggcaactcgacggggatgcggcggtcaaaacgaccggggcgcagcagcgccggatcgagactgtcggggcgattggttgcggcaaggacaacgatacccttgtggttatcgaagccatccatctcggtcagcaactgattgagcgtctgctcacgctcgtcgttgccgctaaaaccgccgccatcgcgcttcttaccgatggtatcgatctcgtcgataaacacgatgcacggggccttttccttggcctgcttaaaaaggtcacgcaccttggcggcgccacggccgacgaacatctcgacgaactcagaacccgaaatgctaaagaacggaacaccagcctcgccggcaacagccttggctagcagggtcttaccggtacccggagggccaacaaggagagcaccgcgcggcagcttggcgccaatctcctcgtagcgctgcggcttctccagaaagtcgacgacctccttgagggactccttggcctcttcctggccggcgacgtccttaaaggtcacgccccnnnnnnnnnacgtccttggaggcgatcacgcgcgcgccggacttacccagtccgccgccgccaaaaccgccgccgccaaagttcatcgacgggccgtcatcgcccatagccttcttcatgcggcggttgagccaccaaccgatgaggaagaaaatcgccatgggaagaatgagcgtgagcaggtagtaggtcatcaaacccgagtttttatcgggaacgaccgactccagcgaagcgccagactcaagcacgcgatcggtaaagcccgcatcgttcggcacaccggtcgtcttataggcgatgttctcgtcctcgcccttcttggtgtaataaatcgagtaatcgtccgtgttgtactcgaccttgtcgacactcttcttatcgagcgctttgacaaacgtcgagtaatcggtcttcgtaatctgctgcgtgtgaccgatgttagggaacagaacggtcgagagcacgaggtagacgacgaaggcgatgagcacgtagaggatcatattccgtctacgcttgttgtcatccatctccatctgcttgaactccatctactggggttgataatgctaactagaatacccaacccggccggcgataaaccgacgccgggcacgaaaggacagagatggcatcactgtaagtcggcaaggttcaaatctatacaggcgacggcaagggcaagacgacggctgcgctggggctcgcgctgcgcgcgacgggctacggactcgacgttcttaggctgcagtttgccaagaaacttcactgcgccgagcatgatgcggcgccccgtttgggtctgcgcatcgtacaagccgaccgcgacacgcccgaggcctgcgcggcacagattctggagctagcacgcgagcagatctcgcaggtcgatgtgctcatcctggacgaactcggcgaagcgatgcgccgcggctttgtaacgcgcaaggatgtggaggggctgatcgcgcagaagcccgccaccacggagctcgtgctaaccggccgcggcctgctgcccctcgcgaacctcgccgaccttgtcaccgaaatgcgccccatcaaacactacttcgacgaaggactcctagcccgccaaggcatcgaatactagccattggggacgtcccgaatggctaggcggtggcgcggccgagccagttgccgctgtggtggtagatggtgaacatcgtggccgtaatgagccacgttacggggtagaccagcagtagatgctcgagcgacggatcgaagggcatgatcgcaaacacccagatcaccctcaagacaacggtgccaaagatggtgagcatcataggctgcaaactcacgccggcgccgcggatggaacccgaggcgttctcgataatcgagaaaatcgcatagaacggcgcaatgaaatggaggatagtcgtggtgtacgccgaaatcaaagcatcgtcgacaaacaaacgcgacagcgggcccgagaacaccagcagcacggcagacaggccaccaatgagcataaacgacagcacgagcgacgtatggtagcccttgcgcatgcgctcgtagttgcgcgcgccaaagttctgcgccgagaacgtagtgatcgatacgccgagcgcctcggtcaccatccagataatgccatccaggcgcccagatagaccccaagcagtcgtgacatcggcgccaaacgaattaaccgatacctggatcagcacgttcgagatcgaataggcagccgattgaaaaccgagtggcagaccacacgagatcatactcttgcaaataccgcgatcgataccgagcttagacagcgaaagacgccatgcacccggagcgcgcatcatgcgcaacacgatcatcgttgcattggagcaaatggtcagcgccaccgcgatgccgcagcccagcgcctccatatgcaacacagcgacaaaaatgatatccagcaccacgttaaccaggcagccagaggcaatgatcacggcggggccgcgcgtgtcgcccacggcacgcagcagtgcggttcccatattaagcagcagtgccgcaaccatcgcggcaaaataacagcgagcataggccacgccctcggccaatagttcatgcggcgtgttcataagcaccagcatgggctcaacgaacactatgccaagaatcgagaaagcgataccgcccaccagcgcaagcgtcatggctgtatggaccgaacgactcagtcgctcatcatcgtgctggccaaaatactgaccggtaatgaccgcgcagccggcgccgacgccaacgcaaaagccaatgcagagctcggtgagcaccatcgtggcttgaatgccacccagcgcgagcttgccgccaaactggccaacgatatacgtaccgataagcgtgtaggcctgctgaaaaaacgaactaaaaaagatgggaacgcacagcgacagcagctgttgccaaatgacaccctgcgttacatcgatagccgtagatttcttagccacacgccctccccgccaacgtatgttaaacaacaaaacggcaatttaagaccaaagcaaataccagcttagcaccgaccggcgtcgaccgaaacaccccgaatcagagcccagtgcaaaatatctgcctagtgatacaaacccggctggtagtgatactcattgctcacgtgcgggcacagctgccaaaaggcgacggcgctcgccgcggccacgttgagcgaatcgaccccgtgcgccatcggaatgcgcaccgcgtggtcacagccggcaatggtcttggcgcccaagccggcaccctcggtgcccataaaaatcgccaagcgatcaatcttccgcagtacaggatcatcaagcgaaacagagtcgtccgtcaacgccatagcggcacacgaaaaaccggcatcgtgcaacgcgctcagaccatcatgcggccacacacgagcctcgctgccaatgcgcgtccacggcacctgaaacacggtgcccatgctcacgcgggccgagcgacgatacagtggatcgcagcacgtcgggctgaccaaaataccgtcaacgttcaatgcggcagccgagcggaaaatcgcgccaacattggtgtgatcgacaataccctcaagcacgcacacgcgcaccggacgaccccccgccgcctcgacaacgccgcccaagaactcatcaaccggaatctgacgcgggcgacggaacgccgccagcgcgccgcgcgtcacgttaaagcccgtcaactgctccatgagctccatggaggccacgaacacgggaaccggacccgctccctcgcgcacgacaagctggtcaaacagcggcatcatctggtcgagccagcgctcgcccagaagaaagctcaccggctcatatccggcgcgaaccgcacgctcgatgaccttggcactctcagcgataaaaatgcccttctgcggctccagcacgcagcgaagctcacgctcggtcagtcgcacgtaggcatcgagccgctcgtcctcgagcgaatcaattcgcagaacctcaacggcatcagtcatagcagccagcccgcacccttctatacagcacatctataccaaacgaggcgacgctaagcgccgccccatgcattcaatcaacccgatgataccgttcacgccagacgatttacgcctcgatgcgacgatacgtcacgaactcataatcgacgccctcgtcaccctcaccggcggcaatcgtcgcgaccccgctacgctgcgcaatctcccacgcaggatcggcttccaaatcgggaaagtacgtatccacgacatggacgcagtggttatgcgtgacctcggcctcgacgcaatacggcaaaaaatgccgatagacatcgccgccaccgatcacccaggcaacgggctcatcggcaaccgcggcgagcgcctcgtcgatactatgcaccacgtcgacgccctcgggggcaaagctctcgtcgcgggtgagcacgatattgcggcggttcttgagcggacgcccgccgggaaaactcagcagggtcttgcgtcccatgataaccgggcagcccttggtgcaggccacaaaatggcgcatatcggcgcgattggacaccaccatgtcgccctcgcacccaatgccccagtcatcgcacacggcgacaatggcagaaagcttacacgtcatgcgcgtcacctacaccgcgatggggatgttcttgacctgcgggccgtgctcatagccctcgacgatcaggtcatcggtcgtaaacgcatagaagtcatgcacatcggggttgagcgttaccttgggcgcggcaaactgcggacgctcgataagttcgcggatgatatcgacatgacggtcgtaaatgtgggcatcggcaatcacgtgcagcagctcgccagcgatcatatcgaccgactgcgcaaccatcatcagcaaaatggcgtactggcacacattccagttgttcgcggccaaaatatcctggctacgctggttgagaatcatgttgagcgtcggcttgtcgtcctgcgggcgctgcgtcacgttatacgtcacgctgtaggcgcacggatacaggtgcatctcggacaggtcgctaaacacataggtgttcgtcataatgcggcggctgtacggcgtgtgcttgaggtcgtacagcacgcggtccatctgatcaaagtcaccctcggcataatggctcttctgcccaatctggtagccgtaggctttgccgatagagccggtctcgtcggcccactcatcccaaatatggctgttgaggtcatgcacgttattggacttcttctgatagatccacaggatctcatccatcgcagacttaagcgccgtgcgacgcagggtgagcgcggggaactcctcgcgcaggtcgtagcgtgccgtaactccaaagtttttaatggtataggcaggggtgccgtcctcccacaccgggcggaccttttggccctcggtcgtggtgccatggtccaagatgtcgcggcacatagctacaaactgctgatcagccttgctcattgaccctcctgtcagtcgcctataagcgagattcattgtagcccaggcgcacgcggccccacagcccaaacataagccctcatattctgacatatgccagaaattccttgcgcaaatctacagtttcgttattctattgttgacatatgtcagataaggagggtgcatggcaggaagacgcgagaaactgcgccgcgtcgggatcatccccgaataccgcggctttacccccgatggcctggcgagcggagacgccatcgacatgacgatcgacgaactcgaggtgctgcgcctgtgcgacctggaaggccttaaccaagaggcagtcgcacagcagatgggcatcgcgcgcgccacggtggcggcaatctgcagccgtgcgcatcgcaaggtagcaaatgcgctggtcaacggacgagcgctcatcatcaaaggcggcaatatcgtgtactcccccatcaccacaacgacggccgcatggccagcaaaggaggtcgacaccatgagggtggcaaccacgtacgacaacggcaacatctttatgcactttggccgcagcgagcagttcaagatctacgacattcaggacggcaaggtgctcaacgaacaggtcgtgggcaccggcggcaccggccacggtgcccttgcgggcctgctcgccaacggtggcgtggacgcgctcatctgcggcggcatcggcggtggcgctatcaacgcgcttgcccaagccggcatcacggtatacgcaggtgcccagggcaacagcgacgcttgcgtcgaggcccttatcgccggcacgctcgcacagaacggcgaggccacgtgcggctgccacggccatgaccacgaccacgcccacgaacacggcgagtcctgcagctgccacgaccatcacgagcacgagggccacgagggctgcagctgccactaacggcacgacaccgcgagctcggggcgcgacgccgaactcaacccaacaatcaaagccaacaacaaaggccacccggtagcttccgagtggcctttgccatatcaagctggaattacagccctatttcttattgcgcatctgcgcttccatctggcgcagcagctccatatcggacttgggaccgcccgtgcccaggccgcccataccgcccagacccatagcgtccaggccagggatattgggcatgcgcatcttcttgcccttcttaccctttttgcccttcttgccgccggcctgcgcttgattggccatcgtgcgcatgcggcccatcatcttgttcatctcgccccactgcttcataaggctgttgacctcggtggggggtacgccggcgcccctggcgatacgggcgcgacgctggccgttgataatggaggggcgaaggcgctcctccttggtcatcgacatgatgatggcctcattcttgtcgaagatgccctcgtccaggttgccgcccatctggttgagggcgcgctggccaccggggagcatacccagaatgcccttcatgccgcccatcttcttgacggctttcatctggtcgagcatatcgttcatggtaaagccctcgcgcagcatacgctcggcagcctcgagctgctctgcatcggctgcctcctgggccttctcgatgatgccgacgacgtcgcccatgcccaaaatgcgcttggccatgcgatcgggatagaacggctccagcgaatcgggcttctcacccatgctcacaaacttgatgggcttgccagtcacctgacgcaccgaaagtgcgccaccgccacgggcgtcaccgtcgagcttggagataatcacaccgtcaaagtcggtgcgatcggcgaaggtcgagacgacgttgacgatatcctggccggtcatggcatcgacgaccatcagcacctgatcgggcttgacggccttcttgatgtcgacggcctcctgcatcatctgctcgtcgatctgaaggcgaccggcggtatcgacgatgaccacgtcgcgcaggtggtcgacggcctcctggatggcgcccttggcgatgtcgaccggatgcgcaccgtcgccgcggaagaccggcacgccgatctcgccaccgagcgtggccaactggtcggcagcggcgggacggtagacgtcgcacgcggcgagcagcggcgagcggccctgcttcttgagcaggtaggccagctttacggcagccgtggtcttaccggagccctgcaggcccacgagcatgatgacattgggaatgcggttgctaaagacgagcttgctctcggttgagccaagcatctcggtgagctcgtcgagcacgatcttgacgacgttttgcgccggcgacagcgactccatgacctcggcggtcatgcagcgctccttggtcttggcaacgaactccttgacgaccttaaagttaacgtcggcctcgagtaacgccatacgaatatcgcgcatggccgaggtaatatcggcctcggtcagcttacccttaccgcgcaggcggtcaaatgtgtcgttgaggcgatcgctcagggaatcaaacactggttactccttagttggactcgcccaccagggcgcggcagaaatctttggcgttaaactcctgcaggtcatcgacctgctcgcccacgccgatgcgcaggatcgggagcttgagcttctcggccacggccatggcgataccgcccttagccgtgccgtcgagcttagtcatgataataccgtccaggcccagcgcctcgttaaactcgagcgcctggttcagaccgttctgaccagtggcggcatcgatcacaagcacgaccgagaccggcatgggaccggcggccatattggcggcgcgcttacgagtcacattgaccaccttggcgagctcgcgcatgagctcggggctcgtgtgcagacgaccggcggtatcaatgagcaccaggtcgctgccgcgcttatcggcctcgtcgagcacgtcatagcacacgctcgccggatcggaaccgcggtcacgcttgataaccggtacgccggcacgctgaccccacacatcgagctgcggcacgttcggcgccaacgaggtcgctatcttgggcgtgggctgcgttgtggccgacacgcataaaaagcctcccatttctcgtgtccaagaaatgggaggcagttcagaattcatccccggcgcgccttatttgtgatgtggcaaagagactgtccctttgtcacattatgcgaactggctcagatagaggtcggcgtaggcaccctcggcagccagcagctccttatgcgtgccctgctcgataatgttgccgtgatccatgaccaagatcaggtcggcgtccacgatcgtcgacaggcggtgcgcgatcacaaagctcgtgcgcccgcgcatgagcgcgtccatggcacgaccgatggcaagctcggtacgcgtatccacgcttgaggtcgcctcgtccaggatgagaatcgccgggttattgagcagcacgcgtgcgatggtcagcagctgacgctggccctggctgatgctttcggcatcgttggccacgcgcgtgtcatagccctgcggcatggtgcgcacaaagaagtcgacctgcgcggcgcgcgcagccgccacgatctcctcacgcgtcgcctcgggacagccgtaggcgatgttttcggcaatcgtgccatcgaacagccaggcgtcctgcagcaccatgccaaactgctgccgtagctcgccgcggtccatgcggctcgtatccacgccgtcgagcgtaatacgcccgccgtcaatctcgtagaagcgcatgagcaggttgatgagcgtcgtcttgcccgcgcccgtggttcccaccacggcaatcttctggcccggctcggcggtaaacgacacgtcgtgcataagcggcttgtcgggcgaataaccaaagcgcacgtgctcaaaggagacgcgaccctcaacgcgacccggcagcttggcggcctcgtccggcagcggatcggcctccatctcgggctcatcgagcaggtcgaacacgcgctccgcactcgccaacgcgctctgcagcgagttgaaggtaaacgacagctgcgtcatgggttcggacgcctcgtagataaactggaagaacgcctggaacacgccgacggtcatgtgaccggcaaccagcatgctgcagcccaccagcgcgatcacgatctgcgccaaacggccgataaagcgcaccgcagggccgacggcattgatcataaagtcggccttggcactcacgcgtgccagctcgcccgaggcctggtgcacctcggcagaactttggcgttcgcggttaaacgcgcggatcaccagacggcccgaatagccttcctcgaccgcactcgtaatcttggacacccactcctggcgctcgcccgtcacatcgtgtgtgcggcgcgagacgaccttcgtcaccagcagcgacagtgccgtaaagaacagaaagacgagcgtaagctgcacgctgaacacgaacatcacgctcacagcaccaacaaccgtgccgatcgacacgagcagctgcagcaatccgcgctgcatgctctcggacatcttgtccaggtcgttggtcgcgcggctgacgacctcgccgggacgatgcgcgtcaaaataggcgagcggcagacggttgagcttttgcgcgatgcggttgcgcaggcgcagattgagacgctcagcgacgctcgacatcaaaaagctctggagcgcatagaacgaggcagcggcagtccagatcataaagtagacgaaaatggtcttgccgcagttctcccaggtgatgctgaaagtggtgtcgttggcaaacgccacctgaatgtggccccacagctcatcgatcacgcgggcgctatatgccggcgcggcggtgttaaagatgacatagaacacaatgctcgcgaacacgatatagaagcgccaatggtcgccggcagcctcactccacaggcggcgcaccgtcgcccaggtatcccgaggcgtctcgtcctcgtcttcgtcgtccacgtcgcgcatacgctctgcctcggcgcgggcgcgctcgtcctcggcacgttcgttttcctcgtagagcgcttggcggcgagcctcgcgctccgccgccttggcggcttcgtccaggtcgggcgcgacgcccgtctcctcgactgtctctacaaccgcagcgccatcgacgatgccctgcttcttgagctcctcggtcatgctactcacctcccttcatctgcgattccgcgattgcgcggtacacctcgcaggtttccatgagctcgtcgtgcgtgcctaggcccacgatctcgccgtctttgagcaccacgatctgatcggcatgcaaaatagtcgagatgcgctgggcgatgatgagcaccgcggcatcgcacgtctcgtcctgcagcgcatggcgcagtgccgcatcggtcttaaagtccagggccgaaaaactgtcgtcgaagatatatagatcggcatgcttcatgagtgcgcgggcaatcgccaggcgctggcgctgaccacccgagaagttcgtgccgccctgggccaccggcgtatcgagcccctggggctggtcgagcacaaaggtgctctgggcaacctccagcgcatggagcatgtcagcctcagtcgcgtcttcgttgccaaagcgcaggttgctcgccaccgtacccgagaacagccatgccttctgcggcacataggcgatacgcccgcggatgtcgtcttgcgaaaggtcgcgcagatcgatgccattcaggcgaatggcgcccttcgtggcatcgtggaagcgaagcaagagcttggccaccgtcgacttgcccgaacccgtcgagcctacaatcgccgtggtctggctacggcgacaggcaaagctcaggtcgcacagggtatcctcgtcggcatcgtcaaaacggaacgacatgtggtcgaacacggccaccgcgtcggcaccgtcaacagactccgccgcgcacgtgtccagcgtgcgcttgccgtccacgatgctcggctcaatctccaacacctgctgcgcacggttcaggcatgcggcggcgcgtgggagcgtcagaatcaccatctgcgccgtcatcacaaagaacaggatcaggatcgcgtactccagcacggccgagatgctaccgatttgcatggcgtggacgcccacgcggttgccgcccacccacagcaccgccacctcggcgatattcatcaaaaagaagctggagctgtcgagacccacaaacaggtggttgaccttgatggcattggccgcgtaatcgctaaacacctcgtccaggcgctgctcctcgtggcgctccttgttaaatgcgcggatgacgcgcacgcccacgatgttctcgcgcagcaccacgttcatgcggtcgataaagctctgcaggcgcataaagatcggcgcggcgttggcaacggtaaagaccgccgccaccagcacgatcgcaaccaccacgcccagcagcgtacccatggcgggatcgatgaaccaagcaaaaatgatgcctgccacggccaagaacggcaccggcagcaccagctgaatcgtctgaaggacagcttgctgaatcacgttgatgtcgttgagcgagcgcgtgatcatcgaacccgtgccaaagcgctcaaagtcgctggcggacagctcgagcgacttgtcgtacacggcattgcggatatcgcaggccacgttggcggccaggcgcgccgaaagatagcagcccagcaccgtgccgccgctggccatgccggtcgcgataagcatgtacaggccgttgcgtaatatatagtcgacatcacccgtggtaataccggtgttgaccatgttcgccagcatcgtgggaaccaacagcgtaccgacgttatctatcagcaccgcaaacagcgtcaccgcaatcagaccgcggtacggcctcataaacctcattaagagtcgcatgcgtccccctcgcccttatcgtcagtctcgttctcggcggccacttgccgtttaaatgcctcgcactcttcgttaagaacatgggagaacttaccgaccaagcgcatgatctcgcactgttcccacggctcgagcgcctcgaatgcctgttgctcggctttttgcgccggcaacgcgtagcgcttggcaaaccgcacgccttcttcggtcagtcgtacaaccttgtttttacgactgccctcggcaaactccaacgtcgcaagccctcgcgccctaagcgttttaatcgccgaattgatggtctgtttgctgtagaaccattcactcgtcagccgactcacggcaacgcttccgcccgctgcactcgtgtcgacgagcatccagtaggcgcagtccgaaaggccgcaggcgcgcgagaactccgaatagatatggtcgagtccattgagcaaccgatcgaagtcgaccagcgtaaccgcactattcatctatcccaccattcaattgtccgatttttgaccaattatgtgtctctagattagtccgagttttgactatcgtcaacaggctctccgcaaatgcgtgcatttttatggcctatcggcagaaaaagaccgccggcgcgggggcggcgccagcggtcacgtgaaaatcgggttttattgcctgttaagcggcgacggcctcatagaccgtagcgcccgagaagctgtcatgcaggctcttgccggcaatccacggcagctcgacgacctcgcagaccgtgttgaccaactcagaacagtcagtaaagtggcccttgtcgttgagggcctcgcaatcctgaacacgccaatagccatcggtgtgcgtgatgtagtactcgtgatcgttgatcgacacgaaagcgcgcgtcttggaacgcagcagcttcagaaatccttcgaaatcggtctcgacgacatctccagcctggaacatgatgttacctcctggcccggcgccaccacggcgcattgataaacgttggtactcctttagtaaaacccttatcagaggttatgcgttcgtcatttaggcaagtggtaaaaaaccgcagggtagacgggataaaacgtttaaccatcccatttgtttgtcacattatgaaggtacttttatgcaaacctactttcccaattggaatctatccttttggccgggcaattgaccgtctatcgtttgagcccgacgggtatgaacggggcatctgcaacgccaccgcaaggagacaccatggagactatcgaagcactcattcaccgccgcagctgccgcaactacagcgatcgtcccgtcgaggccgaaaagcttgcacgtattatcgaagccggccaatatgcaccgagcggcatgggccgccagccggtgacgtttgtcgccgtcaccgaccccgcgaccgtcgagcgtctctcgcagctcaacgcgcaagtcatgggcagcaacagcgaccccttctatggcgccaagaccgttgtggtggtgctggttgaccgcagcgtgcccacacatctggaagacggctcgctcgccatgggcaacctgctcaacgctgcctatgcgctgggcgttgattcgtgctggattcatcgcgcccacgaggttttcgattcgcccgagggcctggagctactggccagttggggtctacccgccgacggcagcctgcgcggtgtcggtcactgcattctgggctatgccgaggacacgctgcccgagcccaaaccccgccgcgacaacgtggtctacgtaaggtaattagttccgccattctaccgaacggcgggctcgttgacgctgcgcgggccgcattcacgccaatctgacgttcaatttcgagggcgcgaccagaaggtcagcgccctctcatttcacgtcaccttggcgcaaatgcggctcgctcgcttttggcgactgacatcgaatgagccactgtcttgggcagctaaaaaagccccgtcccaaattagctgccccactcgcaacttatcccgccgatggagttattgccgtttcgctcgtctgattcgcatcgacgtcgtcgccttgcttgtcttcgtccttttgcacatcggcgatggtggaggccgccgcaacgataccgcgctggggcgcgacgctcgtctgggcctgagcgccctcgacaacttctgtacctacatgcgcgagctcgggcgatttaaacattgcgtccaagttggcgccaccgccggcatatccgagcgcagcgagcgcgatgacgatcactgcaacggcggccacgatcggcacgtagcgatgccagccggcgggattgagcccgctgcggcgagccgccccgcggctgatgtagccgagcgttccgtcgtgcttgagctttgagcccaccacgcgtttgcggccccacagcgaggactctgcctgcattgccaagcgggcgcttgccgaaggatagccgtatttagtgcgcttgaacgagccatcaaaccccgaggcgtgtttgccccacgtcaccgatgttgtgcgtcggttgaccggcgcggcactccgccttctgcggctcggttttgaagtctcagccatatgccctcgcacgccgtaaccaaatcgaaacaataacgctttggactgtagcacacgcgtcgcgtgcggtcacgggcgcctcgctcaacggtcatcgtccttcagcaagcgccacagcgttgtacggcttatgcccagcacctccgccgcacgggttcggttgccgtggagatgatctacaaccaaatgcgcgatatctcgctcggtatcggccagcggtcgcaggatatacaggtcactttcgagtgtcggggcgccaaaggttgcggtcttaatcacgtcctcttgggcgagcacttcctccgccacagtgcggtccaccgtgcccgcccccaccaatatatacagtcgttccgagacctcgcggagctgcagataattgcgcggccagcggtaagcatcgagcgtcttcgccgccgcggcagacagcgtgggcgctgacgtcccaaatgcgtcagcgagatattccaaatagcgcgcaaccttcttcgacgcggctccctgctcggcgattgccggcgccacgctcaccgcacaggcgaagcgctcggtcacaaaagcggcttgatcactttcgctgccgcccggcatgtcattcgccgtcagcaccacatggcagcgcgtcgccaacgcggtgtcggccatcgtggaaacgagctcgcgaaggcgttggggaccaaccgcattccagtcctcaatgcaaagggtcagccccgtttggaacagcggcgattcggcgcttttgagcacatggcgccaaccgcgatcggtgagttcatcgagcgcgacggaaacaaagggctgaccggcaaaaggaccgtccagatagaggcgcttggcgatctcgacctgacccgctcccagctcgccctcgagcataaggggcacaccgcgcgcgtaactctctgcaaccggcgcagccaccgaggccgccccctcaacgatgccgtacgcgctcgattcgtagcgagcctcaacttcgtcggcgttgagccactcgatacccgcatgcgccgcggcaccgcgcacctcgcggaccacgacgacccaaaggcccccgccctctttgtcggtggggcgaacggtcaggctcaggcgcgcacccgcacgtcccataaccagacgcgcgccgtctcctatacggtcgaggcgctcagcgacaaaagccgccacatcccgctcgagcgccgcgtcattcatggtcgagatcgcgacgtccccacgcgcatcgattgccaatgccgaggccccggcagcagccagggcctcggtcaagatgttcagcttggcatcgctatccatgatttgcccctgtccgcggcgacatgcagccgccgacggtcgcacgaccgagtgtttcaaaattgaacgatattgctcaccaaacactatagggcagaaagcgccgtcctgcgagtataggtgttgccccgcatcgccatcctggcggggcgataagagctcttcgggacttataaacctgcggacaagccatacccgcaagagctcctatcgctccaccgtgagaatgcgctcaccagcaaccagcacgcaaacaagctacttctctaccagattcccagtacgtgttgcattcccaaactcatgcacgcaatgccaatccagcagcaaaagcccaatgcgatgggcttgccgccctttttgaccagctcgacgatatcggtattaaagccaatagccgccatggccatcacaataaagaatttcgacagctccttgatgggcgccgtaaaggacgcgggaagctgaaacaccgtggtgatcacgctcgccagcacaaagaacagcacgaacatgggaaatgcgcgcttaaacgagaacgtgctcttggcgtcgccgccggccttgcgcgccagatgcatctgccagcatgcgaggaccagcgtgataggaataatggccagcgtcctggtgagcttgaccaccgcggcgctctcgagcacattggcgccgggatgcatgctgtcccaagcgctcgccgcagccgttacggacgaggtgtcgttaatggcggtaccggcaaacaggccaaagccctcgttggtcagcccgagcatgccgccgagcgtcggaaacacgagcgccgcgataacgttaaacaggaagatgaccgaaatagcctgggcaatctcgcgatcgtcggcatcgatgacgggtgcggtcgcggcgatggcagaaccgccacaaatcgacgaacccacacccacaagcgtcgcgatcttacccggcacgttcataacgcggcagagcacaaaggcgatgacaagcgaggtcgagattgtcgccacgataatcggcagcgactgggcgcccttggacagaatctgggagaggttcatgccaaagccaagcaggataaccgcgtactgcaagacttttttggacgtataggtgacgccggcggcgagctgttcgcgacgattcttgggaaagacgagcgccaggaccatgccaaagaggatggcgaataccggaccgccgaccacctcaacctgtttgccgagcaacgtcgcgggaatggcgatgatcaggcagaacaagacgcctttccagcgctcgcgtacgatatttgccagttgcatatgggattccttctttctatttcacgtttgcgacggcttatgatacggcaacattgagcacagccttgcgcaaacacagactaagatgccgcgatagttctcaggcaacagccgaattacccaccgcggagagctgattcgcggcataattaacaactgacatatgagtttgatagaacagttgcgaggcgctatggaagaatcgatgcacgtcggcgagcaggaaacgagcctacaggaccagtcctaccacaccattcgacgcaaaatcgtctacctggactacaagccgggcgaaaagctgggcgtcaagcagctttgcgatgacctggacatgggtcgcacgcccgtgcgcgaggctttggttcgcttggcgcaggaaggcctggtgcgcaccgtgccccagagcggcacctacgtctcgcccatcaacctcacccttgccgagagtgcctgttacatccgcgagcatctggaaaagcaggtgattgtggagtgctgtgcgcgcgccacgtcggccggcatcgagcagctcgaccgcgccatcgtgctgcaggaaaaggccatggccgaggaggatcgcatcggcttctttttgagcgacaacctcatgcatcacatgatttttagcatcgcatgtcgcagcaccgtgtggtcgtggctcgaagagaccaatgccgacctggagcgcttccgctggctgcgcgccgccacgcaggttctcgacaatcaggacatcgtgaacgagcacaagcagattcgccgcgctatcgccggtcgcgaccccatcgaagcgagctttttggtcagcaagcacctgcacatgatgttccgcaatcaaaccgaggttctggaccagttccccgagtacttcgagaccagcaagctccgctaacctgccaaatagggacaggtttattttggcaggttttatccgagcaaatgcaacaaggcccggctccgtcttgatgcggagccgggccttagtcgctagaacggcggaaccaactactcgaccgtgacgcttttcgccaggtttcggggttggtcgacgtcgcagccgcgcaggatggcgacctcgcgggcgagcagctgcagcgggacgctcgccgtgatggggctgaacacgtcgcggactgctggcacgcggataatgcagtcggcgatcttgttgatctcctcgtcgccctcggtggcaacgacgatgaccttggcgccgcgcgccttgcactccatgaggttcgacacggtcttgtcgtagatggcactcttggtggccacggcgatgacagggaagcccgggtcgatcagcgcgatggggccgtgcttcatctcaccggcggcgtaggcctcggcgtgcaggtagctgacctctttgagcttgagcgcgccctcgtaggaaatagcggcacccatgccacggcccacgaacagcgccgactgcgcgtccttgcacagcagggcggcctcatgcacggcctcggtttgggtatccaaaatccactggatctgctcggccgtatcggaaagctcgcggaacagcatgcgcgcctgcttggtggtcaagcggtacttgacctgcgccagcagcagagccaaaagcgtaaggctcacgacctggccgatgaagctcttggtcgaggcgaccgcgatctccttgttggccttggtgtagatgacgccgtcgctctcacgcgccacggggctgcccaccacgttggtgatgccgaagaccttggcacccttgatgcgcgcatcgcgaatggcggcaagggtatcggccgtctcgcccgactgggacacggcaacgacaagcgtcgtcggcgtaatgatggggttgcgataacggaactcgctggccgcctccacctcggtggggatgcgagcccagccctcaatgagattcttggcaatgaggccagcgtgatagctggtgccgcaagcgatcacgtagacgcggtcgatgtcgttgagctcctcgagcgaaaggcccagctcgtcgatgtcgagctcgccggccggcgtcatacgaccaaccagcgtgtcgcgcacgacgcgcggctgctcgtgaatctccttgagcataaagtcgggataaccgcccttttctgccatgtccaggtcccaatcgatgtgggtgaccttgggctcgataacgttgccggcctcgtcggtgtactcgacgcctgcgggcgtgagcttggcaaactgaccgtcctcgagcaccacgacatcgcgggtggcgtcgatgagcgcgatgacgtcggaggcgacataggcgccggtctcgcccgcgccgaccacgatcggggaatccttgcgggccacggcgatcacgccgggctcgtcagcgcacacggcggccagaccataggcaccgaccacgtgggtgcaagcctcgcgcacggaggccatcaggtcgtgcgtctcggcataagcctcttcgatcagatgcgcgaagacctcggtatcggtctcgctcttaaagtggtggccgcgaccctccagctcttcgcgcagctcggcgaagttctcgatgatgccgttgtggacgatggcgatacggccgtcgcagctggtgtgggggtgagcgttaacgacggagggcttgccgtgggtggcccaacgggtgtggccgataccgcaggtagcgtcgctgtcaatgttggaaagctcgctctccaagcccgcgaccttgcccacgcggcggatgacatcgaggtgcgccgcggcgccctcgcccacctcgagcgcgacacccgaggagtcatagccgcgatactccatacgcttgaggcccgtgaccaggatgttctttgcaatatcagagccggtgtagccgacgattccgcacataagataaatcccttcgttcgcgtgactgcaagacgtccacgcacaaggggcgctgagacgtataacgttcgagtattgtactcacgcaaacgcaagctgatataccagaagtggtatctcaacttagataccactcgatgcacacacgtccagccggtccaaaccaccacaaaggtgcctgcccccttcgtggtggtcgcgctggcaatagcgtttgcccagataaaacctgccaaaataaacctgtccctttttggaaggtttgggatgctacaatctggcttgtacttgaaacgcatcaaaggggccgctatggcaaaggtaaaaatcagcgacgtcgcgcgcgaggccggggtttcgttgggcacggtttccaacgcgctcaaccaccccgaaaagctgcaccccgagaccctcaagctcatcaacgagaccatcaatcgccttggctacctgcccaaccaaagcgcccgtcagctcgcgggcggcgctaccaagtcctttggcctggtgctcccccgtctcgatcacggtttttcgctccaaatcgccagcggcgcccacaacgaggcccgcaagcacggctacgacttgctcatcgccaacgccgataacgacgatattctcgaggaccattacctgcgctactttatgggcacccagatgtccggcgtcatggttcagcccatggcatcccccgactggcaccccgccatgaccaagatgcccgtgccgatcgtccatctggacatccattgctccgagcccggctactacgtagcggccgacaacgaggcccagggtcgcatcattgccgaacttgctatcgcccgcggcgcgcaccatattgtcgtcgtcggccgagcagcatttatgcaactcaccctgcgcgtccttggcattcataaggcgctcgccctgcaccccgatatcaagatcgaagtcatcgacgccggcgaatggaataccgctgccgacggctacggcatcggtgcccaaatcgccgagcgccccgcggacgaacgtcccgattttgtcgtcggcctgaccgatgtgttggcctcgggtgtcgtttcggcactggtcgacaagggcatctctgtccccgggcaagtacgcgtggccggatgcgacggcaacccgctcgcttggagcggatcggtcccgctcactacggtagcgcccccgggctacgagattggccgcaagggtgtccaactgctgatggagcaaatcgagaacaaggccccggcaaagatcaagcatatccgtgtcggctccgcagcgcgtaccgtcaccgcagtcgccgccgaggatatcaaccgccaagaactggtacgtccgttcctactggaacgcgccagcacccaggcaagcagccagaccgacgccacggccatcaacctcggtgcgtatctatagcacgcccgcgagtatgctaagtcgccgcttaagcaaaaggggcccgaccattgccggaccccttttgtttaagcgcaaacgtaagcaattgctcgtttcaacgccgcaattgtctagcgcacggccttgaccgccgccgccaggtcgaacaacgtatcgagcacggcctcgcagccatccaccacgtcctgcggcagcggcacgatatcggggacggcaaagacatggcagccggccgtaatgcccgagacgcaaccgttgcgcgaatcctcgaccacggcacattcctcgggagcaaagcccgcgcgctcgcaggcgagcagatacatctcggggtcgggcttgccgtgcacgacgtcctcgccacacgttaccgtttcaaacttgtcaaagaggccaaccatcttaaggttgcgctcggccgtaacgaggcgcgacgacgtcgctagaccaacgtgatagcccgcagccagcagctcgtctaggcactcggcggcgccggccttaagttccagttcggtcttgaccatctcgtcgcgaatctccttgtggcgacgatagatcgcctcggtggtttcgtggctgccataatgcttatcgaggatgtccataacatcgggcagcgtgcggccgataaactgatggatcagcgcttcatcaatcgcgagccccagctcagcggcgcctaccttccaggccttaatccccaaacgctcggtatcgaccagcgttccatccatgtcaaaaataacagccttgatcatatcggtccccctcgccggattgcattactgccactctaccgcactttacaagcttgtatataacgtatatagcatattgcactttcgttacatagctggaagtcttatgacaagcagctcggtgggattatagtttcatccgagctttaattactgtaaggaactttcatgctttcagacaccgccgcacccacagaggagcttcaggacaaactcgcagcactcgagcagctgcttttggcatacggacgcgtcgccatcggcttttccggtggtgtcgacagcagctttttggccgcggtctgtgcccgcatcatgcctaccaataccctcctcgtccatctcaccacgccgctcatcggcacgcccgaacagacttcgtttgagcagtccgttgatggacaggccaatgaggggccgcattttaagctccccgtgctcaatctttcggtggatcagctgcagctcccccaagtagcctgcaacgatgctaatcgctgctaccactgcaagcacgccggctttaccgccatcgtcaaccacgccaagtcgctcggctttcccaccgtcatcgatggcagcaatgcaagcgatcgcggtgactaccgccctggcatgcgcgcggcagaagagctcggcgtacgctcccctctcatggaggtcggctttaccaaggacgaagagcgcgagctgctgcgcgcatggggctatcctgtttggaacctgccggcgggagcatgtcttgccacgcgcgtccccacgggcgaggagcttacgcgcgagaaggtcgatttaatccgcgcctgcgaggattacctgcacgatcttgacttggctcaggtccgcgcacgcctggtcggcggctgcatgcatatcgaggccgcacccgcagatgtcgccaagattgccgccctcggcggtgccgccgtcgacgacaagggcaagaccccgctgcccgccgttatcgagtccgcgctgcgcgagctgggctgcgaccatatctcccccgaggtcaccccctacatccacggcaacatgaacctttagattacgccgttttacaaacggcgtaactgctcggcgctgcgcgggctccgggcacatatgctcaacctggactgcgttaactgacctgtcaataagggacaggtttgttttggcaggttttatcttgggaaaatatcgcgaggcagtcgcccctctagcacccatcaaacttcgagagacgatagaggggcaattcggctgcatctacttcttccgatagcggcggttgcggctcgtcgatgaacccattacttcgatgagccctttatccgtcatttttggcagatggtagctgacggacgaattttggcattccgtctctctaaaacaaggcgcttatctctctaactttagagagataagcgccttgttttagagagacattaagagagatgtatcgaattcgctgctagattgcctaatgctatctctctaaccaaccttctctttagagaaacatttagagagatgagcgcgacctctctaatcaagggctccactctttaaggtgcacacttcctaaccgtgccctaagttgcggtgaaataactcacgattagcctgccaaaaagggataggtttattttggcaggttttatctggggaaacgcaaacagggccgcgacacctatatggcgtcgcggcccttttccttggagaaggatcgattgattgaacgggataaccgttctagtcttcgagtccgctattgatgagctccgcaatctcaacgggatcggtgctcgcgcgcaccttgtcgcggaagccggcgtccatcagcattacggcagccttggagagcaggcgcagatgcgtggttccagcctcgccggcaggcacgtacagcgcgagcgcaacatcgacgggcaccccatcgaagctcggccattcaacgggctcggtcagtttaagcacggcaacgcccggcgtgtggatcgcgtcgcttttggcatgcggaacggcaaaaccggcgacaaggccggtctcggcctcgttctcgcgagcaatgaaggcggcctctacggcagatgcgtcatcggcaaagccgagctcgatggcctgctcggacaaataatgtagggcgtcctcgcgcgaggcggcggtatacccgattgtcacttggttggcagatacaaatcccatggaaaccttccttacaacacggacctgaccgcagcttcgatgccgtcggcgtccaaaccgtacttgtgcagcaaatcgaccgcagggccggactcgccatacacatcgcgcacgccgacgcgacgcatcggcaccggatgctgctccgcgagcaccgaggccacggcctcgccaagaccaccgataatcgaatgctcctcggcagtgaccacacgaccggtcttcttggcgctggcaaccaccaggcgctcatcaagcggcttgatcgtgtgcatattgatgacctcggcatcgataccatcggcagcgagcgcctcggcagcctcaagcgcctcggcgaccataaggccacaagcgatgatggtcacatcggacccctcgcgcacgaccacgccgcgaccaatcttgaactcatagtcctcgtgatcgttaatgaccggcgttgccaggcgtccgaagcgcatgtagaccggtccctcaaactcataggcggcgcgcacgcaagcgcgagcctcgatgtcatcggcgggaacgattaccgtcatacccgggatcgtgcgcatgagcgcgatgtcctcgcagcactgatgcgtggcgccgtcttcaccgaccgagatacccgcatgcgtggcaccgattttgacgttgaggtgcggatagccaatggaattacgcacttgttcgtacgcgcggccggcggcgaacatggcaaaggtgctcgcaaaggcgacgtggcccgtggtcgcaatgccggcggcgagccccatcaagttgctctcggcaatgccggcatcgtagaagcgctcagggtgcgcagccttaaacttacccgtctgcgtagcggcagccaggtcggcatcgagcactacaaagtcatcgtgctcattgcccagctcgacgagcgcctcgccgtagcttacgcgcgtggcgacttttttgacctctgccattagagctcctctcctgctgccgcaagctcggccatggcctgctcaaactgttcatcgttgggcgccttgccatgccagccaacctggttctccataaaggagacgcctttgcccttcaccgtctcggcgatgatagcgacgggcacgccggtcacctcacgagcctcggcgaaagccgcctcaatctgtgtcatgtcgttgccatcggctagctcgatcacatgccacttaaaggcgcggaacttgtcagcgagcggcatggccgagttgacctcatcgatcgtgccgtcaatctgcaagccgttgtggtcgacgacggcaacaagattgtcgagcgcatggttgccggcaaacatggccgcctcccacacctggccctcctcgcactcgccgtcgcccagcaacgtgtagacgcggtagctgtcaccccagtgctttgcggcgagtgccattccaaccgcggcggagataccctgaccgagcgatccggtggacatatcgatgcccggggtgtcgttcatgttgggatggccctgcagtcggctgccaatatggcggagcgtctcgagctcttcgacgggaaaatagccgcgatttgccaacaccgaatacaggcccggcgccgcgtgacccttggagagcacaaagcgatcgcgatcggccttgtgagggtcagcaggatcgatattcatttcctcaaagtacagatacgtcatgatgtcggcagcaccgagcgatccacccggatgtcccgacttggccgcgtgaaccgcagtcacgacacccttcctgacctcattggcgaccttcgccagctcctggttggtcatacgaattcctctcttgagaacaaccccggcaccggatgacgcgatgccggggcaatccactcgttaagcctgagcgacgaccttctgccaatcagcctcaaaagaggcaaggccctggtcggtcagcgggtgatgcaagcatttcttaagagcggccatggggacggtcgcaatgtcggcaccaagcagcgccgcctgggtcacatggttgggcgtgcggaccgaagcggtgatgatctcaacggtgtcgtcgacgttcttgccggtccagtcatagttcttgatgcaagtcacaacattgtcgagctgcgagataccgtcctcggcgatgtcatcgaagcgccccacaaacgggctgatgtagcgagcaccggcattggcggccataagggcctgcgtcggcgagaagacgagcgtcatgttgacgcgcacgccagcatcggccagcgcacggcaggcggcaaggccggcctcgcacacgggaagcttgaccacgatgttgggggcgagggcggcaaggcgcttgccctcctcgatcataccctcggcagtggtagcggtagactcggcggaaacgggcaggccctcgcagagctcggcaatcttgagcatatgcggctcaaagtcggcaagcttgccgccggtcttggcgtacagggacgggttggtggtaacaccggccaggcagccccagctcttggcctcggcaatctcgtccagattggcggtatcgataaagaacttcatggtgaaccccttcaaaggaagctaaaactcaaaagaatgggacaaagggactgcccctttgtcccatgtgccgggcctgcagctgggacatgccccaggcccggcgtcgcgtaggaaaagctacttactcggcaagagcggcctcgatgcggctcgtgacgcccttgaggttaagaccgacgacgtactgcttgatcgggcgcttgatgtgctcgatcacaaagcgcttgccgtcgatgtcttgggcagcgaggttgcgatagagcttctcgacctgctccttgacctcgggatcgttgaacgcatagtggccggagacatccaggatcttcaggctgagctcatcgtcggcaaggatgtcatcgacctgcaggttgacgtcgtcgccagtcatccacttgcgccagcgctcggtcttgatagccttgaccagcagcgtgtgatacaggtcagaggggtcatcgcacagaccgttgtcgaccaggatctgctcggtggcgcagagcttgaggtaggcgcgggtctcctcggtgccatactgcggagcgacgttggaggcggtcacgtgtgccgggatgtgctcgagcagcgtcgcgtcgtccagatagtcggcgttgtgctccttcaggcccacgccatagcgcttggccatatcggcaagctcgcgggcgttcttgaagttgtagtgaccgacctgctccgtccagcgggtaagggtgccggtctggccgacgataaaggtgggcatggggcagccgcgcttctcgagctcgggctgcagctgagaaatgaactcctcgtacttatcggtagaggtcaagccgccattggtctcctcggtaccgacctcataggcgacctcgggcaggttatgctcgcgacggtactgctcaaggtagtcgataagatcgatcgtgcggcgaagcaccacgtcgagcggaataaccttgccgatctgatagggatccttggtggggtcgaccatcagcaggtcaaagcctgcctccatgtcggcgacgaaggacttgcgggcgagctccatggcctcgtcctcgggcaggtgagcgttacgctcctcgtcgcgctgccacggaccgccgtgatctcggcacaggtagtacggaccggtgtaacccacctcgtcggcgaccttcttgatgtcggcggcaaagcgcgtctggtcccaaccgttgacgtagccggcgcccatctcgtccatatcgacctggttgcggctggcgataaacatgggcgggaaatcctcgtccttggcaagctcgaacacggcctgaatcaggttggggctcatggggccaatgccgaccatggttgcgtgatcgccgctatcctgcagtttgagcatgccctgaacggcctggcggatggtgaggttggacattttgttctccttctccagaggatttttgacaaaagttccctgggacccagatgtgggccctatcagtacggatggattttgttgtgtaggggcggttgtgcggagtcaaatccatccctccgcacaaccggagtccttaaaggtttacttggcctgcttgtcgagcgtgggcttcatggcaatcaggattgcagcggcgaccacggcgccaatcacgatgtccaggcagaacagcgcgacgttgttggtggcaagggcgacgataaagccaccgtgcgggacgtagcagtcgataccctggaaggcggcgagcgccgcgcccacggcagagccgatgcagatgccgggcagggtgtggccaaggtccttgaccgcgaaggggatagcgccctcggtaatgccgatgcagcccatgaacagtgcggagatacccatctggcgatcggcgtcatcgaacttgttcttggcgatgagcgcagcaaggccgcaggcaatcgggggaatggcgacggcgacgcggaacatgccgttggggccatagatgccggaggccatgatggccatggtaaaggtcgaagcggtcttgttgatggggccgcccatatcgaaggcggtcataacgccaatgaccagacccaggacaactgcggaaccgccctgcaggctgccgagcacgccggtgagccagtccatcacaaagccaagcggcgtggccaggatgtagatataggccatgcccaggacaagcgaggtcagaatcgggatgatcaggatgggcatgatggtctggatggtgttgttgaccttccaggtcttcatccagcggacaaagtagccgcagatgaccgccatgatcatggcgcccaagaagccggtcgaaacgctgttgccgttaggggtaacgactgcgttgttgaccaggtagcccaggacaaaaccgggggcgagcgcgggcttgccagccatcgagtaggcgatgtatgccgcaagcaccgggatcatcatggagatgccggccatgccgatggtgttaagactcaccatcagcgggttcgtaacctccatgccgttggcgccggcggtaccggatgccagcgagaaggcgaggaacacgccgccgataacgacgatggggataaaataggaaacgccggtattgaatgcattgagcagcgtcttacccggatcggcaaagatagactgcttggacgccggtgtcggggcctgcggggcagcggagacggccttcttctctgccttggcctcggccttgggcgcgtcaacggtaccgcccgtcgccttgataatctcaacagcctggtcgatgatcttgaccggatcggcgatcacatcggaagtaccgaccttgaggaacttgccctcggccatcttctgctcaaaacggtcctcgttctcgacacccacgtcgacggactccaggaccaggtcggcggagtccacgtcttcctgcgtgagctcattctcgatacccaggccaccctgagcctcgaccttgcactcgatgccacgggcggcgcattcatcctgaatcgccttctgggccatatacgtgtgggcaataccaacagtacaggcggcaacgcctacgatcttcattgcttccctcttttcatagagttgcgtgcgcaagacaccgtttgcggaggcctccggagcatcccctgccgtttggacttgctgtcttttcgacaagaacaatataggtgctcgtttttcttaatgccagtttatttcggtaaacgcgcaggtcagagcgttggttatgcgatttagttatgcgtttaaccaaaaatgaatcctgcgattttgccctcgatttcaaaagtcaagaagtatttgattttctcggtagacggcagatgcgcatgccggtcacaaatttcgaccccacccgtatgccgcatttgttgcatactcatatgaaaggaaaaagccgctcaccgaagcgtatccttcaccaagactcaaagtcatcatgttggaaaatgctcatctgtcggaaggagtcgctgtggcaaaacagcgcgttacgatcgcagacgtcgctcgagaggcgggaacctcgacggcaagcgtctcgtattacctcaacgacaaacgagaaaagcttagcgagaagacgcagaacaaaatcgcgcgcgtcattaaggaactcggatacgttcccaacgcccaagcgcagacgctcaccggcaagcaaacccacgtcattgccatcatcattttggataacaccaacaaatgggcggggctcgttctcaatggcatggagcaggtcatgctccccgcgggctaccagacggtcgtttgcacgagcaactttaaccccgagaccgagctcatgtacgtcgacaagatgctctcgctgggcgtcgatggctttatcatccagcccacggcaaacttcaaagccgtgcatgaccgcattagacgcgccggcaagccggtcgtctttttcgatgcggccatctatagcccaggtaccagctggatcaaaaccaacctttacgacggcgtgtacaacgccacacaggcactcctcgacgccggctacgaagatttcttttccattgccgccaacatgaccgaaatgcgcacccgcatggagcgttttcaggggtatgccgaggcgctggcagcgaacgggcagctctacaaagcgattcccatcgatcacaacaagccgtcaatcaacgagctcaccgaatactttaaattcaagttcaatcccgccaagcgaacccttatcttcgtgcaaaatcagtgggcacttccccgtgtctacaaggccctccagccaatggcccatctgcttccgcagcaaatcggccttttgggactcaactgcgaagactggactaatctcaccacaccgaccgtctccaccatcatcgagcccgtcgaccaagaaggtcgcgaagcagccgagatgctgctcgccctacttgacggaagcagcgaacccggcgagcagcgcattctcgagtgcaagctcaactggctcgactccacctcgatctagaacgcgggacaaatgaatcagtagcgtctatcccaaatcttgagtatttgttcgacagaacggcccctgccggctcctgctagactggtagattcccaaccgtccatccaggagcctcaatgtcgcgcaagcccgcctacaagcaagtactttccatcggcaccgccgtggtgctcgggtttgcgctgtttacgggatcgctcgacggagcgcccaagttgctgtcgccgcaaagcgatgagcaggcggtagctctggccgagaaacaaaacgaaagtcccagccgcaccgacgacgaggcggacctggtcgctcggctcgaatcgggaacggcgagctcctcggaccctcaaaacggccaggaccctggcgatggctccgattccgccgcaaccgacaccggcgacggcgcttccgcggacagcgccgccacccccatcgacgaggtcgaaaaccccgacctcaaccgcgcccgcggcgtatacctcagcagcattcccgactacgcgggcaacccctatgttgccctgcgcgccgacagcacgcacccgctcggcacaccatcattcacgctcgatgaatacgagcgcgctacagaagagggctgctttaagaagttctccaagctcgacagcctgggccgcacccgcaaagcgctcgcctgcgtgggccccgaatcactcggtcaaggcgagcgcggcgatatctcgcgtatccatcccgctggatggcgccagcagcgctacgactttattccgggccagagcctctacaaccgctgccaccttatcgcctggtcgctctgcggcgaaaacgccaaccgcaagaatctcctcaccggcacgcgctatctcaacgaaacgggcatgctgccgtttgaggagcagattctcggctacatccgcgacacgggcaaccatgtgctctaccgcgtcacgcccatgtatagcgaagaggaacttgtctgccgcggtgtgcgccttgaggcgcaatcggtcgaggaccacggcaagaccctctgcttccacgtatattgctacaacctgcagccgcacgtgcaaatcgactacgccaccggccgcaaccagacctcgggagactaggaccgaccaagctgccccaaaacctaaaatgatccgttttcctccgtccccaagggaccaaaaagggccgccgcggttacccaaggcggccctttcgtcagcatctacattgcaggcaaaatcacacgctacttggcgcgaccctcctcatagcgctcgaccagcttggcctgaacgtcatagggaacctgctcgtagccggcgggcttcatggtaaagtcacccgtgccgcgcgtgatagagcgcaggcgcgtcgagtaatccgtcagctcagccagcggggcttgagcgatgaccacggtgtcgccgcgctcatcggtctccatgcctgtcacgcgaccgcgcgaggccgagatgtcgcccatcacggcgccggcgtagctctcggggatagtcaccgtgatttcctcgatgggctccagcaccaccgggtcggcatcggcgcatgccttgcgcaggccgatgcgagccgccgcgcggaacgccatctcgttggagtcgacgctgtgatacgagccgtcgtacacagccacgcgaatgcccgtgagcgggtagccggcaatgatgccgtccttcatggtctcctggacacccttgtccacagcggggatcagcgagcgcggaatacggccgcctacgacctcgtccacaaactcatagccatcgctcgtgccgtcgggcccaatgagcggctcaacgcgcagccagcagtcgccatactgaccggcaccgccagtctgcttcttgtggcggccctgggcactcgccgtgcggcggatggtctcgcgatacggaatgcggatcggcacgcttttggccacgaccttggtgcgatcctccaaacggttgagcagcaccgaaacctgtgcctcacccacggcggagatgatagtctggccggtctcctcgtcgcggtcgatgctcatggtcggatcggccttgcaggccttttcgataaacgtgtagagcttctcttcgtcgccgcggttctcggcctcgatggcaatgcgatactgcgagttgggaaacttaaacgccgctgcctcgaccttaccggtaatggagagcgtgtcacccgtctctgccgccaacttgggcgccacgataatgtcgccggcataggcgtgaccgacctcggtcatgtcgcggccgcacatcacatacaggtgagccagacgatcgctcttgcgggtacgcgcgttgatcagctcaaggcccggctcaagcgtgcccgtcagcaccttgataaagctgatgcggccctgctgcggatcggccagggtcttaaacacaaatgccaccggacggtcatcgtcactcgagatcttaagcgaatcgccgtcgatgagtggcatctcgccgtagtccgtcggcgccgggaagtacgtggcgatgtcgtccatcagcgagttgacgccctgctccttaatgcaatcgcccgcaaagaccggcacaaagatgcgctcggcgatcgccttcgacagcagaccttcaagctcctcctgcgtcagcgtctcctcgccttccaagtacttcatcatcagttcgtcatcagcctcggccaccagctcgcacagatggtcatgggcctcctcggcctgggtacgatactcctcgggaatctccgactcaacggcttcggtgccgttgcaatggcgcgccttcatgcgcactaggtcgatgatgccgtcaaagtcctcgccctcgccccagggaagggtcacggcgcccaggcgcgtgccaaagcgctcctgcagcaggtccattgtggtcgtaaagctggcctcggagcgcgacaggcggtttacgaacaccgcacgcgccaggcgcaggtcctcggcggcataccagagcttaaccgtcgtaggctgcgggccggcctcggcgtcgaccacaaacagagccgtctcgcagacgctcatcgcggcaaaggcgtcgccgataaaatcgggatagcacggggcatcgagcacattgatgcgcgcgcccttccagtcgatcggcgcaatggtcgtcgagatggaaaacgcacgcttgacctcttcggggtcatagtcgagcgtgggcttggtgccgtcgtggccgcccaggcgggcagtcttgccagaaaggtggagcatggcctcggcgagtgaggtcttgcccaccccgccttggcctacgagcaccacgttccttacgttaccggtcttgggagcacccatgatgacctccttgcagggccgcgcgcaatgcgcgacgccaacggggagagttcgcggtcggtgccatcccgggagcagcatggtcggcagccgagccgactcaccctccaaatgtcctatgccaccaccctaccctcacgggcggctgtccatgcatacctttcggcgcacgtatgaatacaggcggcgagaggaagagacaagcttgtgaggcgattattgaaccccgtcgatgcaaacaaaaagccgccacagaccgtaagacctgcggcggcttcgcctcaattaatagttgagtaaatacctgagcctatccctcgatacggctcaagaactcacgggtgcgctgctcacgcggatggtcgataacctgctcggcaggaccctcctcgacaatgcgaccgccgtccataaagatcacgcggtcggcaacatcgcgcgcaaactgcatcgcatgggtcacgatcaccatcgtcatattctgcgcggcaaggtctttaatgacacgcagcacctcggccgtcagctcgggatcgagcgccgaagtcggctcatcaaagaacaggatctccggatcgagcgccaaggcgcgggcgatactcacacgctgttgttgaccgcccgaaagctcacatggcaccttgttctcgttgcccgtaagccccatctgcgcgatcaactcacgcgcacgtgcttcagcctgctcgcgcgggcgcttgagcacgcgaatcggagcatcgatgatgtttttcatcacggtatagtgcgggaacaggttgtaattttggaacaccaggccgaatcgcgagcgtgcccgcttgggcacatcgcccttcgcatagaccgcgcccgaacccgcatccgtcgcaacggcaaggtcaccaaacgagagtgagcctccgtcgagtgtctcgagcagcgtggcacaccgcagcagcgtggacttgccgccacccgaaggcccgataatcgccacgacctcgccacgcttgacctcgagcgagatatccttgagcacctcattgccgccaaacgccttgcgcgcgctttcgattttcatcactgagttagtcatggtaatagtccagcttcttttcggcagcgcccagcagcatctcgacgacgaagttaaagacccagtagattagcgccgcgatcgcaaacggcaccatgctcacctgcgaggcgaccagcgccttggccgtcgagaacatctcacccacgccaatggcaaacgccagcgacgtgtccttgaccagcgtgatgatctcgttgcccatcgccggcagaatacgcttggcgacctgcggcatcacgatatacagaaacgtctgcacgcgcgaatagcccagcacctcggcagcctcgtattgaccgcgcggaatggactgcaagcccgagcgatagatctcggcaaagtaaccggcgtagttgatgatgaacgccacgacgcacgccgtccacttggaatcgggcgtgagcgaaatgccaaacacgtagtacggggcaaagtagatggcaaacatctgcagcatgagcggcgtaccgcgcatgaccgaaatgtagatgcgcgcaatccagcgaagcggcgcgattttgctcatgcgcataaacgccacggggattcccagcggaatcgaccccagcagtgtcagcacaaacaactgcaaactgaccaagaatccctggccaagcatctgcatcatgacctgaatagacattacttgagcacccaattatcgaaagatagaccatagcttgaatacttgtcgcacaggtccttgaccgtgccgtcctcgtagagcgccttgagcgactcggctacagcatcggccgacttggtgtcgcccttcttaaagccaacggcgtagtgctcgctggacagcggctcatcaagctgcgtataggcatcgggcttggcggcaagctgatactgggcaatcgaaagatcgcacgccacggcatcgaccgcgccgctctcgagctgcataaaggccgtgttgtactcgccgatcgtgtcgagcgtggcaaacgtcgctgccaggtccttctgatcaccctcaagcacgtcctgcgcagcggaatcagtctgggtaatcacagtcttgccggcaagatcgtcccagctcttgatgcccgcatccttcttgaccaccagcacctgctcgttgagcatgtacggctcggagaacgtgtagtcgtcctcgcgaccctccatggtaaagccgttccagatgcagttgatggcgcccgagttaagcagcgtatccttggcgtcccagtcgatggcctcgtatttgacctcccagtcctgcttatcggcaacagccttggccagatcgagatcaaagccggtgtactcgccatcgtcgcccacaaagccgtacggaggataggacttatcgaagcccaccacgagcttcttggactccgcagcacccttcacatccttggccgcggcagagccagcagcggagcccttgccggcaccaccgccgcaaccgacaagaccaaggccaagcaccgtggcgagcgagccggctagaccaacaaactgacgacgagacatatcggtgttcatggtatccccccttgatggcactttagttaagtaaagtgattcgtgtaacgtccagaatcatacactttagtgagatggagtacaagggagggtttgcccagcgtgggcggggagcggcgcgtaattaagtttcctgctctacagtcctgcgcaagacggaaagcacattaagtgctttcctttgcgtgcggaactcgcgataaacttaattacgcgccgctccccgcccacgccgggcaaacatcgttggacttatcactgacatgaaataggcgcttgtatatcgtccgctagcttggcacggtacaatgctttcagctttcaatttgtaaattagtggggttaattcatggcagaatctcgtgcggagcgtaaggctcgtcgtgctttgatcgaggcggctgaggggtcagaggagaaaaaatcttctcagaaatccaagtcgtctcaggacgcgaagggtaagtcggccaagggcaaggctaaggccaagcgtcccggctctcgtcggaacgaggataaggcatctcagactcgctccaagcgctcgcataaagatcgggtttcgtctgcgcgtaaggctgtggaccccaagtccccctgttcgatcatgaaagcttgcggtgggtgcacggcgctcaatcttccttacaagaagcagctcgccgccaagcaggctgctatggaggagctttttgcttcgctctgtgagcgtgagggtatcgccgttgattctattcgcggtatgggcgtgaccctgggcgatccgggtaaatatcctgcgccgcgtggctttcgtcataaggctgccactccctttgctcccggtagggagggcactgtccgttgcggtttctttgagcgcggcacgcacaggatcgttgccgtacccgagtgtcctgtcgaggcgccgggtgcccgtcagattctcaacggcatcgcgcgtgaggctgagcgcctgcgcattcccgcctttaacgaggacaagcatctgggcttgcttcgctatgccgtcgttcgctgcggctggcgtaccgaccaggtcatggtcacgctcgtgaccgctcagcgcgacttgccgcatgcgcaggagttctttgaggctgtcgccgcactcaatccgcacatcgtcaccgtcgcccaaaacatcaacggacgtcccggcaacgccatcctcggcgaggcaacccgcattgtatatggcgccgagtgcatgcgcgaccagctgctcggttgcgaattcgatatctcccctaccgcgttctatcagaccaatccgcagcagaccgagctgctctatcagctcgctatcgacggcatggatctgcaccagggcgatgtgcttatggatgcttactgcggcagcggcaccatcggtctttgcgcagctaaagatgcccagaacaaggggatcggcatcatgctgctcggtgtggagcgcaacccggcgggcattgccgacgcacgccgcaatgccgagctcaacggcctcacccgcagcgcttggtttatggccgacgatgccaccgattacatcctagatgccgccgacaacaacgagcggatcgatgtcctttccatcgacccgccgcgtgccggatccacccccgagttcctcgaagctgcctgcgcacttaagccgcgccgcatcacctatatcagctgcaaccccgtgactcaagagcgcgacctgcatcagctcctcgacggaggctatcgcctgctcaagatcacgcccgtcgacatgttccctcacaccgaccacaccgaaaccgtagcggtcctcgaacgccgctaaccaacctcagtatatttttgggacaagaaaggtggcgacccgcctgggccgcccccttcgcttggtttataaactccgctacatcccattgcgcagatcgcacacgccggctgccgccatctcgcgcagcagcgtctcgcggtcgcgcgtcacgatcaaatccagcgggaagtgaatctcgtcgagcatcttgcgcgcgtgatcgagcttgccaatggccatgccaatgtgggcatcggtcgacacgccaatgcccacgcccagctcggcgcagcgctcggcgatcttgcggcatacggcccaatgctcagtgtcgacaccgtgttcaagactatggttgttgatctcgataatcttgtgcttggccttagctgccaacagtacctcgtcgatatcgaacggcacgcccgagcgacccgcgtggcccagcatgaacaccttggggtgttccaaggcattgacatacatctcggtcgtttgggccagcgtcgcgccctcagcaatctgcggattatgcacgcttgcaaccaaataatccaaattacgcgtaaccaaatcgaacagtgaatgctgacggctgtacgaatcgccggcaatatcgagcgtgacaggagtgtcctcgccaaacaggcttccgtccagcgaaacgatatcggcctcggcaccacgcagcaccagcacgccgctccaaatgcgcggccagatatcctggttgataaagaattggtaactgcgcaggtcattggggcaagccgtaaccatagagctcagatggtcggcagatccgagcacctgcaggccacgctctgccgcccagtacacattctcctcaatggtcgaatatgcatgcgcagagaacatcgtatgggtatgaatgtcacaagaaagcaggtagggcatcaggtctccttatctggcacggccgtcgcttatattcattgtacgcatagccttcgatagtcgtaaaaccgctccatcccaaagacacaacgtccatgacaacggggtccggcttaacaccaaaccccgtttcacgtaaaacattgtaggcagagcgctttacttttaacgatactcgtccgccaactgtttccaagcgggtagcgaattgacaatcgtttcgtaactcacgcaatagcccaggcggaaccaacccggcataccaaagctgtccgagggaaccgcaagcaactcatacttctttgcgcgctcgcaaaacgcattcgcatcgggctccaacgctttcacccataggtagaacgcgccatccggctcaacataggtgtagccatactccgctagtgcgtcggtaagcgcggtgcggttgcgtgcataggcctcaacgtcactcggctcatcgatgcagtcgataattacgcgctgaaagagcgccggcgcgcacacgaagcccagcgtacgggcggcaccggcaacggcgggcattagacgatctgcctgaggattcgtattgggaacaaggatccatcccacgcgctcgcccggcagcgaaagcgacttagaatacgagtagcacaccacggtgttctcgtagatcgagggcacccaaggcacctcggcaccgtacacgatctcgcggtacggctcatccgagatgagcataatctgattctcgggatcgcgttgagcgttggcctcgcgcagaacattggccagtcgcgtcagcgtgtcgcgtgtatatacggcaccggtcgggttattcggcgagtcgatgatgacggcagtcgtcttatcggtaatcgccttgagcacgttgtccacgctcagctggaacgtatcttcatcggcgagcgcctcgacacacgtacagccggccttctcaatccaaacgcgatactccggaaagtacggagcgataacaataacctcgtcgcccggattcgtaacggcgttgagcgtacaagtgagcgaagccgccgcgcccacggtcataaagacgtctttgccctcatagctcgtgccaaagcggcggttgagcgattcggccacagcggcacgacattgcggcaggcccggtgcgggggtgtagccgtgcagctggtcactcggcagctccagggccttcttaatcgactccgccacggcatcgggcgccggaacgctcggattgcccaacgaaaaatcgaatacgttttccgcaccgatctgcgccttgcgctcaagaccatagctaaaaatctcgcggatgatggagctttccgcaccgtgagcatacatagtttcgttgatcatctgttcccctttcgcataggcgctattgtacgctttagccgagcaaagtgccgcagcaatgttgattggggacagacttaaatgcgtgaaaacgctcatttaagtctgtccccaatcaacagatggcccaatatcgctcaaaaaagcctccgcaggtttccccgcggaggctttcaccacaaagactatttgtcgtcgtcggtgtcggcaccggcattaacggcacagtcatcgccggcatcatcggatgcgacttcggcatcctcctgcatggccgcctgcgcaaaggccgcggcatcagccgccagctcctcctcgctcatacgaggcgcgcgcttcttggtcggcatgccggccgccttggcattgcgctcctccttggccgccaggatatcgccctcgcgctcaaggtaggcgtcccactcgttatcgagcagggcattcacggcatcgccctcgacagtctcgcgctcaagcagcaccttcgccatcagatcgagctgatcgcgacgggcatccaagatctcgacagcacgacgatgggcctcgcgcatgatgcgctgaacctcgatatcaatgcggcgcgccgtctcctcggagtaatcctgatgatcggcatagtcgcggcccaggaatacctgatgctgcgcctcgccaaagacctgagtgcccagctcctcgctcatgcccagacgtgtgaccatctcgcgcgccatcttggttgcgcgctccagatcgttgctcgcgcccgacgtaatgtcatcgcacatgagctcctcggcaacgcgaccgcccaagaacacggcgagctcgtcgagtatctcgttcttggtcttgaggaagtggtcctcctgcggaagctgcagcgtgtaacccagagcctgaccgcggctgacgatcgagatcttgtggaccggatcggagtgctcaaggatgtggcccaccagggcgtgaccgctctcgtggtaggcaatcgtggtgcgctcggcctcggtcatcacgcgacccttgcgctgcggtccggcaatcacgcgctccatcgattcctcgacctcgtccatcgagatcacggaacgatgacggcgagcggccagcagcgcagactcgttgagcaggttcgccaaatcggcaccagtaaagccaacagtcatctgggcgagcttctcaaacttaacgtcctcgtccatcggcttgttctcagcgtgcacgcgcaagatctgctcgcggcccttcacgtccggacggtcgaccgtaacctgacggtcaaaacggccgggacgcagcagcgccggatccagaatgtcggggcggttggtggcggcgatcaggatgaccgactcgctctcctcaaaaccgtccatctcgaccagcagctggttgagcgtctgctcgcgctcgtcgtgaccgccgcccaacccagctccgcgctgacgtcccacggcatcgatctcatcgatgaagatgatcgacggggcctgggacttggcctccttaaagaggtcacgcacacggctggcgccgacacctacgaacatctcgacaaagtcggaacccgagatgctaaagaacggcacgcccgcctcgccggcaacggccttggccagcagcgttttaccggtgcccggagggccaaccagcaacacgccacgcgggatcttggcgcccagcttgcgatagcgatccggatcactcaaaaagtcacggatctcctcgagctcctcgactgcctcgtccacgccggcaacgtcctcgaacttgaccttggggcgtgtggcctcgttggtcttagcgttggtcttgccaaactgcatgttcctgttgttggcgcccatcatctggcgcataaagtagaacatgatggcgataagggcgatcgtcggaagcacactcatcgccaagtcgccccaaaaatcggggtcgttggtgttgacgatgtacttggtatcggggtgctccgccatgagctcggcaagcgaatcggagccgacataggtcgaggagaaactcttgagctcgctcgtatcgcccttgtccttcttcgtcttccagtaatgacccgtcacgcttccgtcttgaaccgtataggtcagatcttcgacgcgatcctgcttaatggcgttgaccatctcgctcgtcgcgagctttacggtattgctggaattggcaaagccagagcccatgttaaagaaggcgtagcccagaagcgcgcaagccaaaatgaaatacagccagcccgtacgcgtgggcttcttgcctccgggcatccccgggatcttaggctcccggggagtctgggaattgttatcgttacggtcgtcgggcatcttacgaataaacctccggtttcaaaatgcccagatacggaaggttacgatagcgctcggcatagtcgaggccgtagcccaccacaaaggcatcggggcaatgggttccaacatacttgggcgtgatggccgagacgcggtcctcaacgtccttccacaggaaggcggcgacctccagagaagcgggcttgcggctctcgaggttcttcatcagatacttgagcgtcaggcccgagtccagaatgtcctcgacgatcagcacgtcgcgaccgcggatgtcgatatccaggtccttaatgatacgcacgatacccgaggacttcacaccgtcgccgtagctcgaaacagccatgaaatcgatgttggtcggcagctcgatcttacgcatcaggtcgcccataaagaccacggcgccgcgcaggaccgcaatcagcaccagatccttacccgcgtagtcgcgagtaatctcctcgcccaagcgagagacgataccgtcgatatcctcctgcgtaaacagaaccttctcgatatccggatgttgagaagccatgacaaccctttcttgtgcttatcgcccacacaccgccgtatggacgcgaacttcacattctagcagcgcacggggtaaatttaccagcccgtgcgccatcagcgcgggaataccgtcaacgtcgcacagaatagcaggcgtgggacgctattccgcatcgaccacgcggagcagatatgccacgcgcgttgcggccgtgcacttaaaacgctcgtccgcgcgaactccggcgacccacaccacggcaccccccggcgccgtcctcaccatgggcacgccggcgcgctcggaaacgggaatgcgagcctcacctagcaagtcggatactttcttgcttcggccactcatccctaacgggcacatcacgtctcccggtgctggaccgtccacccacaggcgcgccaatcgcgcctcggcagggatctcgccacgcgagcccgccaggatccgctcactatcgctgtcggcaaaacccagggcagccgcgtctaccaaagctgtcacttccccggcagccgcaagctcacgggctcggcgcacgatatcgcatcccggctcaacggccatcggttctgtgaccagcatgcgtcccccgcccaacggcaaacggccgggcacggtaacccagtccgcgaccaggccctcgcgagccgccggcgccttaaacgccagcatgccaaactcaatgcgtgcgtcaatccccgccggaagcgtgaccgagccggcaccctcggcaacgcaggaaaggactcgctccacatgtcgcatccctggacgggcgtccggatcgatgcgcttaatcgccagtcgcacgatgcgccgcgcgattaccacctcggctgcagcaaggcgcctggcatcgagcaccagcgcgcccgctgcctctttgcgcaaacagcttcgaaacgcctgtgccgaaagctgagacaaaaacgcgtcctcatcgcctaagatctcgcaggcggcgccaatcgtcttgcagacgctcgcgttgcgctgcgccaccaccggcatcactcgatggcgcacgtagtttcgtagatacgagatgtcctcattgctctcgtcttcacgccacggctgaccatgtacctgcagatagcccaccagctcgccgtgagtcaggtcgagcaagggacgcaccacgatattcctccggcgaggaatgctcgataggccagcgggccccgaacccttaatcgcgttcatcaaaaacgtttccgcgcgatccgaagacgtgtgcgcggtgcagatacgagccgccgttcgcggtgcccccgtctgggcgcagagctcgcgaacataccttcgcgccgcggcatagcgcacctcgcgggcagccgcctcgatattgcccgattcatcatcaaaatatgcatgctcgacacacagcggtaaaccatattgtgcgcagagctcacgcacaaaggcctcgtcgccatcggacgccttgccgcgcagatgatggttcacatgcagcacgtgcagtcgctcgcgcgcgatgggggccacaccacgcccatccagaatatccaactttgatgtgcacgccataaggagcaaagccgtcgagtccgcaccacctgataccatgagcaccacgggggcagccgtccgccgcgttgccaaggctttatcatcagcccacgatgcagcatggtgtccataatgctgagataccgttggcatttgcttcctcctctattcgtccgcacccattgtatcctttggaatcttatgtctcgtctgcaccttcatatcctcggcagtggctctaaaggcaactgcgcacttatcgagggcccgcaggggctcattatggtcgatgacggactgtctcgccgcgagacattaaaacgcatggcagaactggggctctcggcagacaacgtctcggctcttctcattactcatgagcatagcgatcacatcaagggcctcgatgtctggtgcaagcactggcacggccccctctttgccagcaggggcactctttcgaacaaagaaaatctttcgcatctgtctgtcgaggaattcgatcccggcgacgccctatccattgccggcatccacgtgcaaacctactcaacatcacacgatgtcatcaatccagtcggctatcgattcgacgccctcgatgattccatcggctttgccaccgacaccggagagctatcgagccaagccatgaacaccctcaaagattgtcgagtcctcgcgctcgaaagcaaccacgatgtgaccatgctgcgcgagggagaatatccccgctttcttcaggagcgcatcctgtctgcaaggggacacctctccaatggccaagccgccgaagccgcgcgcgaacttgttaccgatcgcaccgaacagctcattgccatgcatatcagccaagataacaatcgtccgagccttaccgtcaaaagctatgccaaagctctggccgcaaccctggatgacgaggttggcagctccgcaacccttctccaaggatcgcgaaaactctcgatacgccctgcaagtcagtatcaaccgacaaccattgtatagaccgctcaataaaacaaaaggggccgggaatcaaatcccagcccctttatcttggctcaaaagctctgaccatcggaaacgttagtcgatggagatcttcgtaacgttcttcttctcgacgatcttgggaaccgtaacggtcaggatgccgtcagcatacttagcagagagaccctcgctcgaagcgtccttcagatatacgccacgcgtcgcgctgtacgagctgaactccttctgcaggaagttcttgccctcgttctcctcgtcttcctcgacattcacgctaatggacagacggccctcattaagctcgacatcgatatcgtccttggcgacgccggtcagataagccttgacctcatagccatcgcccttatcctcaacgtcaacgggaaacgccttggaggcaatagagctgttcgccaggtcactcatatcatcaaacagatcgaacagcgagctagcagagggacgaacgccaaaaaccgaacgataaggaaccatgcttgccatgtttaccactcctttataggactgccgagtcatcttctaggtgactgggacttcttttgacgttcttatatatgcccacccggtgctcatatatacaccgactataaagttttttgagtccagtactataagcatatctaagtgagtaagactcaggtttttggaaggttaaggttctttgaaccagagcttaaataacgagtatgtccacagctacaaataacaaggggcttacaatgagcgcgtacacgttgttggtaacgagctaaagggcatcatggacgaccaaaaccagaacaatatgtttatgccgacgcagggggaagatatttccacgcagccgccacggttccgtcgcccccacatctcgcaagagcccattaatgatgcagagcccgaatatgtgacgagaaatcgatatcaaacgctcgaggatgcccaaacgggacgtaagcatatgggcgtcgcctcgggagaccctgtatatctgaaagacgcaccattatctaaaaacagcgcagctagtgatgagccgatgaaagcatccgccactcatcgacaaagaggtcctcgaccaaagcaaaccttgacgcattcggctcgctatctcgaaacgccaaaacagggaaaatcaatcttcgtttcgacaagtaaacgacgcaagcagcatcgactgacaatcctgcttttgatcattgcggtcatagcagttgcccttgttattcgatttattttctttaaataaaagctcaataccaaaaacgataagatcgtctggtgtaaatgagtcatttacgcccggtaaacgcaaaaaagggggaggccgcgaggcctcccccttctaagttcaagcgtacggctcggtgccgtccaccggtcagcggcgccctggcctcccacgggctgaccccgtagcgggtggtttaaagctggccgctgcgcggccagcggactaaagtcttgaacaacacccgccaccggcacgcccggtggcgggttcttttttgcttcgcgcgtataggagaagaacatcatggaaagccgcaagccgtatctcgccaccctgcccggactcatcctgggctgcctcgtttgctgcacgctctgggggtcggctttcccctgcatcaaaatcggctacggcctctttggcatcccggcgcacgacagcgcctcgcagctgctcttcgccggtctgcgcttcacccttgccggcatgctggtcattgttggcatgagcgtggcccagcgccgtccgctcgttccgcaagcgcgtgatatcaagcccatatgtatcctgtcgctcttccagactatcgggcagtacttctttttctacctgggactctcgcgcgccagtgccatgtcgagttccatcatcgaggccagcgccaacttcctagccatcctctttgccgctctggcgtttcgcaccgagaagctcaatacggccaaggtgctcggctgcgtactgggctttgccggcgtcgcgctcgtcaacctttcgggcgcggacggcacctttggctttacgctcgacggcgagggttttatcctggcctccaccgtcgcgggtgccctttcgacctgcctgatcggcatcttctcgcgcgagcacgacggcgtcttgcttgccgggtggcagttcttggtcggcggcctggccctcaccgccatcggctttttgatgggtggcgcgctctcccccacggcgattgcccccgccatcacgctcatcatctacatggcgcttatctccgcggtcgcctactcgctgtggtcgcgcctgcttgccgtcaaccccgtcagccgcgtctcggtctttgggtttatgaaccccgtctttggtgtgctgctgagcgcgctactgctcggcgagggtgctggcacgagccccgttaccgtcatcgttgccctgctattggtctgcggcggcatcatcatcgtcaacaaacccaaaaaagcctagcgagctacccttatttagcagagaggattcacatactttagcttaatggagtacatcagtgagctgagggccgccacgcacgcaagcgtgcaccccttttcctagcgtatctggacgccggctttctttttctcggccttgacgcggtagagctccgcatcggcagcgcgaagtaagtcttgccaggtatcaacactatcgccgacccgcgcgtaaccgatggacatccgcaatgcatacggcacctcggcacgagcgagctcgtcgttaatcgccgaacacaggtctatgatgtcctgttccgccgcagccttctggagcaccacgaactcatcgccgccataacgtgcgataaaaccaccagacgccgagcagacctctttgagcgtagcagatatgacctggagagcatggtcgccctccacatgtccatagcgatcgttaatcagcttaaagccgtcggcgtccatcataagcagatacacatcatcggcctgatcagcacccgagaacagcgacagcatataggtctcaaaacggttgcgattgttaaggccagtcaacgggtcggtcgagatcagctgctcctgacagatgatatagagcagcaacatgctaatcattatgccgacacaaaggccaggcaccgagtatacgatctgaaaggtaccgcccaccagagcgggaaccgcaaaaaaggcgagggtgcgataaatggccttcttttgcaggctttcgacttttcgagcctgaataaaggcatgcaaggacgtatatatgacgtagcagtagctaacgataggctgaatcatataaagcgctccgcgacgatatacgccccgcgcatcgatatagaacatagcgtgcgtccagtagctggtaaatgccagaacgaccaccaatgcggttggcaacgttaaaagtaccaccctatagggcgtggtcaggagccgtgagccctgcatcgtctcggaatagaaaaaccaaatgaggcacgcgatggcgaacagcgaaaacgaaaccgcgttggaaatccagttggccgtgatgcctacaggagtgctcacgccgtccgagagcgtccagatcatatcgaagaaaatgtaggcagcagacgtgtagcccagcatgctaaacaaaagctgctgggtgctcgagaacagggagcgacggcttcgtacggcaagtccgataagaataatcatgcacagcaggaatatctcgatcttgagtgcctttaccactagacgccctcccttcaatatccaagtggccagaatcgcccaattcgaatctgggcaacaaacaccccctactccgcaggagtaaggggaataatagcagagcgaccgaacgtcactgcaagacagctctcgttcgggcgctcaaacggcgcgagttgcacgccggaatcattgatgggtatcgattgctactcgccatcgatgtcggtcgcgacagcctcttcgatggcctcgacaccggcaggcgacaggtcttccttgctctggcagaacttcttatcgacccagccggtcagaatcggggccatgattgccgtgatgatgacggcagtggcgatctgcgcatacgcggtgggcgcaagctcggcatagcgcggagcgacctcggcgagggcgaccggcgtggtcatggccgtgccggcaatggtggaacatgccacagccgccttaccattgccgccacacaggcgctcgaaggcaaaggtaatgggaccgacgataaagagcgtgatgaggcccagcaggatgcccgaaatgccaccggcgatgaagctcgaaaggctcatggacgcaccgagctgaaaaccaattacagcgatcgcgggattggcgccgggaaccagcaggttcttgataaacgggaacaagttgcccaggaccatgccgataacaagcggcaggatggatccgatgatggtgccgacggggatgttggcgagacccgaaacaccaaggatgatcatcgtgacggcggggccggccgtaaagaacaggataccgacagcgccctgctcggactcatcgccgaactcgcccatgatgcccgtatagagcgccatgttgcaaaacgtaatgccgccgatgatggaaaccgagctcaggcctaaaaagttatcgttaaagaagtacgcgacgcccagacccagcgcggctgccactacaagcttaggaatcagcacgacgatgccggtcttgatggcgcccggcgtggacttaaagctgatgccggcgcccacgaacagcaagatcgcggcaacgatggtgttggagccgccgcggcaggcagccgtaaagaagccgccgacctcaaagacctgcgggcagaaggtattgagcaaaaggccgacgatcatcggatagatcatgatgtcgcccgggatgcgcggtaccttgaatttcttttgctcgctggcggtcgcttcctgtgccatgaaacccccatttccgctgacgcagaacaaaagcccacgtcacgctttgctacagtaaagtttgaccatggtaccagaagaagcagaccgcctcggtgagaaattcgattcgttaggccgggacgataacgcgtcctgctcctatacgaggctcaaaacgatatagaacacgatgcccgaaacgcagcaccacaacatcgactttgtcttgattgccaccgccacgacgccggtggccgcaatccagggaaccaaggcaggccagagtcccgcgtcgaacgcgccggggttcaccaagtcgttggcgaccagcgcggcaaaggcagcgggcgggatatagcccagggcctcggtaatgcggggcgacagggtccgcccgcgcaaggcgaacgccggcgcgatgcgaaagaacgcgatagcagcccacgacgacagccacagaaccaagaactcgttagcgggcatcgcgggcacctcttccgtcaaatacagcatcgcacgccagcgcaatggcaatgccgaccacgacgcttgccggcacggcaatattcgcgaggcccaagaacttgcatacggcgacggacaccgcgcccgaaaccgccgcgacaacgttaccgcgcgacagccgctgcgaaaagagcaggcagataaagagcgaggtgcagacaaaggctgcaatggcggtgggaacatcgacaacggcgccgacgatggcgcccatcgtacacgaaacgccccatgttgcgatgaggattacgttgagcacaaaggactcgcgcgggccccaatcctccccttcaaccaacttggcaagcgagatgccatatgcctcctcggtaagtgtcgcggcaacagccagcgtctgacgcttcgaggcacccctcagatgcggtgcgatcgatgccgagtaaagcgcaaagcgcgaggagattgcggcgacgctcgcgacgatcgatgctgcaggcacacccgccagccacaggttgcagatcataaactggccgctgcccgtcacaaacgtactgcttagagcaaagaccatccagggctccattcccgtctgccccatgatcattccgcacggcgcgcctattgcaacataggtaagcatcactggccagacggttctaacgattttgagcaccatacgtttctcatcctgacaaggtctccgagccgcatgtagcgacacggcagaatcatcatccggcagcaaccgagttcacctacaattgccaccggatcgaaagacacaactttttaggaagtcattatgacagctatcgatcgagaccgggcgcgcgcggccttcaaaagctacaccgatgcctacgacgccaccaacccacgcatcgcgctcaaaatcgagcatacgtaccacgtggccgaggcatgcgatgccgtagcgcgcgagcagggctggtcgtcagaagatattgacctggcatggctttgcggcctgctacacgatatgggccgctttgagcagctgcgacgctgggacacctttaaggacgccgagagcatgagccatgcggcgctgggcatcgaggtcctctttggcgagaatcccgccgatgcacccgccgtaacgagcatccgcgactttatcgatgacccggcagaagatgagctcatccgagcgagcattgcctatcacagcgatttccgtctacccgcgcagctcgacgagcgcacgcggagcttctgcgatatcgtgcgcgatggcgacaagatcgacattatgcgcaccatcgccgacagcactgtcgacactatcctcaaggtggacgagaagacgtttctcggcagccgtttctcgtcgccgacacttgccgcctttgacgagcaccgctgcgtcgcacgcgatgagcgcgatgagcccgccgacttcttggtggggcttatctgctttatgtttgagctcgtctatccagcaagccgcgcgctggcgcgcgaacagggcgatatccaccgcctgctcgacgcgccctttggcattacgcggccctttaccgaccccgccacgcaggcaacttggagccgcctaaaggacgagatgcgcgactggctggcgcgcgcctagcgctcaagctgggccagcagctcctcgacgacctcgacggcgtccccaacaaccttgtactgggcagcaccgaaaatgggggcatccgggtcctcgttgatggcgatgatgcactccgccccaccgatgccggcaagatgttggatggcgcccgaaacaccgatactcacgagaagcctgggcgaaaccgatacgcccgtctggccaatctggtggcgatactccagccaacccgcctccacgacgggacgcgtgcaaccaagctcggcacccagagcctcggcgagccttcgcatcaacggcaggtttttcttggaaccaatgccgcgacccaccacgaccaggcgctcggcattggcgatcgagggctgctgtccccactcctcggcgggaatcgagatttcgacgcgggccttaacgtcttctgcaagcgccacctgggtgatcgtgccggagcggccgtagtcgaagtcgggcgccttaaagatgccgggacgcactgttgccatctggggacggtgatgggggcagacgatggtggccatcaggttgccgccaaacgccgggcgcgtctgctgcaacagacccgtctccgtatccatcgaaagcacggtgcaatcagccgtaaggcccgtctgcaagcggacggcaacgccgggcgccagctcgcgaccaaaggcggtcgcgccgtagaggatggcctcgggcttgcgctcggctaccagatcgcagatcagacgagcatagacttccgcgtcgttttgacgcagacgctcgtcgcgacaggccagcacttcgtcggcgccggcgcaaaccaaatgctcaagctcctcgagtgaactctcggggctcacgccgactagtgccaccaaacggcagccgcgggcatcggcaagctcgcggcccttgcccatgagctcataggccacaggggctacagtgtcatgctcgtcagtctgaacgaatacccaaatatctcgatacgcgtcgaggtccaccgtgccgacggcttcatcgcgctcgatcgagatggcgttaacgggacaggcgtcgacgcagccgccgcacaggatgcagccgtcggttacgcgggcgcagcggtttggccgctcaccctccaccacaataccgcccgaggcgcaggcacgaacgcagcgaccgcagccgatgcaggcttcgctatcgataatcagtccgctcatctatgccatcccctcgataatcttggcaagctttgccgcctgctcggtcggtgtgccctcaacggcttcgcacgtttgatcgcggtcgggcacaaacgagcgcacgacctgcgtcggcgagccagcaaggccgcaacgcgcggggtcggcatgcacgtcggcagcgctgaccacgcacacgtccgcctcctctgccgcacgaataccggcaatgctcggcatgcgcagctggccaatctctttggcagttgtcatcgcgcagggcatctccagatacacggtctcctcgccggcatcgcatccgtgaacgagcgccagcgaaccgcacgtcgtaaagcccgcgctctgcacgcagctcacatcggtcacgcagggaatctcgaaggcgccggcaagctcgggaccaatctgggccgtatcgccgtccaccgccatcttgccgcagataagcaggtcgaagtcctcgtcgaacgcctcgataccgcatttgagggcatacgtggtcgccaaggtatcggcacctgcaaaggcgcgatcggttagcagcagcgcgtcgtcggcgccacgggcgatgcagtcgcgcagcagcgcttcggtcgcgggaatacccatcgacaccaccgtcacgcgcacatccatgccaaagccgataaagtcgtccttgagcgccagcgcgcactccagggcactcgcatcaaagggattgatgaccgcctgcttgccgtcgcgcacaatggtattggtcttggggtccatcttgacctcggtgcttcccggcaccgccttgacgcacaccaccatatggaaatcgctcatcttcacgcgccccctttctggacgagttcatccaagagcttctccgaaaacaggttgccgcgacccagctgtccggcaggatcgagctggagcttgagccgcgccgattcgaccatggcctcgtggccgtacatcgtctcgagaaagcccgccttgatcttgccgacgccgtgctcggcggagacggcgccacccatagccgtaacttcggaggcccactgggcaaacaactcgccgccgcggcggtaatcctgcgcatcgcgcggcaggatgttcacatgcaggtggttgttgccgatatggccccacgcggcggactcaagaccgctttcggccaacgtgcggcgatagagggcaatcacatcggccaggcgcgcgttgggcaccgacatgtccgagcccagcttggtgatggtggggtcggtgcgacgacgctcgtcgataagcatgttgacgctctcgggcaccgcatggcggaagaatcgctggcattcgcgatcgacctcggtacgcgcgacccacgtcgcatcatcgctgccgcccgcaagctccaatacccaccccaggtgatacagttcttcagtcgcctgggcttcatcatcgcagtcgagctccacgtagacgcagaccttggcctctttgtcgagcgccggcagcgaagaaaacgccgtcgactgctcgcgctggcggcgtaggatatccagggcgcccgcatcgaaatactcgatggcggccgcgtgggacaggacggggcgcacggaatcggtgaaggacacggccttgtcttcgctatcgaaaaagcagctcacaccccaaacgaccgccggtgccggctgcagggcaatctcgagctccgtaatgacgccgagcgtgccgcaggcgccgataaagaggtcgatggcatccatgtcgtccgcaacaaaatagcccgaagcatttttggtcttgggcatggtgtaggcgggaagatcaagctcgagcgtgcggccctgcaccgtgacgagcgaaaggcgacgaccctgcgcaaaaacctcgccgcgctgaagttcgaccaggtcgccatcggtcagcgcgacatgaagacccgtgatgtgggggcgcatgggaccgtaagcgtagctacgtgcgccagaggcgttgcatgccgccataccgcccaagcaggcagatgcctcggtgggatcggtgggaaagaactgctcgggggcatcctgaaactcctcgtaagccttaagcgatgcctggtcccagcctgcggtcggaagcacctttttgcccagttgcttgcgcaactcggacagcacgacacccggctctacgcgaagcagaaagcgaccctgttcatcgcggcgaaggcctaggtagcgattcgtacgggaagtgttgagaatgtggccgccatggggcacggcgccggcggcaagaccggtccgggcgccctgaaccgttaccgagacgcgctcggcatggagctgccgcaagatggcgcgaacctcgtcttccgatgttggaaacgaaatgctcgaggcctcgcccgacgagcgagactcgtcgcgaccgtattcctcgaactcatcagtgaagggtttgatagttgcagacatgcagaactcccctttagctaactacagtgtttgcagggagatgttaccgcatcgtttcgttgacgtgttcgagaccgtctccataattgaggatttttacgttcgtgcaattcggcgagcggccgccacatctcggcaggcgatgttttttacacatatcgctttgccgccaacgatcgcgaaattggcgctcaaaaaatgttgaagtatttttaccacctgttacctgcgacgatgcgaatccgtcaagtatttggtcagcttttggtcaagtagtggctgatacggtcggcatcgacagccaaaaccgatagaagttttggtcccagaagcagggaggttcctatggcatattactggccccagtacggtgtcgccatcgaagtcgacgacgatccccatctcctgcctttcgaagaagaggcattccccgacacgacggtctaccacgtcactaccgatgtgatctgcgaccctgagtcgttctcggcactcgcccaccacatcgcatgcatccacgacatcgagctccctcccgacttcgatgagcttgtctactcgcgccgtctgatgcttcacatgctctttggagcggacccgtccacgttcgcacgcgtctacaccaccaaggacgccgcatgagcgcgaagaagttgccccggctcgcgagtccgggacatcgcaagaaactcatcgctgtctgcttggctatcgtctgcgccctcgtcgccgtaggcttgtacgcctggcagacacagcccgtacccgaagcgggcgcctcggtcacgacggccgagggcaaatcgcgccaagaaatccaagacgagctcgacgccatcgtccgcgacaacatgatgacgatctcggtcgcgccggtcgcccagctgcaggaaggcggcaagttgcgcgtcaacgtgcaaaacgtccaggacaacaagtttccccagcgattccgcgtcattcaaaacgacgagaccatctatgagtccggcatcgtcgaaaccggcaagacggttgagacgtgtcccgccggcgatatcgaggaaggcgaagcgtatatcgaaatccaggcactcgacaccaagacccatgacaaccacggcaatccgacgcgcgtcaaggtccgggtggaacaggccgagagctagcccctaacgcccgctgtgtcattgcgcgcagtcaccaacactcgtccaatcatcgcggggacggcccgcggcgaatagaaaggaacgaccatggacatcaccaggaacatgaacggagccagagcgctcgtcgtgggcgcagggctcgcgctcgcgctcgcaatgggcgccgccccgacgccagctatggcagccgggcgtgttggaagcacgaaggtaatggtcaagaccgagatcgacaacgttaatttcaaagttccgacggttattccgttcatcgccaaggccgacggcacgcttcagggcccctcagaagatgcaaccaccatcgacaacctttcggcctacggcatccatgtcaccaacatgaagatcgatgccatgaacacctggaccattgccgccgacgcgaagaccggaaccgctcagaactccatcgactttaaggtcggtcccgaaggcgcgctccaagacgccagtgccgcaatgcagggaacgggaatcgatctttccaaaaacgcaacctttgatatgggctatcagggtattgccggcggttcggacaagatcaagctcaagacgagcggaaatgtcgcccgcgtcacgcgcgacatcttccacgtaaccggcgaaggcgatcaagttgcaacaatcacctggacggtcgagcccggtgcgcacacggcataaggtgatcgccctggccgccgccgtcagcatcctagcgtttgggccagccatggcctttgcccagcaagaacaggctcaggccgccacgcaagtgacggtcgacctctcggggctcgaccgcggcaaccaccaggaaccgttggcgcagacaggcgacgaaaagcagctcttggcagcaagcgtcgctgcggcgggcgcgggagccaccggcctcggactgtgcatcaaacgcaaccagcaataagacacaaccagctcgcacaatataaagcaaggagaccccatggcatcgaagaaccttttgcccgtcgtcgcgctctgcggcgcactcgcaaccggaacgcctatcgccgcttgggcgacccccgtcatggcggactccttgccggcagccctaagccccgcaccagacccgtcgagcgtcattgcgtgcaagcggttttcgctcacacaggcaacagtctcgacctcgggatgccttcgtcaggacacggacagctcgatagtcgtggatatcaagcgttcggacaagacggacggctcccaggcaggatgcgccatctgcacgtggcgctcagttgcgctcgatgcagatgacgacccttgcgatttggagctacgcatcgacatcgcttcggtcgatgactcggcgaacgaagcgaaggtcgccttcgacagcgcgtttttcgaagaagaaggaggtgtatgcctgggctgcgttgtctcgcacgccgacggcgcgcagcccacgctctcattcacggcatcgttgcggataaccaaagccagcaccgacgccgtcgcaacgggagagacccccctgttgttctacgccgacaatgccgaaggcgccaaaatcaaagacgataagcaaaacgggtcgctcagccttactcgaggggcgaaactctgccctatcgagatcgatgtccaaacgcaagacaggcagcacgtacttgccgacccggcgctcctcgaaatggaatggaatggagctggagccatcggggtcgccccctttgtattgaacgaaatggccttcccatcaaaagatggcaccacgaacgcagccataacagaggagaaagcagacagcgcgccactgccgacaaacggcatctccgccccttcagaggaaccggatgaagctgttatcgagccaaacgatccccaactcgaggacagcctaggccttgcgacgtcccaagatgtcgatgagggcaactgctgcatgctcaccgcactcgaccacacgacgaccgtcgatgcagcaagcatcgaagttgccgcggccaatcaacctgttcgcaaatctgccatcattgcatttccggagtccgtcgaggtcgtctttttgccatcgggtgaaatcgtggcaccaacattgctcaccttgttaggcgccaagaatactcggaacgaaatcaaaaagatcacgatcgtcgaccctgcgaccactgccaagctgcgcctatacgccgttgccccagatggaagcaaaaccttggaattcgatggcgacacgctccaagcttggcggcgtctggacattatggaagacgtctcgtaccagattgaacttgaagggtttgaccgcgcccgagatgccgatatcatcgccgcgggcatcgagtccccgcaacggctgatgacgctacgctttgaatactatccctacgttccgacgacaacctagggctttcccgctgaacgccagacttaataccactcatataacgtattagacaagtcgcgatatgccctgcgttccattctgctacgattgccaaggtggcatcaatacgggagggctcatgccgggcttgggaacaatcatcaacgttgtgcttttgattgcgggcggtcttttgggattagcgggcggccgttttatcacgccccgtatccaagatacccttatgaaggcgtcggggctgtgcgtcctgtttatcggcttgggcggcaccatgcaaaagatgctcgtcatcgatgggaaagccctggcgaccaccggcaccaccatgctgatcgtctcatttgcgctcggctcgcttatcggcgaggccatcaacctggaggccgccatcgaagacctcggcgaatggctcaagcgcaagactggcagcgagggcgataacgagtttaccaacgcttttgtctcggcttcactcaccgtgtgtatcggcgccatggccattgtggggtcaatccaggacggcctgctcggcgactggtccacactcgccctgaagggtgcactggactgcatcattgtctgcaccatgacggcctcgctcggccgcggctgcatcttctcggccctgcccgtcgccgtgttccaggggacgatcacgctgtttgcgggcgcgctctcccccatcatgaccacggcggccctcgacagcctctcactcgtgggatccatgctcatcttctgcgtcggcgtcaaccttatccgacctcagaccttccgcacggccaacatgctgcccgccgtcgtcatagccgtcatctacgccctcctgttctaaatctatctacgttgcggcatttcgaacatctgtttgatgctgtgctatgatatgaggtcaccgacaccgtatagggagaggagagggcggtggccgaccaggacgtcaagatgctcatcgagcgcattatggccgaggctcggacccatcagtccgcccgcttctcaaataaaatctatgctgacgagccgattctcaagaccggccgacagatgcagaacttcctccccgaccagtaccgcaagatgcgcgagatatcgcgctggcaggatgatcccaagggcggcgcggggcgttggctatcagaggcggagcttttttaccgtcagggcttactgatggccgacttcgaagacgattgtccctacaacggcacgtttaagtcgtactttcccacctacaacgccatgagcgatcgacaactgcgcggctactttacctggcgcgcccaggtgcgccgcaaaaaagtggaagagacgtccacgtccttcgcctttttatatctctacgagctcatctgcggcatcggtgtagacaatccgctcgacggcttccgcaaaatcaaagccttttgggaatcataccgagcttatgagcccggcatcgaccggttcgcgcgcgtatggctgcaggactacgccgtattccacgggctcgatcccaaactgctcagcgattccaaaacggtcttatttgataaggcgctcattgagctgcgccgtgcggcacgcgatatcgagcccttgcctacacccgctacaccagcaaccaaacgccgcaaatcctccgagccgaccctccccctgccgcccgatgaggcgcgcgaggagcgactgatggctgcgatcaatgcgctgtcgacctacaacctgggcaactcaaggatcaaccatgcgcaccatcgcgacctgcgacacgtggcttgcgccgtctatgtccgcatggcccgctactatgacacgcaccgaaagagtggcattgtggcgagcctgtttggggaggagacggccatgccttataccatgtttgcctcggccgtcttctttgcccccgagcgccacaaggactgcgaatatcgtctggaccccatccatatctaccgttgccaaaacggcttttgggaatgcatgcgcatccacggcagcagacaaaagagcagcaagctcggcgagatgatgcgtgcctgcgatcagcgcttgcgcttggcgttggatcccgctcatccccttaaggaagaaaaggttcccaaatatctggccaagatcatcgacgatgagattgtggcctggctttcgtgggacgctgcacaccagcccgtcaagatcgatatcgacctgagccagctggggcatatccgaaacgccgcagcacagacgcgcgaggcgcttttgatcgacgaggagcgcgaggacgatgcgcttacggaagccgcggaagcagattctgggcaaccggaagccgaacccgcggcaaacatgattgccgaaccggccgcagcgtccacgcagcagaatgaggctgacgagccgaccatctccaccgagcagtttggtgtcgtggccccgctcctcgcgcccgagcccacacccgcaacgcccatgtccgccggcaccgcatccgcactcgcccacgccgcagaagactatcttcgtgcgttgctcgagcagaacgcggcgcaggcagcatcggctgtggagaggtcgggccagagcgaagacatgcttgtcgacaacatcaacgaagcgctctttgacctcgtgggcgacaccgttattgaattcggcgcggcgggaccgcagataatcgaggactacgaagcagacgtgagaggatatctagaccatgagtgataccacatccacagcaccccgtgtgcccaagcgcgtcgccgccgtcattctcaactcgctcaagggcggcgtcgtcccgcgcatcggccttccctacatcaccgtgggacgcgaggtcgagatccgcgccctgctcaccgacctgagcctcatagccgatggcggcgcaagcttccgctttttggtcggtcgctacggcgccggcaagagctttttgctccaaaccatccgtacgcacgccatgggtgagggcttcgtcgtcgccgatgccgacctttcgcccgagcgtcgcctgcagggcggtcaggggcagggtctggccacctatcgcgagctcatccgcaatatatcgaccaagacgcgccccgagggcggcgcgctcaaccttatcctggatcgctgggtcgcctcgtgcgccaataccgacgagtcagccgttaatgcccagcttgccccgctcgaggagatggtccacggttttgactttgtccgcatgcttcgtcgctatcgcacggccgtctctgagggcgacgaagagagcatgagccgcgtgaccaaatggattcgcggcgagtaccgcaccaagagcgaggcacgcgccgagctgggctcctcgaccatcatcagcgacgacgactggtacgactacatcaagctcatcgcgcgctttttggtctgcagcggctataagggcatgctggtgctcatcgacgaactcgtaaacctgtacaagatccccaacgccatcacgcgccagtacaactacgagaagatcctgaccatgtacaacgacacactgcaaggcaaggcacagtacctgggcatgatcatgggcggcacgccaacctccatcgaagaccgtcgacgcggcgtattttcctacgaggctctgcgcagccgcctcgcccagggccgttttgcacgcgaggacctcaaagacatgctcgcacccatcattcgcctgcagccgctcacctatgaggagctgctggtgctcatcgaaaagctcatgcagatccatgccggctactttggctggacgcctacgcttaccgagaacgacctggtggacttcctcaagattgagtttggccgcgtgggagccgacacgcacctgacgccccgtgaggtcatccgcgactttatcgagttgctcgatatcctgtgccaaaaccccgatgccgacgtggccgagctgctgcaaagcgtcggcggcgacacactggcaccggccaacgaatcgcccacatcatccgacgatcgcaacttcgccgaattcaccatctaacctgccaaaaagggacaggtttattttgacaggttttatctgggcaaacgtcgagacagtaatgtagcgagccactgcccaccgcgttgagagttccgcttttgagaggaggccccgtgaacgcctttgaccgctacgccccgtttatccaagacttcatctactcccacgattgggagagtctgcgctctatccaggttgcggcagcagatgccatctttaacacacaagacaatgtgctcctaacggcatccacagcttccggcaaaaccgaagcggccttctttcccatcctgaccgagttttgggagaacccgcccgcaagcgtgggcgccctctacattggccccctcaaggcgctcatcaacgatcagttcgtccgcctcaacgacctctgcgaagaagccgacatccccgtctggcactggcatggcgacgtttcgcagtcgcacaaggcaaagctcatcaaaaagccgagcggtatcttgcagattacgcccgagtcgctcgaggcgctcttgatccataagcacatggcgattccgcgcatgttctgcgatctgcgctacgtcgtcatcgacgaggtccattcgcttatgcgcggcgatcgaggcgggcagacgctctgccttattgagcgcctgtcgcgcatggccggcgtacaaccccgccgcattggcctttcggctaccatcggcgaccccgagcgcacgggtgcctttctctcgcagggaacgggacgcgactgcgttatccctcgttttgaggaaccgcgccgcgtgtggcgtatctccatggagcacttctacaactcgggtccccaggcgcagcagcggggattcaagagcatgggtcctcaagaggccgaagtgcttgcatgcgagcgcattgaggcagcggcacccgcggcactgcccgtcagcacccaagacatgcgccatagcggacaactcacacaggaggaacgccgccaacgtcgcgagcaggcacggggcaaggctgcccccaaggacagtcgcgcttcctcggcccccgagggcgaagtcgacattccccgagcacccgaacaggcattactcaaccccaccgacacagcaccagacaacgccgaccccggcatgggctatatcttcgaacacacccgcggccgcaagtgcctggtctttgccaactcgcgcgaagaggcggaggccgtatgctccatgctgcgtagctactgcgaaagtcgacacgagcccgaccgtttcctcatccatcacggcaatctttcggcatcgttgcgtgagacggcagaagagcttatgcgcgacgaggaacaggcacagacgaccgttaccacctctacgctggaactcggtatcgatatcggccgtctggagcgtgcgtttcagatcgatgcgccgtttaccgtcagctcctttttgcagcgaatgggccgcacggggcgccgcgatcttccgcccgagatgtggtttgtcatgcgcgaggaagagcccgagccgcgcacgatgatgcccgagaccattccgtggaagctcttgcagggcatcgcgctcgtacaactctatcgcgaggaaaagtgggtcgagccgcccgagctcgatcgactcccctacagcctgctctaccaccagactatgtcgacgcttgccagcaccggagagctcacgccggcagagcttgcccagcgtgtgctcacgcttagctatttccatcgcatctcggccgatgactatcgcgtactgctgcgccacctcatcaagatcgaccatatccaagtcaccgagggcggcggactcatcgtgggcctcgcgggcgagcgcatcattaacaactttaagttctacgctgtgttccaggaaaacgaggagttcaccgttcgcagtgagtcggccgagttgggcacgatcgtcaatccgccaccgcccggtgagcgcatcgccatcgccggacactgctggattgtcgaggaagtggactggaagcgccacaccgtctttgccacgcaggtcaagggccgggtgccggcctactttggcgactgccccggtgatatcaatacacacgtactcgagcgcatgcgcaaggcgctcaacgagcacgcagcatatccgtaccttatgggtaacgcacgggcccgccttgcgcaggctcgtcataccgccgagatttcgggcgcgggaaccaagccgctcattaacctgggcggcgacacctgggtgctcttcccctggttgggaagctacgcctttttggcgctcgagcgcatgctcaagattaaatgtgccgcggagctgggccttcgcggactcgacccgtcacgcccgtactttatgcagtttaagatgaaggccgacgaggagacgttctttgaagtgctcgccgccgaagccgagaaagacttcgaccccatcgacctcgtctatcccggcgaggtgccttactttgaccgctacgacgagtttgttcccgaagagctcgtgcgcaagggctttgccgaaggcgtgctcgacatcgaaggcatgaagcagcgcgttctcggctggcgcgaccacgcctaagaccagtctttttgggacgaggagacttatttgtcgtgaaggacggtgccgaggaagtcggtgtcgaagggcacggcttcggcaaaggcgtagttgccgtcgctggcgatgagcaggtagttttcctcgccgccgaactccgcatcgccacatgggaccacccaggcgtgggcgaatacctcgagtgccgtggcagcgcaatcgcgcaggaacgtcacatcgctcccctcgcttgcgctcacgatattggccacgtagatgccgccggcattcaggctgccccgcactagacgcaacgcctcaacggtcgccagctcgcgtacgggctcggcaccgccaaagcaatcgctcacgaccacgtcgtagcgacgatgacccacactcgtcacacccagatacgagcgagcctcagcagtaatcannnnnnnnnngaccgcttgcgggtgattactgctggcagtaatcacccgcaagcggtcgcccaccgtgcgctccagctcgtccagatagaaccaacggcgcgccaggcgcgtaatctctccgtcatactcgataacgtccatgcgcaagccctcgtgcgacatcagcgcaaacttgggataggcaaacccgccgccacccagcatgagcatacggtcgatgccgtgaccataagcgtcgtgcattgcaccctcggcctcaaacacgtcgtcaaacgcacgatagtacacaaagacgggctcagcccaacgctcgccaacgtaactcgcgctttggtagacgccgccttgcaccaatacgcggacttcgtcgccgccctcgtcgtgcacgcgcttcacacgcgccaacccattgcaggttcgcgcaacctgcagacaggcaacacgaacagcgacagcggccgcaccaagcgccgcggctcccagagcaacgccggcaacgacgccggcagaaacactcggcttgttcatctagagctccttttgcagataaaggccatggtcataaaatccaagatggcgatagtactcgcgcgtaccaatcgcgctgatcacgttgatgcgcgcatagccggcatcccgggcaatctcgcacgcacgctctacgagcaaacgccccaacccgtgatgctgcgccgcctggccctggtcacccacgcgtgccgccatgccatacacgtgcacctcgcgaatcatcgcctcgtccggcgtcgtcggcaactcgtccgcatgcgcggcaacaaaagcgcgaacgggcagcgacaggcgcaaaaagccagcgatcttgccttcgggcgtcacccactgcaaaaagcgttcacgcgtcaccggcgtctcgtaagcgacctcatcaagagacagttcatccaggtcggcacccgcggtactgatctcgcgatagcgaatctcacgcaccgtcgcaccgtcaccccgagcagccaggcggttctcaacgagctgacgcaggttgggcttcttgttgcccaccatgatgtcatcggaactaaaatcgcggatcatgcgactgatacggcagaacgccggcgtcaccacgatgtcgtcggctaacacatcgagcagttcttcctcggtataggggcgccactcgccgcgctcgtagcagcccaccagacgcgagccctcgatgagcgcacacgggtagaccttgacctcgtcgggcataaaggccccctcagtcataaagtgctcgtagtcgcgcttgtccccctcgggtgtggcgcccagcaagttgagcataaaatgcgcatggatcttaaagccaaacaggcgcgcaagcgaaaacgcctgctcgatccgagccaccgaaatgcgacgctcgttgatatcgagcaaatgttggtcgagactctgaatacccatctggatcttggtgcagcccaggcggcggatgagcgtaagcgcctgcggcgttacggcatcggggcgcgtctcgataacgagccccaccacgcgatgcttcgccgtctcgttgatgcgctgctgacgctcaagctcctccatcgttgccgtttgccactcggcaacctcgccccacggcgtaccagggccgtacagccgacgcaccgcgcggttatagccgcccacggcagcatccacacgctcctgctcgtcggcaacgccggcagcaagctcgacctcgtctgtcgcaatgccggcggcccgatagcgctcgcggcgttctgctaccacaggcggcagggcatcggcgggagcgtcatcgagcaggcgccccgcctcggcacggctgatgcccggacgcgccaacatggggttggccgccacgcccgccaccgcatcatcattgagtgcacggaagagctccgacataaaccacgtctgatacccttgcggatagtcgctccaggtaccgccgagcacaatgagctcaatcttatcggtcgcatgccccatctgcgaaagcgccgtcaaacgggcgctcacctgcagatacgggtcaaagcaattttgctccgcacgggcgcatgccggctcggcgtgcagatagctcttgggcatgcgcagatcgttggggcaaaacaggcaatcgcccgagcatggccagggcttggtgatgacggtaatggtcgccacgcccgaggccgttcggcgcggcttcatacgcagcacctgcagcagttgacgctccagatcggaatcgacattccacgcagcccaccgagccggctcctcacgtttaacccgctggtagaacggcagcagacggcgcttggccaaatcgcgtttgtcggcaccctcacggcgcgcctcggcatgtatcagtttgacgagcgctttgtcgtccacggtctcgccgcgacgcagagcctcgagtatgttcaagataatctgttccatgcccccattgtaagggcaaaggcgccgaagccgatctcggcttcggcgccttcatcaaacagcgcgtctatatcttcgcctaggctttcgtctgccccactactccgaatcaaacgacatgtcgcccgaatcgacttcaaaactatacacagcagacttatccccgttatcgaattcaagattcaaaatggtctcgccgtcgtagccaagcggaaggaaatcgctctcgaagtcgccgctgcccaaggtgaggctcgccttaaagcccgtagagttcggaaccgtcatctccacatcgcccgagcccacactcacgtccatcgacttcgcgggggcctggtagagctcgaacgttacatcgcccgacccgacctctgcactaagcgcatcagtcacgctgcccgcaaactctacatctcccgcacccaggaaaaggtcgaaaccatcacaggtgacaccggcaatctgcagatcgcccgagcccacgtgcgcgttgactcccttcagatgttcggcaacacggcgcggcagctcaaccgtaaccgagcggtcaattgccttaccgtcatcacttccaaactgagaaaccttgagcgtcgagtcctcgacggatgcgatgttctgcgtcgcggccttggaggcatccataccattggcaacgtgtccccgctcgataacgcgagccttgttgccatcaacaaccttgacgtccaccgtagccgcagcgatatcgaaatcgaggtagcggaactcatcggcatcaaaagtcgtgctcgaaagctgctgaggccgagcagaatagttaccgctattcaaggaatcgtcctcgtcaaacatatcgtcaaaatcagacaaatggccagatagaataccggtcgtacgcaccatatcggaatgagccaatagccgcgaagtgccaaagacaagcccgatgatgagcacaaacgctccgatgccaacgcccaagcgtaccttggattcatgcgaaagcttcatcattcatcactctctttggcaatcggctcagcggtagtcgcggtagccacgtcagcatcagattccgcagaagtatccttcccctgggccttgaccgccaccgacgccgaaccaacctgaatatccccgcgcgcccaatcgccatcgagcgcacgcgccacccagtgatagatgggaatcgtaaagaagatcagtgcggcaaaggggccggcaccaaacaggaacatcagcaaaaagaacagcagccagcacacggcccaatacgggaacgactggaacgggcccttcaccggagtcgagccaactgcgctgccactcgtcgcctgcgccgtagcggcattggcggcctgcgcactccagcttgccgcttgcgccgccttggcggcggcgtcactcgcctgtgttgccgcctcggtggcacgtgccgccgcctcatgggtacgggcgcgatctgccgcctcggcctcgcgctgacgggcacggtcctcgttctcaaactcgatatcgtcctcaatctcatcgctcggattgagcagctcgtccaagctcacaccatagagcttggcgagcgagatcaggttctcggtatcgggcgagctctccgcgcgctcccatttactgactgcttggcgcgacagtcccagctttcgtgccagcccttcttggctaaaacccttgctgcgacgaaggtcggcgagccgctgcgcagtttctacattcatggttcctcctatgtgatgccagccgtgccgccggaccgtttttcttcttaaggcgccttgcacagttaaaaatctatccgccaccgccaaaagcatgccacctattctagtgagatttttgacaaccgtcggttgcgggtgcatatgagctgcggaaatgtgtccaaacaaagcaatgacccgtagcttggttgtccccgttgcggcgttaacggtagtatggtcgtactgttaattccgcaccgccaacggagggagttccgcgccgtgaaccgcgatttcgcctcatcgctcatccagctcaacaacacgttctatcgcgagcactccgcctccttctccgatacgcgccaggccccgtggcccggctgggtgcgcaccatggacatcgcgctcgaacagctcgatgtcgccacgattgagcatcccgtccgcgtcttcgatctcgcctgcggcaatatgcgattcgagaactttgccgccggcggcgcacttgccgccaagggcgtcgacggcgcaaacccctcggtagatgccagctgcccgtttgagttctatggtgtcgactcgtgtcaggatttggctatcgatgcgcacggtcacgccctgcgcattcccaacctgcacttccaggaactcgacgtgctcgatgcccttatgaagctcaaccccgccgagacacccgacgtgcttttcgacgccccgctcgccgacatctcggtctgctttggttttatgcaccacgtgccgtcgtgcgagtaccgcgtacgcgtgctcgacgccctggtgcgccagacgcgcccgggcggcatcatcgccatcagcttttgggagtttatgaacgacgagcgcatggcgcgcaaggccgttcgcgccgaggcccgtgccgagctcaccccgccgtttgaaggttacgattccgcgcagtttgaagccggcgaccacctcatcggctggcaaaacgaccgccacgcctaccgctattgccatcactttgacgatcagcagatcaccgacctggtgcgcggcgtccgtacgttctacaagagcggcgaggtccccgtgcgcgagcttgagcgcttccatgccgacggtcgcagcggcgagctcaaccgctatgtgattctcaaacgtctgtaggcaccgacgattcgccgccgagccgcaccgcatctttcgggcaaactatgcccaccctttttcaacccattgacggaacgcgcagctatgcgttccatacttatgaccaaggagcctcatgggagccgtccacgttcgcacgcctaagaactttgtgctcgaggagcgcctggagcgctacgccgatgcgatcgagacgaaccccgaggcttatgccggagattggcgcgaggcttgcgcgccagctggcagcaagcccttcgaacaccttcacctggatcttggctgtggcaagggaacctatctggtcgagcgcgcccaccgcgagcccgacaccctctttatcggcatggaccaggagcccatctgcatcgcctatgccgcgcagaaaatctgcgaacaggggctatccaacgcactcgtcctgccccgaggcgccgcatcgctgccacagctgtttgccgcaggcgagctcgatgccatcaccattaactttcccacgccgcagcccaaggccaagtacgctaaaaaacgactcgtccatgtcgaccatctgatgctctaccgcccgctcttttcagccggcgctaccgtcacactgcgcaccgatagcaagccgttgcgcgattacgccctgggacagtttgccgcggccggctacgatacgctttgggtaagcgacgacgtccgccgcgaccatcccgagcatcccgagaccgagtacgagcgccgcacgcgcgagatgggtgccgccgtctatggcatttgcgccacacctggagcgcagcccagcgatgaacagctcgcggcgggccgcgcgcaggagcaaagcctagcctgctacctgcccgataacctcgatgagctcgcctatgtgcctctgggcatggaagaggccgtcgagaactttagaaaccgtgcccgcaagggcaagaagcgtctaccgcaagagtcccaggggcctctgatggtcgcagcttcggcaaacaagcgcaaataggcgccagcaaacgtccctcaaatctaagtgagtagacttttttgcaatagccaagcacaacccgcataaccaatactaaaaccgcaggtagagcccttgcgcaaaagccatgtgctcgcgatattgcaaaaagtctactcacttagctggcaactgcaccaaacggctgggcagaacgcccatttcctgcattttcttgcctgcgaacgcatcgatgcgacgctacgccataatagttggcggacaatcgcgagagaaagcaaacacatggcacagaccacgacagataccgccgtcagcaccgtctccggcgccggggccgccagctcattctcgggcggcacgggaaccgaagccgagttcggctcgctcggcgcgctctcccccacctggtgggagcccgaggacggcagcgagcccgaaccatggctcacgcccgaccaggccttcgaacgcttctttgaatggacgagcgatcgcggcattgagctgtgggatcaccaagaagaggccctcatggacctggcagccggcgatcacgtcattctgggcactccgaccggatcgggtaaatcgctcgtcgcgctgggcatgctctttatgggcatggcgcagggcaagcgctgttattacacggcccccatcaaggctctggtcagtgaaaagtttttcgatctggtacaggtgctcggccgcgataacgtcggtatgatcaccggcgacacgcatatcaacaccaaggcacccgtcatctgctgcacggcagagatccttgccaacgacgcgctgcgcgagggcgaagatgccgatgttggctgcgtcgccatggacgagttccactactttgccgaccccgatcgcggctgggcctggcaggtaccgctgctcaccctgcctcacacgcaattcatgctcatgagcgccacgctcggcgatgtcactgccatcgccgcctcactcgaggaacacaccggcgctacctgcgacttggtcgtcgatgccccgcgccccgtgccgctgagctacgactatgtgacgacctcgctcgaaggcacggtcgagctcgccatgcgccgcggcgaggccccgctctatatcgtgcactttagccaggatgccgcccttgcgacggcacagtcgctcgccaattttggcatcgccagcaaagagcagcgcgaagccatcaaagaagcggcaaaggggacaagcttctcgacggccttcggcaagatcctcaagcgcttgctcggctgcggcgtcggcgtgcaccatgctggcatgttgccgcgctatcgcctgttggtcgagcgcttggcgcagcagggcctgctgcccgtcatctgcggtaccgatacgctcggcgtcggcatcaacgtacccatccacaccgtggtgctcaccgcgctcaccaagttcgacggttacaagatgcgtcgcctgcgcgcccgtgagtttcatcagatcgctggtcgcgccggtcgctcgggcttcgataccgagggcatggtgatcgccgaggcacccgagcacgagatcgagaatgccaagcttatggccaaggcgggcgacgaccccaaaaaactccgcaagattaaaaagaagaaggcccccgagggctttgtcacctggaacaagcagacctttgagcgcctgatcgagacgcagcccgagacgctcaagccgcgcctgcgcatcacgcactccatggtgattagcgtggtcgagcagggcggcgatgcccgagcccgcgtgcacgacctcatcgagacgagtctgcagactcccgaggaaaaggccaagctcgaggttcgcgccgacgaaatcttcgccacgctcatcgattccggcgtcgtcgttcgcaccgaggtgccgcccgcacccgacgccccgactgacgccgcaccagacatcgactatgcactgacggttgatctgcccgaggacttcgcgctcgaccagccgctctcgccgtttttgcttgccgcattggagctgctcgatcccgagagcgagacctataccatggatctaatctcaatggtcgaggcaacgctcgaagatcccaagcaagtgctgcgtgcacaggaacgtgccgcacgcgatcgcgctatggccgagatgaaagccgacggcgtcgaatatgaggaacgcttggagcgcatccaggatgtcacctacgaaaagccgctcgaggatttgctcgatgccgccttcgacaagtactgccaggaagtaccttgggccaacgactaccagctctcgcccaagagcgtcctgcgcgacatgttggagagcgcgagcgactttaagggctatatccaaaagctcggcatcgcccgctccgagggcattctgctgcgctacctagccgaggcctaccgctccctcgatcgcaccgtgcccattgagaagcgcgatgagcgcttgcgcgacatcatttcgtggctcggctttgtggtacgctcggtcgactcgagcctggtggacgagtgggagaacgccggcaacccggcggccctcgacgccgcgccgccgcagggcatcgacgaggtcgttgcggaccgtcgcggctgcacgctgctggtgcgcaacgcactcttccgccgcgtgacccttgccgcccgcgagcacgttcgcgacctgggcgaactcgacgaggactggggcatgagcgaggtccgctggcaaaaggcgctcgatgcctaccatgagcagcacgaggaaatcctcaccgacggagatgcccgcagcgccgcgatgtttaccatcgacgggagcgacgagaagaccgatcacgtgtggcacgtgcaccagatttttgccgacgaggatggcgaccacgactttggcatcatgggcgatgtcgacctggatgccacgcaagacggcggcgaggtcatcttcaaaaactaccgcgtcggctttatcgaggacctgctcgaggactagccgtacatactggaacgaagcggggccgttggcagtatcgccagcggccccgcttttgcactatacgctatcccctactcggcatcctcgacctcatacgaatccgcctcggcgggctcatcgtttgcccctgtcgcagccccgcgcgcctcgtcaaacgccgccttcatggtcttgttgccccaggtgagcttgcgaatggtaagatcgtcggccttcttgttggctagacgtaaattgttctcggaggacagcaatgcctccttggttttctgcagatggctaatcgtcttgtcaatctcctcgatcgccgtctggaacttacggctcgcaagctcatagttgcggccgaagtcgttcttgaacttctccatcttggcctcgaagttcgtgacgtcgatgttctgctgcttgtactccgccagctcctgcttatagcgcagcgaacccatggcggcgttgcgcagcagcgtgatcatgggaatgaagaactgcgggcggatcacgtacatcttctcatagcggtaactcacgtcgactatccctgcgttatagagctcgctttcgggctcgagcagtgtgcagagcaccgcgtactcacagcctttctggcgacgatcgtgatcgagtttcttaaagaagtcctcgtttttgtgcttggtcgcggtctcgtcgttctcgtttttcatctcgaacataatcgaaatgacctcgttaccgcttgcgtcgcactcgcggaagataaagtcgcccttggtaccctcggacgcatcgttatctttctcgaagtacgcgttaggaaatgccgtcatgcgcagacggttaaactcggtctcgcagtgctgctcgagcgactcgcccaccatcttggtggacaggcggaccttcatgtccttaaggcgctcaatctcttcatccttgtagcgaatcaggtcatcgctcgcgcgcttggcctgcgcaagctcgagctcatgtgccgccttggcttgctcctcgcgagaatcgcgcaccgccagctcgctcgtcagcttggcacgtgcctcatcgcgctctcgctccgccgcggcgaccgccttcgatagctccatttttgcagaaagttcttgctcacgaagctgtgcacgaaggccctcggcctcgcgcatggactgagtctttgcggcggaaaacttctcctgtaccttcactcgatagtcagcaagcgcgcgctcggcctcgctgcgagcggcatcgagttcgcgtttcgactcagccgcagcggcggcaagcgccatctcctgggctttatccgccgcggagagctttgcctgcaattcggcaatctgcgcatcgcgtgcggctaaatcgttttgagcagcgttacgcgccgccgactcgacgagcttggcttcgtcatccttgcgtcccagctgcgcgcgcaaattgtcgatctcgcgctgaagcttggcgttctccttttgagcgtcggcacgggcttcaaccgccgcacgctggcttgcactctcgcgctctgcggcagcgccctcgagcttggcgcgcagttcggcaagctcagcatcgcgcttggcgacctcttgtgccagctgttgagccgcagcattcttctgctcgacaagctgagcgttgcgctgagactccgcctcctgcaaagcagccgacgaacgcgagcgctcaagctccagcgcctgctcgccctcacgctggactgccttcacacgctcatccagatcgcgcgaaaactcggcatcgcgcacttgcttgatgatatccgcatagccagacgcgtcgaccttaaaaacttcgccacaatgcgggcacttgatctcattcatagcagctcctcgatggacgcaaatttcaatcgcctacactctaccgcgccgcacggacaaaaaaggcgccgccgccataatggcaacggcgccagaaccacgacaaaggtgcccgccccctttgtcgcggtttgtgcggtggttcgagaattacagtccaaaatagtcgaggatttgatcgcgacttacgggcttgtactcgttggcgtcgaggccgacatcgtagcgaaagatagggcgctcgcgatcgcggttgcgtgcgttggtgcggtcgcccctgctgtggatatgtccatgcagcatgatggcgccgcgcgccttgccattccagctgagcatggggtaatggctcataaccagacgacgccccttggcatagccgggagcaatctccaggtaatcgcgcacgtcttcccaaatctgcggtacgtcgggatcttcccagtcgccgtcatggttaccacggatgagcgtcacattcttgcattcgatacgctcgcgcaggcgcaccgcctctgccaggggcaaacgataggtaaagtcacccaggatgtagagacggtcgtccgccgccacgcactcattgatggcatcgatgaccttgcggttcatctcctcgaccgaatcaaacggccgatccatatcgtgcaagatattcgtatcgcccaggtgcaggtcggcggtaaaccacatcatcgtctgtatcctcatttcgcaacgcgtctaacacgtgctaagtatacagacgcagcgatgcggcggttatccaaagaacccgccgaacagtccgcggcggctcttgtcttgctttttcgaagcgtcaccctgggcattcttatcctgccgcttcttacgatcccgctccaactcattgtcatcgagtagcatatcccactcaaacggatcgtctgccagatcaaacagatcatcgttatcaaacatggcagtctcccttaccgattagcgagcatccaccacgtagagtccaacgcgcacctgatgccacgggctgcgctcgggagcaacctgttgcacgcgggcctcaaatacgtcctcgtgaccgtaatacatcatcaaggacagcgggccgacctcgtttcccggaacatagccgagcttggtcttgccgtaatagatcgcaaccgcctcggggtcatggggattatcgcgctcggcacgcagcgtcagcttatcgcccactttaagatcgcccaagaccaaggcaccgtcggcatactgaaatcccgcgacatgaaacgacagaagcacacgtgaaggctcgtacatggcagctcctctaacggccggataaaccggcgcttaaccgtactgagaagtctacgagcccgtgcggacacaaattcatcctgcccgcgtctttcaatcgcttgccgcaacgcttgcgagacagagcgcttgcagataagataggggtacggatggcacccgttgcagcgggtcttgccaactccgatacacgttttcatcgtgagaagtggccgtcttcgcttacgcgggggcggctatttcattcggccgataaacaggccgagttcgatagccgcgattaacaacgccagtaacgaaataacatcgcttacgttcataccaattcccttctaaagggagttggcccatccgtaccccatagcagtagtataacgtaaatgacaggtaataggaacacttgttcgtattacctgccatttcctaatgcacaaacatgcgcacgaatttgtgcttccagcttgcgtagggcgcataccgaaacggcacgtccaaccaggttgccttgttcacgatgctcttcttgtggctaaacgtatcgaagctctcgcggccatggtactgccccatgccgctcgcgcccatgccaccaaagcccatatggctcgtagccaagtgcataatcgtgtcgttgacacagccgccgccaaagggcacgtagcgcacaaagcgctgctgaaccgcacggtcccggctaaagatatacagggccagcggcgttggacgatccgtaataaacgtctcggcctcgtctaggctctcaaacgtcagcaccggcaagatggggccgaaaatctcctcctgcatcacggcgtcctcaggcgccacgccgtccaaaatcgtcggctcgatcttgagcgaagcctcgcgcgcggcacctccaagcacgaccttatcgggatcgattagcccgcgcacacgcgcgaaatgcttggcgttgacgatatgaccgtagtcctcgttatcgagcggatgctcgccaaacatacggcggacctcctccttgataaggtccagcagctcgtcgtgcacgtgcgcatcgaccagcaggtagtcgggcgccacgcaggtctgccccacgttgagccatttaccaaaggcgatacgccgtgctgcaaccttcaagtttgccgtcgcatccacgatgcaggggctctttccgcccagctcaagcgtcacgggcgtaaggtttttacttgcgcgctccatgacgagcttgccgaccggaacgctaccggtaaagaaaattttgtcccagcattcatcgagcagcgcctcgttctcggcgcgtccgccctcgacaaccgtcaccaggcgcggatcaaatgccttttcacagatttgcttgagcaccgcgctcgatgccggagcataggcgctcggcttgatgaccacggtattgcccgcggcaagggcgccagcgagcggctcgagcgtcagcaaaaacgggtagttccacggagccatgatgagcgtgacgccatagggcacggactgcgtcttgcacacactcacggcgttggcgaggtcacacggacgcagacgcgagcgactccatcgagccacatgcgcaatctgataacgaatctcggaaagcgaggtgccgatctcgcacatatacgcctcgtcatgcgactttcccaaatcggtcttgagcgcatgggcaatatcggcctcgtgggcccgcactgcatcgcgtaaactcacgagcgcacgacgtcgagcatcgacatcaaacgtggcgtgcgtcttaaagtaggcgcgctgatcgccgacgatgcacgcaatttcctcggtgttcatggaccctcctagttctcgccctcaaacataccacctgcaacgacttcatacatacgctcgagctccaagcggtccattaatagcggaacggggtacaggggattggcctcggcatcggcatgcgtcgccatttgcggaatatcggagcggcgaatacccgagacatatttggggattcccagggcctcgttcatgcggtcgacccaatcgataaaggcctcggccgccaggctgtcctgcgcgttagccggcgcgatactggccatgcgggcgagatcggcgagtttaggagcagcggcttcgccataggcacgaagcatgtgcggcaagatgatggcgttggccaagccgtggggaatcccgtaacgcccgcccaggctgtgcgcgatggcatggacgtatccaacataggagcgcgtaaaggcaacacccgccttatacgccgccgaaagcatattgcggcgcgcacgcatgtcatcgccatgctcataggcctcgagcaaattgtcgtggatgagctgcaccgcctggcgcgccatcttgcgcgtatagggcgtggtgctgcgcccgataaaggcctcgacggcatgcgtcagggcgtccatacccgtttgccccgtaatggaggcgggcaggccgcgcgtaaactcggggtcgtgcaccgcatagcgcgggatcagcacaaagtcgttgatggggtacttgtagtgcgtctcgtcgtcggtaattaccgctgcaagcgtgacctcgcttcccgtgcccgccgtggtgggaacggcgatgagcagcggcaggcgacgatggacacgcagcaggccgcgcatcttgttgatgggtttgttgggttgcgcgatgcgcgcacccatgcccttggcacagtccatggcagaaccgccgccaaagccgataatggcctggcaggcgcgcgctcgatacagagacgccgcttcctccacgtttgagaccgtggggttcgctgatgttttggcatagatcgcaacgccgattcccttggacgcgagcgccgtctcgagcggtgccgtgagccccaggcgggcaataccgggatccgtcacgataaggacccgctgtatcgaacgcgcccgaagcactgcgggcacatcctcggcgtgctccagaatgcgtggctcggtatagggcagcaccggcaatgcaatgcgaaaaaccgtttgatacgttcggcaccaggcacgacgggctagatgcataaaggaagctccctcatttgttgatgggtcaacatttgctcgaccgattgtactcatcggcgtccgcatatggcttgccaatcgttaatcaatcaacatcttcacatgcttaaaattgttttattaaaaatcattcctaataggcttcacatttagttgcatttatggataatagaacccgtcaagacgcacgtccggagagggcccttacgggaccggacgagcgcgccatcgccatcgatcgaaaggatcgaatcatgaagtttgtttgccccgtttgcggttatgtggaagagttcgacggcgaccagctgcccgaggattttaagtgcccccagtgcggcgttcccggttctcgcttcctgaagcaggaggagggccagctcgagtgggctgccgagcacgtcgtaggcgtcgccaagatggagggcgtctctgaggacatcgttgccgacctgcgcgccaactttgagggcgagtgctccgaggtcggtatgtacctggccatggctcgcgtcgctcatcgcgagggctatcccgagatcggcctgtactgggagaaggctgcccacgaggaggcagagcatgccgccaagttcgccgagctcctgggcgaggtcgtgaccgactccaccaagaagaacctcgagatgcgcgttgaggccgagaacggcgccaccgccggcaagaccgatcttgccaagcgcgccaaggccgctggtctcgatgccatccacgacaccgtgcacgagatggctcgcgacgaagctcgccacggcaaggctttcgccggcctgctcaagcgttactttggctaagccaaccgcctgagacataacatctagctcgaagaaggcccggaccgtattggttcgggccttttcgttggcttattgcagttgctcctgaagaacactgagcgactgagagctcaggtcgtcgtattgtatgaggacgcgagatggagcgttcttagtcgatgcccgatcacccgtccacaggcaatcggcgatgttgacataggaaatacgagcgtcagcgagagccttcgcgaaactctcccctgccttgtcctcggccagggcaacagtgcagtaaaggcccgcgtctgcatgctcgatcgacacctcccctgtcggaaacgccttgcgcacaattgccgccagaccatcgcgcgcctcacgagcacgaacgcgcacccggttcacatggcgctcgtaatcgcccgattcgagcaagcgggccaacgcgacctgatctacggagctgaccgacgaggcgtaaaaaccaagctcacgcctaaatcgttccatgagctgatcgggcaggaccatatacgccaagcgcagggccgatgacagacttttcgaaaaggtattagtgtagatgaccgattgggcggcatcgatcgatgcgagcgccgggatcggcttgccggccagacgaaactcgcaatcaaagtcgtcctcaatgagatatcgacccggctgctcggcagcccagctcaggagcgcatagcggcgcgcgatacttgtcaccaggccagtcggatattgatgagacggcattaggtgaagaatatccgccccggcatcgagcagctcgcccaagttaacgccctcaccatcaagcggaatatgccgcaccttgcagcccatggcctgatagatgcgcgtcagtcgcaggtagcccgggtcttcgacggcgtacaccttgtccgcgccaagcagctggaccaacatggtatcgagcaactgggcgcccgcaccgatgacgatattgtcgggattgacattcatgcccctcgtcccgcgcaaatgatgagcgatcgcgcgtcgcagccgagcggtgccttgcgcaggtgcgggcgagaagatttcgcgctcatcttcggacgtcaacgtcgcccgcagagcactttgccagagacgtgcggcttccaaggcggaaggagaaagcgcggcgaattgttcaggctgtccataggagtcatgaacgccaaagctcgctggagcagcatctcgatcggcatcctccgcagccgaagccagaaccggggcttcgggaagctcgcacgcgtagtagccacgacgcggctttgagcaaatatagccctcggcaagtaactgactatatgcattctcgatagtaataacgctaattcccagatgactggcaaaggcacgcttggagggcaggtgctctcccgcggcaatgcggccggcgacgatatcgtctcgaatttgctggtaaacatactcatagagcgatgctccgccacgttgttccaaattgtagtcaagcatgagtttgccacctgaccttatcgtgtcattcaatctggtattagtctgaccttgttattatctcgaaaactgagtattccgccatacccagctcccctataggatgttccgtcaagcaatacacatgccaaccaagggagcaaccatggcagaacagaccagcaaggccgatcgcgtcaaactcaaccgcgagctcgcgcagatgctcaagggcggcgtcatcatggacgtcaccacgcccgagcaggcacgcatcgccgaggaggcaggcgcctgcgccgtcatggccctcgagcgtatcccggctgacatccgcgccgccggcggcgtgtcgcgcatgagtgaccccaagatgatcaagggcattcaggaggcagtctccatccccgtcatggccaagtgccgcatcggccacatcgtcgaggcccaagtcctgcaggccatcgagattgactacatcgatgagtccgaggtcctctcccccgctgacgatgtctaccacatcgacaaaacccagtttgacgtgccgtttgtctgcggtgcccgcgacctgggcgaggcgctgcgccgcgttgccgagggcgctacgatgatccgcaccaagggcgagccgggcacgggcgatgtcgtccaggctgtgcgccacatgcgcaagattcagaagcagatccgcgacgttgttgccctgcgcgacgacgagctctttgaggcggccaagcagctgcaggttccggtcgagctggtacgcgaggtccacgccacgggcaagctccccgtcgtgaactttgccgctggcggcgtggcgacccccgccgacgccgcactgatgatgcagctgggtgccgagggcgtttttgtgggctcgggcatctttaagagcggcgaccccgccaagcgcgccgccgccatcgtcaaggccgtcgccaacttcaccgatgccaagctcatcgccgagctttcggaggacctgggtgaggccatggtcggcatcaacgccgacgaaatcgaaatcatcatggaggagcgcgggcgctagtccggcagaaaggatcgcacatgagcgattacgcagaccagacggtcgccgtgctggcggtccaaggcgcttttgccgagcacgaggcaaggctgtccgagctaggcgcacattgtattgagctgaggcaggcagccgatttgaagcagaactttgatcgcctggtacttcccggcggcgagtctaccgttcaaggcaagctgcttgatgagttgggcatgctcgacgagcttcgcgcccgcattattgagggcatgcccgtaatgggcacctgtgccggcctgattctactggctcacgacctcgccacccatgatgacaagggcacgcctcgcctggcaaccatggatgtgctggtcgagcgcaatgcctacggccgacagctcggcagctttcggaccaaggggcaggtagccggcatcgacggtaaactgccgctgacgtttatccgcgcgccccgcatcgtcgaggtccacggtgacgccaaggccttagccgaagtcgacgggcaaatcgtcgccgcccgtcagggcaaccagctcggcgtaaccttccaccccgaactcgacgaggacacccgtctccacgaactattcctgcaaatgtaggcagataaaacgagcgtggattttcggacacttacaaattgagagtggataatctcccactttgagccaacattcaggccaaaaccgggagattatccactctcattctgactagtcattggagacgttctttaacgactagtcaaacaagaacgtccccaacgactacattgcgatagacgaccacgtttgcccagataaaaccgaccaaaataaacctgtccctttttggcaggtttggatcaaggcaacgccgatgttttggtaccgacagacactatgacccaatccgagggcactaaaaagataggagcccccgctcgtgtcctcgccccgattctacagcgcgccccggtgtagctgtgcgggaggtgccccgtcgcccacttcttggccgcgcccaccgagacccccgcgaacttcgcggcggcggtcggccccatgccgtcctccgtcgccaggaggaagagctcgaccttctccctgctgtacatgcgaacctccagtccggaccgcttcacggtccaactttctgtccgcaccccccctgggcgcccgtatggcatttttaggaactatttcaccgcaactcaaaaggccgcagtcgggagttccggctgcggccctattgcacatgttaggttgacctacttgctagaccagcttgaagcccttgcgcttgcctacggagagggtgtcgcccagtttgagggcgctggggtcgatgttgtagctcttgggagccacggccttgccgttgatcttgacgccaccgccgtcgatatcgcgacgagcctggccggcgctcgccgaaaggcccaagttcttgagcaggccggcgaggtagatctggccctcgtcgttgacggtcagctcgacatgcttctcggggaagtcggcaagctggccctccttgaacacgcggtcgaactcggcctgagcctcgtctccggcgccggcgccgtggtaggtgtcgcacaggtcgcggcccagagcgcgcttgagctcgtaggggtcggcagaaccatcggccagggcggcgtcgatcttgtcgacctcggccggggtgagcgagctggccagacgatagtacttgccgatcatctcgtcggggatggacatggtcttgccgaacatatccttgggagcgtcggtcaggccgatgtagttgccataggacttggacatcttgcgcacgccatcggtgccctcgagcagcggcatggtgagcgcgatctgcggctccatgcccatcttctccatgagctcacggccagcgagcaggttgaagagctgatcggtgccgcccatctcgacgtcggccttgatctgcacggagtcgaaagcctgcatcacgggatacaggaactcatgcagggcgatcggcgtctgagactggtagcgcttggtaaagtcgtcgcgctcgaggatgcgggcgacggtgaacttggagcacacctgcagcagaccggccagatccatcgaaaggatccagtcaccgttgtgcacgatggtggtcttctcgggatccaggatcttcatggcctggctcacgtaggtctcggcattggcctcgatctgctcctgcgaaagctgcggacgggtggaattcttgcccgaagggtcgccaatcaacgcggtaccgttgccgatgatgagggtgacgttgtggcccaggtcctggaactgacgcatcttgcgcagcggcacggcgtggcccaggtgcaggtcggggctggtggggtcgacgccgagcttgatgttgaggggctcgcccttctcaagcttcttgcgaaggtcggcctcgggaacgatctgcgcggcgcccgaggtgatgatacgcatttgctcgtcaacagacagcattgggtatcctccttttgctatagcaccctcgccgaaaacggcggtgctggaagtccataaactctcttatgataacaaactgacgcgacgcagcacctacgacaggaaaatcctcgtcctgccgcatgcgtcaatggcaactggcagacgtgtaccgtcacgctcgaccagatagcgtacctgccgacgacgcaagcagtcgcggcaacgaacctgtcccgtcgcatcggtggcgcagacgccctcggcggtcagcaggcagtgctcgcacaccataagctcgggacggtcggcgtcgaccggacccaagacgccgggttcagcggccagttcggcaatacgctccgcatcattgccgagcaactccgccggcaagcacacccgccccgcaccgagtccgcgcagccaggtaagcgtggcccgattcgcgcagaacaccggcgccgccacgtcaaacgtcacgcccagctcgcgagcgatcaccacctgtcccaggttgcggcagacgacgcgcccggcacgctgtatcagtgagcgggtccagtcagcgtcacccgtgcggcacacctcgtcaagcaccacaacggcgtcggacaaatcaagttctccgcgcgggtcggcatccatcagctgccaagcaaaaaccatgcgagtgggaaccgcgcactccaccaactccgtggacgcaccgccatccaccgcaacgtcctcaaagggcagcacctcaacggcacgcgcaacgggcgcaatcgcatccgcctcggcccgcatgcgctccaacaccgccgccgtctgatccaacacgccggcgctgcgaatcaggtacacctcgcagcccgtgtcaaccttacgcttgcaatgcacgacgacgcgctcccccgctgcggcatccaccggacagggcacctgcggccagcgcttgggcacatcgggacgcgcgtcggcacccggataaaaccggatctcgagcgtgtcacccgccgccacggcggcgtcgagctcaacggtcacctcttcgtggcccacagcgaccaagcgccccacgcgcacgccctggttaatcgcacgctcaaagctcatcagctcggcacccgaacgccctcgcaggtacgcatcggtaaacccacggttaaacgaccttcccagctcgcgctcaagctcttccacggcaccggggtcccacgcgccgtcgtacagcatatcgagtgcccggcgccacacccgcaccacgttgaatacgtaatcggggttcttcatgcgcccctcgatcttgagcgacgccacgccggcatctacaagctcgggcagatgtgcaatacccagatagtcgcgcgggcacagcaggcgatctccctcgacggcgacaacgctctgccccgcctcgtccaccaggtcgtacgccagacggcacggctgcgtgcagtcgccgcgcatcgccgagcgcccacgccgcagggccgagaactcgcacgcccccgaatagccgatgcaaatcgcaccgtggcagaatacctcgatgggcacgcccgtggcacatagcgccgcaatctcgtcgaccgtcagctcgcgtgccgtcgtcacgcgctcgacccccagctcatcggcggcaagtcgcacggcgccttcgctatgaacgcccgcctgcgtggacaggtgaatctcgaccccgggaatcgccgcgcgcagcgcgcaggccagcccggcatcggcgacaatcagagcatcggcgcccagctccagtgcatgagctcccaacgccaccgcgtcggacaactcatcgtcaaacacgaacacgttgagcgtcacgtacacacgcacgccatgggcatgcgccacggcgcagccgcgcgcaaactcgtcgtcggtaaaaccgtgcgcactcacacgggcgttaaagccgcccaaccccgcatagatggcatcggcgcccgcggcgatggccgcaaacatctggtcgagcccgcccgccggcgccagcagctcgggcagcgccgcaccggcagcatccaatccagtcttgtgttgtccgctcggccccatcgcccgaatcgccatcggcaaactccttaccaaggtatgcattcactctgaaaaatgccgtcttccagcatacacgaggcctcgcgcgccccgtttggtttatcgtgtaataacttatgtccatcctgccccgacggcacatccgccgtccggcacgacatacctggaggtcaatatatgggtcctcgccaacgacagggacgcagccgttcaaagacgcatgccctgcccataatcctgctctcgtttttgggctttttgctgattgcgggcgtggcatttggcatcggcatggtcggcaacgtcaaccgctggctgtccgatctgcccgactacaccgacgccaacgcgtatctggtgagcgagcccaccgagatcgtcgactgcaacggcaacaagatcgcgagcttctacacgcaaaaccgcaagtccatcaccaaggacaaggtctccccctacgtgctacagggcaccgttgacgtcgaggacgagcgcttctacgagcacggcggtatcgacctgtggggtatcgcgcgtgctgcggtggcaaccctcggcggcgggcacgaaggcgcctcgactatcacccagcagctggtgcgcaacaccatcctgcaggaggagcagttcgactcgaccatcgagcgtaaggtgcgcgaggcctacatcgccgtaaagatggaggacatgtactccaaagacgagatcctcatgatgtacctcaacaccatctattacggtcacggcgcctacggtattgaggccgccgccgagacctacctgtccaagagcgccgcagacctcaccctgagcgaggccgcgctgttgatcggccttcccaactcgccctcgcagtacgaccccacggtcaaccccgacctggcgctgtcccgtcgcaacaaggtcctcgacaacatgctgcgcctgggccacattacgcaggaggagcacgatgccgcacaggccgagcccatcaccctcaacgtgaccgaaatctcgggcagcggcgttgacgtatactcgcagccctactttgtcgcctatgttaagcagctgctggagcaggagttctcgaccgacgtgctctttaagggcggcctgaccgtcaagaccaccatcgaccccacgatgcagcaggtggcagagaatgccgttcgcgagcagctcgacacgctctcgctcgacggcctggacatgggcatggtcgtcgtcgaccccaagaccggctacatcaagtgcatggtgggcggctacgattacaacgccgacgagaaccacgtaaaccatgccacggccaagcgtcccgtcggctccacctttaaggcctttacgctggcaactgccatccaaaacggcatgaaccccaacgtcaccctcaactgcaactcgccgctcaaggccaagggcaccacgaccgaggtccaaaactacgccaaccatagctatggcaacatcacgcttaagcaggcgacggcatactcctccaacaccggctacatccaggtggcggaagccgtcggcaacagcaagatcatctcgctcgtcaaaaagctcggcatcgatcccgccaaggacaacatcgaggacgttcccgtcatgaccctcggcaccggctcgatctcgccgctcgagatggccgccgcctacgcgacgtttgccaacggcggctactatcgccagccgatcgccatcaccgagattgactctcgtaccggttcggtgctgtaccagcacaccgacaatccctcacaggtacttaccgagggcgaggccgccgcggtcaccgatgttctgtccggcgtcatgaagggcggcggtacgggtgctgccggcgccctgagcgtcaaccagccctatgccggcaagacgggcaccaccgacaacaccaccaacctgtggttctgcggctataccccgcagctggcgtgcgccctgtggaccggctattccgcgggcgagattcccatccaaaaatacggcacagacctgctgggcgacagcaccaacctgcctgtctttaagcggtttatgaacaccgttctgaccggtaccgagcgcgaggagtttgcgaccggaacggcgcccacctacaagaacaacagcgtctggaagttctacggcaccaacaacaccaagaagacggagaacgacgacaaggacgagaacgaggacgaagaggaaaccaccacaacgactaccacgacgaccacgaccaccgagaccacgggcggcgacaccaccggcggcaccggtacgaccggtggctcgacgggcggctccactggtggttcgaccggcggcgatggcggcacgcctacgcctacgcctacgcctacacccactcccgacccctcgcccacgcctgacgatacggttggctagaaattcatccggccattagcaacaaggcccccgagcagcttattaaagtgctcgggggccttttagtttaaagcgacctggtggacggcctttataccggcaaacaatatagggggtaccgaccaacgtcgatacccccttacaagctaccatgtcacgcacacagtgccgagcgcacgacccgcacgcctacttgcgagaattgctcagcttattgatcagcgcctcgagacgctcgccgtcctcggccgtctgggcaataaccaaaatcgtatcgttgccggcaagcgagccaagcacatcgggcaactctgccgcatcaacggcggcggcgatgccggaagccgtaccaggctgagccttgatcataaccagattatcggtgcgcagaacgcccgttacgagctcggaaaccatacgctgcaggtgcaggtcctctgccagaacatagataccctcggggagcttacgcagccccatatcggcaatatcgcgagagacagtcgcctgcgtgcaatcaaagcccatagcgcggagctcatcgaccagcacgcgctgcgtgcggacgtccttattgcgcacaatatctctaatggcatcctggcgcccattgcgttttttagccatacaaaccctctctccaaaagatggcggagacaatcaatcagtgactgaatagtttaacgctatttgaaggcttttgtgtataagaacgcatttcgaaacaattctatgcaaatttgtttcgaaatgagccgtttaggcggtttttgcgcccgtccggttaagaaaagctgccagatgcgtacacatcacgcagcgcgcgggcttggcgctggcgatcggcccaaacaacaaaccgagtccccgatggttatccttgagcgcggcgaccatctgacgggttcgaggcgcctcgagcatatcacgcatgcgggcggaacgctcgattgacgacactccatgcgggctaagacacaaattctcgatgcaggcgaccagtccggcaaagtagaacttttggcttgccagcttgagccgaccaccgctatctgcttccgagagtgagtccgcaagctcgtcgagcgctcgagtgtcatcggatatcctggcatacatggtgggatcaaaggcatctgtaagcttaggtgccaccgcgtggaaacaagcgtcgccgcagccggacacgaatcgtgcctgcgagagcgcataagccataaactcaaccgtacggtacgccttgccgcgcgacaggcatgcctcaaacagcggacggctatacatcacgccagaggtctgagcgactaggccgcccaaaatcaactggggcagcccagtcaccatagaagactcgtcttctatggcaatagaggcagcatccaagacgcgcgaatggcgttctcgatgtgcatcatagcggtcgagcgacaccgtggggaacactatgtctgccgcagtatcgcacgcgatatcgaccatcttggaaagggactgcggagcaaaccactcatcggcgttcatagcgatgatttgagagccgcgcgagacagcaaaaccggcacgaaggcaagcgccgcgcttcgcgtcctcgacgtcaatcaaatcaatatggatgtccctgtcggcagcaacttgaagcgaatggcgcacaccgggcgcagcatcgcggcaaacaacgacaatctgcaaatcgtagaggtcttggttctggatactctcgagcgcacgcatcgcatagctgggcgaaccttctaccacaaggatcaccgaaagtcgcggatgcgagccacgtcgaaccaagttatccgtcctctcgacagcaatgaatcaaaccgtggttcatggtacaccccggcaataaaagcaatgagacaccggttgtattgcacgccaagaacagatgttgcacacgcgcagcccacagataatgggtgtcgacgcacgacgcgtcgagccctcccctagtcgagcacgacgagctcggcgggatcgtaatccacgcccataaacgtaaggccgcaggcaggagccgtggggcccgcagcggtacggtcgcaagcatcgatgacctcgcgcatccactcgggttcacggcgatgcatgccaatcgcgacaagcgtgccaacgatcgtacggaccatcgaatgcagaaacgcattgccctcgatggtaaacgtcaggatgtcctcgccaaacgcaacctcatggccaaactcggcgcgcattacgcagcggtgcgtaggtttgcccacggcagaagcaaccttgcaaaagcttttaaagtcctgctcgcccagcagcgcggggcaggcagcagacatagcctcaacatccaagggatagcgatgccaccacaccgcaccgcgggacagcacggggcgcgcatcccgatcggcaatacggtacgtatacgtacgggaacgcgcgtcaaaacgtgcagaaaagcctttacgggccttgtagacctcgttgatggcgatatctttgggcagcagggcatccatagcccgcagccacctacggcgcgttagggcgagctcagcgtccgttacgggcacgctgatgtactgagccacggcatgcacgccggcatcggtgcgacccgcgcacgtcagatcgatcggacggcgaagcagcgtctcgatggctcgacgcagctcacccgcaaccgtcgtctgtcccggctgctcggcaaagccgctataggacgagccatcgtatgccacgcggaaaacgagcgtggcatcgagctctggaatcgaattgaaatcagacggcgcggtcatgggcgctcccaacaaacaggcaatggcatttcgacaaaaaaagaggggtacgcgaacgtacccctcgaatatagcctatgcagacggattgtctactcagcggtctcctcagcaggagcctcctcggcagcctcgaccttcttgggagcagcggccttcttgggggccggagcagccttcttggccttaggcgtgcaaggctcggtgacgagctccatgataacgatgggagcgttgtcgcccttgcggttaccgagcttcatgatgcgggtataaccgccgttgcgatcctgccacataccctgggcagccttgtcgaagatctcggcaacgagctgcttatcgccgagcttggcgatagccagacgacgagagtgcaggtcgcccttcttggcccaagtgatgatcggatcgacgaccgaacgcagcgccttagcgcgggtctcggtggtcttgatgcggtcgttctcgaagagggccttagcaaggctcttcttcatggccttggtgtggctcgcatcggtgccgagcttcaggcccttcttaacgttgtgacgcatggtctagtttctcctcaaatatgcgaagcattaagccttcaggctcaggcccatggactcaagcttgtccttcacttcctcgatcgacttaacaccgaagttacggatgttgagcagatcgttctccgagaactcaacgagctgacggaccgagtgaatgctggcgcgcttaaggcagttgtaggaacggacggaaaggtccagatcctcgatctgcttgtccagctcggcgttgtcgttggtgacctcgggagcgaaaatcgaagcctcctcctcgacctcgggggtctcggcaaggttcataaaggcggccatatgctggttgatgatattggcagcctggaccacggcgtcgcgcggggcgatggagccgttggtctcgatctcgaggacaaggcggtcgtagtcggtgtgctgaccgacacggcaagcctcaacgagcttggcgcaacgggaaaccggcgagtacagcgagtcgacgtggatcacaccgatgggatcgttgtcgcgcttgttggcctcgccagaaacatagccgcggccatagccgatgcgcatgctcatggtgagatggccaccctcggtgagcgtagcaatgtgctgctcggggttgaccagctcaaactcggacggaataaagaagtccgcaccggtgacctcgcaggggccgtcaaccgagatggtggcggtcgcctcgtcggtcgtgccgagagccctgaagacaagccccttgacattcaggacgatgtcggtgacatcctcgaccatgttagggatggtcatgaactcgtgctgcgcaccatcgatctgaatagcctcgacggcggcaccctcgagcgaggacagaagaacgcgacgaagggagttacccagcgtatcgccgtaaccacgctcgagcggctcgacggagacacgagcagacgtctcgttgatctcttcgacctgaacctgaggcctaatgaattctgacatgtattacctccagcctcagcagcccggatggactacttagagtagagctcgacgatgagctgctcgttgatatcaccgctgatctgctcacgcgtcggcagagcgagcacgttaccagacagcttctcgatatcgacctcgagccagccagggacctcaaagcgctcggaggaaatcagggcctccttgatggggaggaggtcacggaacttctcgccgacagcgacgacgtcaccggccttgacgcggtaggacgggatgtccacgcgcttgccgttcacggtgaagtgaccgtgacggacggactgacgagcctctttgcgggtgcgggcgaagccaagacggaagacgacgttgtcgaggcgagactcaaggatgatcatgaggttctcaccggtgacgccgttcatcttgcgggccttgttgaagtagccgtggaactgcttctccagaacgccatagatgaacttgaccttctgcttctcgcgcagctgcatgccgtactcagattccttgcgacggcgcttgggctgacggatagattccttcttgctgctgtaaccgagctcagcgggatcgatcccgagctgacggcagcgcttaagaacaggagtcctgtcgattgccatattgatacgatcctttcagttacacgcggcgacgcttcttggggcggcagccgttgtgcggaatgggggtcttgtcctggatgctcgagacctcgaggccagcagcctggagggagcggatggcggtctcacgaccggagccggggcccttgacgaagacggaaaccttcttcataccgtgctccatggcctgcttggcagcagcctcggcagccatctgggcagcgaacggcgtggacttacgggagcccttgaagcccacctggccagccgacttccaggaaatgacgttgccctggggatcggtgatcgaaacgatcgtgttgttgaacgtagaacgaatgtgagcctggcccacggaaatgttcttacggtccgcgcgcttcagacgggcagcgcgaacgttcttcttagcagtagccatctatctagcgctccttatttcttcttcttagcaccgatctgacgcttcgggcccttgcgggtacgagcgttagtgtgggtgcgctggccgcggaccgggaggcccttgcggtgacgaaggccgcggttgcagccgatgtccataaggcgcttgacgttctggttgcgctcacggcggaggtcgccctcaaccatgatctggttcttatcgatataatcgcggatggcgttaacctcatcctcggtgaggtccttaacgcgcgtatccacgttaacgttgcactcgacgcaaatcttcgtcgcagtggtgcggccgatgccgtaaatgtaggtcagaccgatctcaacgcgcttctcacgcgggaggtcgacaccattaatacgggccaacgtagtctcctctcttaaccctgacgctgcttatgacgggggttctcgcaaatgacgaggaccttgccatggcgcctaatgattttgcacttatcgcacatcttcttgaccgaaggacgtaccttcatcgttcttcctttcggtagcgctcaaactacttccctactatctactcgcccagccgcaggcgtttaaaactatggctggtcttcacacacaatccgaccgtaggttgagctaagcctgcagtcggaaatggagtgcgtgtatgcgtgccgctatttgtagcgataggtgatgcggccgcgggtcaggtcgtacggggaaagctccacgacaaccctgtcaccggggagaatacggatgtaattcattcggatcttgccagaaatgttgcacagaaccgaatgaccgttctcgagctcgaccttaaacatggcattgggcagcggttcctttaccgtaccctcgagctcaattgcgtcttccttcttcacaagcaatcatctttctctagaaaacgacagcgattgagtattctacaacacgtatgcacgcatcgtaataacttcgtaatggctccacaactaagtggaacttgttacatttctccgccttggagggagcaccaagcaccttgggcatccgtggtgagaatcaccggaccatcattggtaatggcgacggtgttctcgtagtgcgcggcgggcaggtgatcgttggtcgtaacaatccaaccgtcggagcccgtgctcacatggttggaacccatcgtaaccatcggctcgatggcaataaccatgccggcctggaggcgaacgcccctccccttctttccatagttaggaacgttggggtcctcgtgcatcacgcggccaatgccatggcctacataatcacgaagcacaccgtaaccgtgagactcggcgagggactgaacggcataaccgacgtccccgatatggttaccgggaacagcctgctcgatggcagccttaaggcaatcgcgcgtgacctcgcacaaagccttggcttcgggcgtgggggtgccgacgaaaaacgtccaagcgttatcgccgacccaaccgtcgacaacggctcccgtatcgatggagatgatatcgccatcgcgcaggatcatgtcggggttgggaataccgtggaccacggcatcgttgatcgatgcgcaaatggtccccgggaacccgccgtaacccttaaaggccggggtgccgccatgcatgcggataatctgctccgcgagctgatcgagctcaaaggtggaaacgccggggcgcaccatggctccaacgtggcggagcgccatcttagatagcgctcctgccttcttcatctgctcgatttgcgttgcagacttaatcttgatcatagaccgagagcctctttgacatccccgtacacggtctcgcgagcctggtcaccgttgaccgacttgagcagaccctggccacgatagtagtcgacgagcgggctcgtggacttctcgtagacgtcgagacggttcttgatggtctcgggcttgtcgtcgtcgcgctgatacatctcgccgccacacttggggcaggtagcatcggcagcggtgccggtgtaaccgcatgcgcggcaggtgcgacgcgaagacagacgatcgataatgacctcgggggccacatcgaccagaagggcgcagtcgatctcgcgacccatggcggagagctcggaatcgagcgtcacagcctgggcggtgttgcgcgggaagccgtcgaggatgaagccctgctgggcgtcatcggcggcaaggcgctccttgacaaggtcgatcacgagctggtcgggaacgagctcgccagcgtccatgtacttcttagcctgaataccaagctcggtgccacccttgacggcagcacgcagcaggtcgcccgtggaaatgtgggcgacgccaaactcggcgacgagctcctgtgcgacggtgcccttaccggcacccggagctccgagcaatacgaggttcatgagcaatcctcctctagcctatttaaagaatccatcgtaatcatacatcttgatctggccttcgagcttatcgaccgtgtcgagcacgacgccgaccatgatgaggatggacgtgccgccaaatgcctggatcagatggttacccgtgaaggagaagatgatcgaaggcacgatggcgatgagcgccaaaaagacagcgctgggaagcgtgatcttgttgagcgcgttcttgatgtaggccgcggtagccctacccggacgcacgcccggaataaagccgccctgcttcttaaggttatcggccgtgtcatcggggttgaacaccatggaggtgtagaagtacgcgaagaacacgatgaggacaacgttaagcacccagttgagccaaccggtcgaaagcgcggaggcaactgcctgaatccagccgatgccggggaagaacacggcaatctgagccgggaagtacagcagcgccgaagcgaagatgatcggcacgacacccgcggtgttgaccttgatgggcaggtaggtggtctggccacccatcatgcgacggcccacgacgcgcttagcgtaggagaccgggatgcggcgctggccgcgctcaaggaaaacaatcagcgggataaccagcaggatgatggcgcagatgatcaccatggtgatgatgccaccggcattgccctcggtgctggagaagatagcctgcggcagaccggccatgatgttcgcgaagatgatcagcgacatgccattgccgataccgcgctgggtgatgagctcaccaatccacatgatcagcatggcgcccgcagtgagcgtaccgacgatcatgaggtcgaagatgatctcgggagcgccggcgccattgaagctgatgccgaagctcttaaagaggaagaggtaacccacggagttgaggattgccagagccagggtgaggtaacgcgaatactgcgtaatcttggtctgaccgacctcgccctcgcgggcaagctcatgcagggaaggcacgacggcctggagcatctggaggatgatcgagctggtgatgtaaggcatgatgcccagcgaaaacaccgacacatagctcaacgcgccgccagagaaaagattcaggagggccatagcacctgcggcgaccgaattgttatcggtcgagaaaaggcccagcatcccctggaagggaatgccgggcacaggaacgtgcgcaccaatgcggtacacgacgagcatagctatggtaaaaagaatcttttcgcgcaattctttgatgcggaaagcattcttaagaccatttagcacggcagctcgacctttccgccggcggcctcgatcttggcctgcgcagaagcgctgaccttgtcgaccttgaccgtgaacttcttggtgagctcaccattgccgagcaccttgacgggctcgaactcgctcttggtgatgcgagcggccttaagagcggcaccgtcgatcacagcgccgtcctcgaacttacgctcgagacgctcaacgttaacggcggtgtactcgatacgacgggggttgcggaagcccggaagcttgggcaggcgcatagccagcggagtctggccaccctcgaagccggcacccttggtgccgccagagcgggaaccctggcccttctggccgcggccagaagtggtgccgtgacccgaagaattgccacggccgacgcgcttgcggttcttggtggaaccgggcgcgggagtaagatcgtgaagctgcatttgctactcctctacaatctcgacaaggtgcttgaccttgaagatcatgccgcggacggactcgttgtcagcaatctcgcgaacctcgcggatcctgtggagaccgagggcacggacagtacggacctggtcctgcttgcaaccgttggtgctgcggacctgcttgatcttgatggtgtcagccatgcttagttctccttaccgacgaacatctcggagaccgtcaggccacggcgagccgcgacgtcctcagggctggagagctccttgaggccctcgacggcagccttgatgatgttgaggccgttgtcggtaccgagggacttggacaggacgttcttgatgccagcaagctcaaagaggggacgcacagcgccgccggcgataacgccggtaccctcgacagcgggcttgatgatgatgcggccggcaccaaagtggccgagaacctcgtgcgggatggtgccctgctcggtcaccggcacgtggaacatgttcttcttggcatcgagagatgccttggagatggccatgggcacctcagcggacttgcccatgccaacgccgacgttgcccttgccgtcgccaacgacgacgagagcgacgaggctcatgcgacgaccacccttgacggtcttcgacacgcggttgatgtaaacgacgcgctcctcgaactcggaggcctcgcgctgctgcttctgattacgagccatgtgctacatacctcctagaactcgagaccggcggcacgagcaccgtcggcgagggccttgacgcggccatggtagatacggccaccgcgatcgaaggcgaccttggtgatgccggcctcgatggcgcgcttgccaacgagctgaccgaccttctccgcagcctccttgttcgaggtgtgggtgcccttgaactcggcctcgagggtcgaggcagagacgagcgtcaggctggagcccttgctgtcgtcgatgatctgggcatagatgttggcgttagtacgggtcacgcgaagacgcggacgctcggaggtacccgagaccttgccgcgaacacgacgctgacgacgcttgaggccttccagcttcgccttatgcttgttcatacgtaaactcctaaaaaggttgatcttgccagcacctgacggggtgctggtcttatgcgagtgagtcggttacgactacttggcggccttacccagcttgcggcggatgtgctcgccaacgtagtggatacccttgcccttgtaaggctcgggaggacgatggccgcggatctcagcggcgatctgaccgacctgctgcttgttaatacccttgacgttcacgtgggtgttgtcgggaacctcgaaggtgatgccctcgggagcctcgacgatcacggggtgcgagaagcccagggagaactcgaggttcttgcccttctgctgcacgcggtaaccgacgccggcgagctcgagcttcttctcgaagccctcggaaacgccaacaaccatgttgtggatgagggcgcgggtgaggccgtggcgggcacgggtctcacgctcgtcgtcgggacgggaaacggtgaggacgttgtcctcgacgttgatagcgagcttctcaaagacatcgagctcgagctggcccttggggcccttgacgacaacgttgttgccgttgactgccacttcgactccggcgggaatctggacaggcttattaccgatacgagacacggtgatctcctttccttctacctaccgagcgaattaccagacgtaagcgatgatctcgccgccgacgttgtgcttgcgagcatcgcggtcggtcatgacgccatggctggtggaaataatggcggtaccaaggccaccgcggacgcggggcatgtcagcaacgccggtgtacttacgcaggcccggcttggaaatgcggcggatgccgttgatgaccttagccttcttgggaccatacttaagcgtgatgtgcagagtcttctggggaacggtgtcctcgacatcgtagccctcgatgtagccctcctcgtgcagaacacgagcgatctcgacgagcttcttgctgctcggcatggagaccgtggccttgttcacagagttagcgttacggatgcgcgtaagcatatctgcgatcgggtctgtaaggttcatacagattctccttcgttcttgatgaacacgtgctcttggttcttcgccgcccttaacggcaaagcctttttagcgcgttttccctgttccaaactgatgcttgaaacgctggtagtgacttaccagctggccttcttaacgccgggaagctcgcccttgagtgcaagctcgcggaagcagacacggcacaggccgaacttgcggtacacagagtgcggacggccgcagcgctggcagcgcgtgtactcacgagtagagaacttctgcttgcgattgcacttgacgatcatcgatgtcttagccacttatatcctcctcacatagagtattgttcgccccaagcgccgcccccttgtgggaacggcgcttatagggcaggtgaacctatttcttgaacgggaaaccgaaggcgtccagaagggccttggcctcctcatcggtgttggcggtggtcacgaaagtgatgtccataccgcgctggtgatcgacggagtcgaagtcgatctcggggaagatgagctgctcggtgacgcccatggagaagttaccacggccgtcgaagctcttggcggagatgccgcggaagtcgcggatacgggggatcgcgacggaggtcagacgatcgaagaactcccacatacggtcgccacgcagggtaaccttgcagccgatcggcataccagcgcgcaggcggaaggtagcgatggacttgcgggcacgggtgatcatcggctgctggccggtgatggcgcgcaggtcgcgcacggcaccgtcgatggccttggaatcggtagcggcctcgccgacacccatgttcacgacgatcttctcaaacttggggatcatcatgacgttctcgtactggaacttgtcctgaagctgctgcttgacctcgttgttgtacttggtcttcagacgcggcacatacttctcttctgccattgttcactccttcttggggttttaagcacggggcgtggccacgatgggttgtcctcgtgcctcctggctgcatccgcgccgctcatggcattttgcggtttggactcgacgcagcaggagccgacaaaacaatcggtactatacgcgcatcgggagcgtatttccagaaaaacctcgtctgcctgcacaactccacaactcccccgcacaaatggatcccaaaaagcagttgcggtgaaatagggactgtttggcggcctaacaggcttaaacagtccgtatttcaccgcaacttattggtggggatccgattagcgcttgcgggggacgagtttggtgcggcgcaggtggatcatctcggcggcgatggagatggcgatctccttggggtcctcggcctcgatggcaacgccgatcggaaggtgcagctcgtcgatctggtcctgcgtaaaaccttcctgctccaggcgggcacgcacaaaggccgtcttgcggcgcgaacccagacagcccagataggcaggcttggcacgcatggcctgaatcaccacgtcgatatcggacttgtgacccgccgtggcgacgaccaccaagtcgcgcggaccgatgggacacagctcgctcaggttcttgtaatcgaccaggcgacgatcgtagacaccgggcacccattcgggcgtcaacgtgccggggcggtcatcgcaggccacgacggcaaagcccgccgccgtgagcacgcgcgccgtcgcggcgcccacgtgtccgcagccaaagatgtaggtcaggccctcggggcagagcgtctcgatgtgcgccgcgggaatctcggaggcagcgttggtgtaggtgacgttactcccctcctccaccagtgaaagcccggggcagcccgcaatggtatggcgcgatgcctcgccatggtactcggccacatcgccctcgagcgcgctcgcgataaacggctcaaagtcgatgacgaagtcgccgatgcgccgatagaccaagacgtcggcaatttcctggaacaacggtgcctgggtcgcatccagatgcagatagcacaggcaaatggctccgccgcagatcatgccggtatcggagttctcgccgcccatggtgtagcggaccagacgcgactgtcccgcgctcaggagttcgcgcgcctcatccagcgcaaagagctcaatcttgccgccgccgatagtgcccgcctggctgccgtcggcaaagacggccatccaggcgcccacgccgcgcggcgacgaccccgccgtgccggccacgaccacgagctcgcacgtctcgccagcacgcagggcggcaagcgccgcattcacaacatcgagcttttccattgccgccttctatcctctaaagatatcggtgagcatagcgagtgcctcgagcacgccgccgccgaccgacgtcgccttgtccgaaatgtagttgatatagctggcatcgccacgcggatcgacatcggcgcatttaaagccctcggtcacctgcacgccgttcgccaaaagcccgcgcagacagccatcgatctgcgtgcgcatgggcgtatcgcccgcgtagccaatcacgtctccggcgcgcacgatgtcgccgattgcgcggtcggaccgaaacacgccggcggcggggctgtggataacacgctctttgccatatccggcgatgacgcccggcacgcccgtgttgggctggggtgaaccttgggtaatgacacggcccaggaaatgcccgcgcatggtctcgaccacggcgtcgcaatcgaccggcgcggtaaagcccggccccacggcgatgacggtaggcgccatgtcgcgcgtggtgcccaggttgcgcttggccagaatcgcgtcgaccacagccgcgggtttaagctcatcgagcatcttggcctgagggtccaccacgacggcaacatcccccgcttgggtaatctcgagcgcctctgccggcgtctgcgccaagcgagcgcgaatgccctcgacctggacctcgcccaggcgaatagcctcgcaaaaactgattgtgcggcggatgcacgtgggaaccgcgatatcggccataacgaccgacacgccggcgcgcaccaagcgagcggcgacacccgtggcgatatcgccggcgccgcgaacataaacgagcattcccggggcacctccctgtgctacggtttgagcagagcaaaagcggttcgaccgctactctgatgattatttattatcacagtattatacggcggtgaacagatggaaacggttagcggcaatcttgcctcggcgctcaggatcgagccgggcattaccgcgattatcggcagcggcggcaagtcgacgttgctcaaaacgctgggtcttgagctcatgcgcgctggcggccgcgtgctcctctgcaccaccacgcatatgttccccgtcgccggcgtgccgtgggacgggtcgagccgtcgcctggacgccgcgccttggaagccgggcgcctcgcatgtccccggttgcacctgcgaggcatgcgcgggcatgagccgcggaagtatctgccaggcgggtgttttggacccggagacgggcaaactctcctcccctgccgagccgctcgaccagctggcgcaacgctttgactacgtcctggccgaggcggacggcagcaagcggctcccgctcaaggcccacgccgcctgggagccggtaattcccgacgccacggcaaacgttgtctgggtcgtcggcgcttcggggctgggcaagcccgtcgccgaggctgcccaccgccccgagctcttctgcgagcgctgcggctgcgagcccaccgacgctgccaccccagagcgcgtcgccatggtgctcaatgccgagctgcgaatgctgaacctcaacaatgcccgcatcatgctcaaccaagtcgacacgcttgccgacccaacgatggcagattgcttcgaggcagccctcggcagccccatcgtcgccaccagcctcaaggggtagctaatttgggacggggctcttttagctaccccatgttgagagaaaaatcatcaggcaggcaagggtagctaaaagagccccgtcccaaattagctaccctggcggccttcctgctagcgggggacgtagcggccgggttgggctccggtgggctcgccgtcgcgtgccaccagcacgccgttcacaaacacgaccttggcgcggccatgtgccccaaaaccctcgagcggcgtgtagtccacagcttgatgctgtgtcgcggcactgattgtccagcgcgctttgggatcccacacgcacacatcggcatcggcgccctcggcaagacagcccttgcgcgggtacatgccaaacacgcgcgccgggttctcgctcatcaagcggcacagatcctcggggcccagctggccctcaaagctcgtggcaatcgcgacgggacgatgttccacgccgggcccgccgttgggaatcgcgcggaaatcgtcgcgcccgcggtccttttgcccgtgcaggttaaagctgcaatgatcggtcgcaatcgtatcgatctcgccggccacaagcgcctcgcgtagcgcggcacggtcaccggcatggcgcagcggcgggctcatcacatacttggcacccgcaaagccgtcctcgccctgctccaagtagcaagtatcgtcgagcatcagatactgagggcaggtctcgacatagatgttcttctgcccgcgcgctttggcggcgcggatggcctcgagccccagcttggtcgaaaggtgcaccacgttgaccggtgcgtcgccggccaggtgcgccagatacagcagacggctcaccgcctcggcctcgcacacgtccggacggctgagcgcatggccctcgggtccatgaatccctcgctcgtacacgcgcttctgcagttcattcaccagcgtgccgttctcgcaatgcacgcacagtatgccgccaatatgtttgagctcctcgagcacctcgagtgtctcggcatcgtccaagcgcaggtggtcataggcaaagtaggtcttaaacgacgacacgcccgcctcgcgcatggccgaaagatcggcgcggttgcgctcgttccactcggcgagtgccatatgaaaggcgtagttggccgtgcaggttccgccggcgcggcgatgccactcggccaaggcatcgggcatggtcacgccgcgatcggccgtcgcgtagtccacgatggtcgtcgtgccgccgcaggcagctgcgcgcgtgccggtctcaaagctatcggctgtccaatccatgccggtccagcactgcatgtgcgtgtggccgtcgataaagccgggaaacacccagcagcccgcggcgtcctcgacggtatcgccctcggccggctcaatcgccgcggcgatccgcacgatcttatcgccatccatggcaagatcggcgcggcgaagcccctggggcgtcacgagcgcgccgtttttgatgatgatcataattgctccttattgattgatgctgttggccacgcgatcaaaatacgagcaggcggcgatatgctccgttatgcgtcgctgtcccttggcggtatcgacgtcccacagctcgtaggcacgcgcctcgaccagcaccacgtcaatacggtccttgaggatcgaaccgccgccgtccttgccctcaagacgcatgagcgcatcgaacagttccgccggaaagagcaccgggctcgaaggctcaccgttgcacgcaagacgcaccggatgcttgcggccacgttcgtcaaatgcacgaaccatagcctcaaaagaatccgaactcacgagcggctggtcgcccggcaaaaagaggcaacctttccagttgcgttcgactccccacgaaaggcccgcacggacgctttcgctgcgcagctcgccatcgtgcagcacgcacgggcaatgcttgtcctcgcaaatctgagcgacctcgggccaacgcgtcgaaaccacgacgtcaaagccccggggaaccgaatcgatggtccgggcaatcagcggctcgccatagatatcggcaagcatcttgttagagccaaaccgcttgccctcgcccgaagccataatgacgcatccaagtttcatggtgatacctcccctgaaaccatcgtacccataactcgcgccgcgggcatctacatcgaaagcgcttatcccgcacgcccgcgatgcaaaaaggggcaccccgccggttggcagagcgccccctttacatggcttacctcaacccggctttaggcctggaaccaacgggcggtgttgcgctcgtcgagggccttgagggtagcggcgggatcggcaaccttctgcaggaacatcatggctgcgatggcgtacggcttgtagctggcctccttgtacatgcccacgcggtgcatgtcgaagacgtcggcgttgacctcgccgtgctcgcaggagacaccggagatgtcggcgggcagcgggtgcataaagatggtgtcctggccgttggcagtcttctccatgagctcggtcgtggagcaccaatcctgatgggtggcgttctgagcgagcagctccttctcgagcgcagcgatgccggcgtcgtcgccctcggcgtacaggttggtacgcttctccatggcggcaaacggagcccagctcttggggatcacaatgtcggcgccttcgaaggcctcggccatggtgttgacctgcttaaaggtggtgccggactcggcggcatagcccttggcgcgctcgacgacctcgggcatgaggtcgtagccctcggggtgagccagggtgacgtccatgccaaaacggggcagcaggctgatcagcgactgcgggcaggacagcggcttgccgtaagagggcgaataggcccaggtaacggcaaccttcttgcccttgaggttctcaaggccgccaaactcgttgatgaggtagagcatgtcggcagaagactgcgtggggtggtcggagtcggactgcagggagatgagcgtgggacggtgatccagaacgccgtcctcgtaggcctgctgtacggactcggagacctcggccatgtaggcgtcgcccttgccgatgtacatgtcgtcgcggatgccgatgacgtcggccatgaaggagatcatggtagcggtctcgcggacggtctcgccgtgagcgatctgggacttcttctcgtccaggtcctgcagctcaaggccgagcaggttggcggccttagagaaggagaagcgcgtacgggtggagttgtcgcggaacagcgagacggcaagaccggagtcgaagatcttggacgaaacgttgttctcacgcagctcgcgcagggcgtcggcgacgatgtagagcgccttaagctcatcggtggtcttgtcccaggtgtgcaggaagtcgctgccgtacatacccttaaaatcgaggccgttcagctgctcgacgagctcggtaaacttagcgtccatggaaatgtcctttctaaagatgaaacgatcgcaatgagtagatgtgctccgccatgcgcgtgtggctagaacatgcagagcaccatgacgaggacccgccaccgttgaggaagcatgggagataacgaccgcgggccccaagtcaacagggggtgccggggacacgagcggcccccggctcaacaaaatcgaggaatgggactaatcgatcttgttgttggtcagaccggcgcggaacacggtggcatcgccatcggcctggctcggatcgtagaggttcagggcagccacgtacatggcggcagcggtgaccaggtcgtccttgtaggtgacctcgttgggagcgtgagcctgagactcggcacccgggccaaagcccacgcaggggatgccgtagcggccctggatggaaacgcagttcgtggagaaggtccacttgtcgcacagcgggcgaccggtgcgcttgtccatgctgggctcgcagccgatgcgctcgtcaccaaacatggccttgtgggcgtcgacgagggccttgacgtgcggagcggtctccttgttgatccacgtggggaagtaagcctcggtctcgtagacctcgccggtccaggacggacggtcgtacatgtacatggagaccttcacgtcgtcgccgtacttcttggcggccggcaggttgcggatctcgtccaggcaggactcccaggtctcaccggcggtcatgcgacggtcgatggagatggcgcaggagtcagcgacagcgcagcggctgggactggtgtagaagatctggctgacggtgcaggtgccgcggcccaggaagcgggcatcctcgaagtgctcggggttgtacttggggtcgagcatcttgacgagacccttgatgtcggtcgactcgtcgcagccgttgttgttgagagcgcggacgtcggcgatgatgtcggccatcttgtagatggcgttgtcgccgcggtcgggagcggagccgtggcaggaggtgccgtgaacgtcgacgcggatctccatgcggccgcggtgaccgcgatagatgccgccgtcggtgggctcggtggaaatgacgaactcgggcttaatgccgtccttgttgtagatgtactgccagcacatgccgtcgcagtcctcttcctggacggtgccgacgaccatgatcttgtaaccctcggggatgaggcccatgtccttcatcatcttggcagcgtaggtagcggaagccatgccgccctcctggtcagagccgccgcggccgtagatgatctcgtcggtctcgtagccctcatagggatcggcgtcccagttctcaatgttgccgatgccgacggtgtcgatgtgggagtcgatggcgataatcttgtcgccctcgcccataaagcccatgacgttgcccaggccgtcgaccttgacctcgtcatagccaaggctctccatctcggccttgatgcaggcaacaacctcaccctcctcgcaggactcagagggatggctaatcattgcgcgaagaaaacgcgtcatatcagcacggtgggactcagcagcagccttgatagcgtcgaaatcgagttctttagccattgttcataacctttcaaacgaaggaatctacctgtgaggtggcggagcgatacctatttactccgccccaacgattagcaagtgggatattcgccttcccaaacaatgcggcgatactggtcgggatcggtgtcgccctcggtggagaagcagagcacggagctcgtcttgtccaggccgatgagctccttgagctcggcgtactcgggatcgagcatgagggtctcgaccaggccggtggtcacagcgccggactcgccggagatgacgcgcgggtcgcccttctcgggggcgcctagggtgcgcatgccgcgagcggtgacccagtcggggcaggacacgaaggcggtagcgtggttgcgcaggatatcccagcccaggatattgggctcgccacagcacaggccggccatgatggagggcatgtcgccgtccacgatgcgcgggtcgccgtcgccggcggcagcgcccttgtacaggcaggcggccggagcgcactcgaccacgacgaaggtgggcgggttatcgggatacaggttggtgaagtagcccaccacggcgccggcgagcgaacccacgccagcctggacaaacacgtgcgtcgggcggttgatggccatctcgcgcagctgctcggcagcctcggaagccatggtgccgtaaccctccatgatccaggacgggatcttctcgtagccctcccaggcggtgtcctgaacgatgacgccgcgctcgcaggcgtcggcctcggcggcggccatgcgcacgcactcgtcgtagttgacctcttcgatggtcaccgtggcgccctcggcggcgatgttatcgaagcggggcttggtggaacccttgggcatgtgcacgacggccttctggccgagcctgttggcagcccatgccacgccgcggccatggttgccgtcggtggcggtaaagaaggtggcctggccaaagtcctcggccagctgatcggaggtcaggtaatcgaaggtgcagtcggcaacgtccttgccggtctcgtcggcaatgtagttggccatggcaaacgagccgcccaggaccttaaaggcgttgaggccaaagcgatagctctcgtccttaacgcacaggttggataggcccaggcgcgcggcctggccgtccaggcgggcaagcggagtgacggtgtactgggggaacgactggtggaaggcacgggccttcttcacgtggtcgagactcatgattcccaagtgcttgtcatcgctcttgggcatcgtgttgctcgcccactggatcttatcggccatacggtgaactccttaagtcctctcttgccggcccccgcatacgcgtttcagcccgatcccattcacacggctgaacttttatgtggatgccaaacaaaaagtttgttagtactgttctatcacactttttgattggcatacctaacgaattgtttgttgccgtaatcggtactttttcgccgccgaacggtcatgaattgccttgttgatggatttgtttgcggccaagtgtggtttatggcaaagtgtgcccaaactaatttttaggaaggcaaccatgacccccgcacagattgagttttacaagcgcctagcacacggcctggcgctccaatttggccccaactgcgaagtcgtcgtccacgacctagagaccgaggacgtggaccactccatcgtagtgatcgaaaacggccacgtcagcgggcgcaaactgggtgacggccccagccatatcgtgtttgagtccatgcacgagggcgccaccgacgtacacgaccgcgagccatacctcaccaaaacaaccgatggcaagctgctcaagtcctctaccatctttatccgcaacgacgagggcaagcccgtcggcattttgggcattaactttgacattacgctcatgaaggcttttgagcgctcgctcgatgcctttaccggcaccggcggcacgggctataccgagcccgagcccattaccaagaacatcggcgacctgctcgaggacctgctgcacgagtgcgagcagtttgtgggcaagcccgcggcactcatgaccaaagacgagcgcattcgtgccattggctacctcgaccgtcgcggtgccttcctcatttccaagtcgagcgagcgcgcctgcgagttctttggcatctccaagtacagcttctatagctacctcaatgaggccaaggcggcggccggcgacaagtaagcgctcgcctggattgcccctccccttttgggcgcgagttctggaaagcacgaatccaagaccgagcagcttgggaagttccatataatcgatgtcattagtatttcgaaaggatggaacagaatggcgttgagcaaggcatcatgcaccggtcgcggattgattccggcaattggtggacatgtgcaccgcatgttcgatgagggtgaagacgacctgttttcgctgagccttgacgacgtgatggatgatcgcccgtggaccgccgacgaactcatgggcggcggggctcgcccgtcaaaccccaatcccgcacttgcgcctaagcccgcatctgcgccgacccctgcgcagtcgcccgcacccacttcggcgcccacgcccgctccccgccccgcaagcgacccgtccgagacggcggcatttctcgctgcagcgacgcagggcaaatcggccgacggcaccgttatgtataacgcccagcagttgcccgttcctgcggcgcgcaagcctccggtcacaaggctcgatgagcccgttgcccatcaggttgcccacgattcctgggctgcagccgatctggatgagacctctaccggcatgccggcgctcgatgttccagttaacccgctttttgccgccaacacgagcgccgcggactatgagggcggtgaggcatattccgattattccgatggctatgctggcaacggtcgcatcgagaccgaggattatggcaccgcatcgagcgattatctcaacgatccgtacgctgccacgcctgcaccggaatatgacccggaggccgcatccgcaccggcgtataccaaaagcacgggcgaagagcgcttcgccgattattacgccgaggaaaaggcgctgcgtttctcggaatttccgcaggcagtcaaggttgcctttatcgccattatcattgccctgctcggcgtcattgcgtttgagggattccagctgttccgcggccccacccaagcggagtcagagacccagcaaaaagaggacgataaccagtacctggacatcaacaccctcaagggcgaccccaacgacggggacgacgaatagcgagagctgaaggcagccgcaggatctcgcattcagcatcggcttctaagtgctgttttgtcatccagctatacttttggtatgtaaaataagtagttggaaaaaatcaaaagctatttcgattatcggcctaatacaaccataattccaaccaatggttttagaaacggtatttagcggttcccaaccatttatttaccgttctcgacaatacaatcaaagtcaatcagttcaagctgctctacgaatttctccaaatacgaaacgacttcctcgttgttgacgaatagcggcctgtcttgcgttagcctgcctgatttgtcctgcggatagcggagactgatgccgttgttatcgatgtcagcaacggcttttacgaaagcacccatgttcttgatggttctattgtcctcacggcacttttgcctcggaaaccttgagagcaaagagttccacaagctcgtgaggccatgatctctcttaggctcagctccacacctttttatcgcccttttaattgcaagctcaatacagtgccttgtgaggaacattaccggaatcgcgtaggaatactccagcatcaaatacataccaggcttgtcgattgctttcctcccagcggccgcaagctcctttgcggcattgaggaaagatcgtatgaactcatcatcgaacctatcggctttaaactcgtccttcatcaaggcagacgagtccaacagcgagaaatccctcaaagtggggtcgttgaagccatccatctgagacttcatgacttgttggctcatgtatttaggaaacacatggtcattgaacacactctccatcagagaatctctcccgttttcgcgtctatcttcgctcccgacctcgagccgatgaactcatccaccatctcgtcgtcgcggtcgggcccggtcacgaagagcggtcccgggacgtcgacgcgcgggccaatcgtcaggccgttgctcgcgatgatgcgatcgaggttctgtctacggtggagcgagcgggcccgtagtgtgtcgaaggaatagccccggccccgcacgtctgtcccgttgatgagcctgttggcgcactcggcgtagccgttcgagatgcggctcgggcagttcccagtagtgtcggcggggcgaaacacatcgtgcacgtagttggcgatacccaaaatctcgttcacgtagtcgaacgcggacttctcggccatggtcggtcctctctggcaaagacgatttcagccagagattttacaagttcaatgagttgcttcgctttaaatccaaccattggcttaacaaaacggtaggatgctttcttcaaccagaaaactaacaaacccaaccagttattttacataccctatacttttccggataatttgcctatcgaattagacacttttttcccgaagttttaaggtgcctatttcgacacttttccgtacttttacacggctgatttcgacactttccggatgaaagccgaataatcacttgcgaaaccaacgccgttcacacgtcatttcgcaggcagcgcttgatttctgtccgcacacgttgatagacttcctcttgcccgcaaggagcgggcgcgttttatccagagtcggggtagagagttggctccacgatcccgacgccaaccggccaagaggcacggtggccctgccaacatcgatgaaaggaatccgtatggacaatttctctgtgcgcagtaagcgcaacttccacaacctggcagccaagccaaaacgaatgcatcttctggacgagccgaacggctacgcctcggccatggtcaagagcagcctctcccaccagatgcgctttatggtacagaagctcgaggaaaagctctgtgctgctggcaatccgcatgtgctgcagattaagctgctcggagacgactcgcgtgagccgtctagctggaagctttttgccgacggtgagtgcatcgcggacggctcgggtgactttgcccgcgaatgcttctgcgagggagctgaggtgtttctggacctgtgccgcgacgccgtacgcacagctgagctgcgccagtggagtcagagggagtacgagctgttgagtgcggcccgcgggattgcggggggtgtaggagcagaagcctcatgacggtggcctcagctggaatgacgtatcgctcgataaatgatctcaacaacgtagccgatgcgctgcatttcatctcaaaggcattgagcgatcgggcggcgtctagcatttctttgatatccccaattgattgttccgagaaagtctcttcatgccctcataatcgcccttacgagaaacttgggcgagacaggcgtccatatgccgtctctaaactaacgagccgttcgcggaaagaacatctggctaacgtgggccaaagatatactggtatcgttgcagcaattatggaagatcggtgccgccaatgacctccttgaaattccccaggcgctttgcacttagcctgctcgtcccgttgtccgccgccgtagcgctggctttgccctcaaccgccctcgccgcgtcagacccgaacccgcccagcatatccaacgtgacgatatccgcaacggtcgtcacggcaggctccacgctgcgtgtcggctacgatgtggacgaccccgatggggtgcggtcagtcacgccgatagtcgaggtcgtcgtcgatagcgatgacggaggccaaggcaacagctcccgtctcgccttccagtcgaccggcgacacgaccgcgggcttcgatatccccacctccccgagcgaccagccctgcaggtatcgcatcatcggcctcggcgtgaccgatagccttggatgggttaccgatgtctacgacgcggcgtatgccgaggagaaggggctcgactgtccgaccttcgccaccagccctctcgtctatgaggtgaccgaggggcccgcggaccagaacccgccgaccgtgtcctccgtgtcgctctcgagcagggaggtcgcgaccggcgccgacttccacatctcttggtctgtcgcggacccggacggcgttcgctccgtttcccccatactgcagcggggctgggaggataaggacgacggctgctccgtttcgtcggcctattatcacggaggctcgtctatcgacgggttcgacctcacattcgacagtaataggatcggaaggcacaggctgatcggcctttcggtcaccgatgacctagggttcgagaccgatgtgtacgagagttcctacgccagggccaacggcatctcgggcgcgactttctcggttgccgacccgagcgagctgtgcttcgaggtgaccggcagcgcgatcgaccggaacccgcccacggtctcgaacgtttccatctccgcgaagagggtccctgtcggcggggtcctccgtatctattgcaatgtaggcgacgcggacggcgtgaagtctgtctccccgatcctcggcgaccccggctatgtcgaagacccgaactcggcaaaaactcgcaaaatgttgagctgcaactacgatgcggcaagaggctatatcgaaatcgagttccccacgtcgctctcgatgggctcgtttgaaatccatgccctcgcggtcctcgacaaggcgggtcatgagaccttcgtctacagctccgcctacgccgagcgtaacggcaagaccggcgttcagacctttgatgtcgacgacgcgggggacgtcacctttgacgtgaccgccccgctgtatgccgccaccaagggcaacggacaggcgtatgcaaaggacggcggggtcggcctgaccttccgcttcagcggtcctctcgatgagttcgcgcgtctccttgtggacggaaatgaggtctccgctgagaactacaccacaaccaagggcagcacgattatcgagctcaggccggcctacctagacacgctcgccgccggcggacacaccgtcacggctgtctggaaggacgggacgtcgaccgatgcgtccttcaccgtggaggggaagacccaaggggagcaagcgggcggcaagaccgatgtagattcacccggcgacaacaaaagtgatcctgccactcctgaaaaggacgccgacgaggcgtctacaaaaaggtcgggacacacgacagccgatgaaccaaagctcgccacaaccggcgactccgcttggatggccagcatcgcattagccatggcggccacggcctgcttcacggcagcgagaaggcttgagcccaagcagcataggcacgaacagtagctcaaagcgaactcaactgggaggggcagatggatagccgtccttctcttacaatcaacccaatccgctgaaatgcaatcagttaacgattttcgccagatgctcggtctctaccccgctctggcaagccaccaggcgatgagataatgcccacgactatcaacgtaagcaaggagcgcgctatggcagacaacgagatcaaaccctcgacggacgatggccgagaagaactcgtggcaaaacagctcgcatccaccaaaatccacctcgcgctcacctaggagcgggtggacgtctccagcgccatcaagctcccactcgaacgagtcccccagctcggcatagcgctcgcctcactcccctcgacgttccgtaccgtctccaacacagtaagcgtgcccatgctgctccagccgaccgataagcttggcaatccgcttgacccgtcgatactccaatcgttcaaggacggcagtggcctcatgggatcctatcgcgatgcggccaagggtttcgggcaggcgcgcttccacgtagtcgagggcgacatcgccacaagcgtcacgcaggtgccttacgatccaacatcgctattcatggcagccgcaatcgcgcagataaaccaaaagctcgactccatccaggagtccgtcgacgagatgttcgagtacatgcgtcagcgcgacaaggccaacatgcgcggcaacctcaagacgctcgcagacatcctcaacggttacggcctcaactacagcaacgccacctacatggcaaacgcccatatgaaggtgctcgacatcaagcagtcgtccgcgcaggacatggaactcttccgctcgcaggcgcaggcagatctgaaaaagaaagggttcatcgaggtgcgagacggcttgggcagacgcctcgacaaggtgctcgaatacctcaaagactgccagctcgccacctacatacacgcattctcgctgttcctcgaacccatgctcgcccagaacttcgagcccgcaaagctcgcggatgccaccgcgaagatcgaggccgattcgctcgcgtaccgtgagctctacaccgagtgttacgacgcccttgaggcaggaactgccgacaccgtcgattcggcgctgctgggcggtatcgcatccgcgggcaagctgctcggtcacgccatcgcaaagacccccgtgggcgaccatacactcatcgacgaggcgctcgagggcgcgggagaggacatcggcaggttcaacgacaggcaatccgagaaactcctcgagaagctccatcaggcaaagacgcccgacgtcgcgccgttcaagcagagcgtaaaggagatcgacaccctctacaaccgccccacgcagatcgccgtggacgccgagaacgtctacatcttgcctgccaagcagcaggaagagtagcgatacgcgacaagcatgcgccaagcagacagctaacgcccctacctcccctccgccttcagcctcagcagcaggtcgcccagctcagggcacttgctggagaagcgcgtccgggctcgctcgcccatcctccatcgctggcggatctcctgggcacgcggactcacgcgatagttcccgtccatcacttgcttgagcaacttggcggccacgcgcgcatcggctagagcgctgtgagcgtggcccgtcgactcgtcaaactcgatgccaaaccacgttgccgcgtcactcaaagagacgcgcccgtggctgcccacgtccatgatcgaagtgtaaaacgcctgcaggtcggcccagtccgtaggaaatgcggcaaggtcgatgtgctttgcttggcactcggtcaaaagctgtcgacgatctgccccgctccaacagaccacctgggcggagtagcgaccaatccaatcgctgagccttttgatcaccacatagagcggatcggccatcgcggtgtccacggccgatatccccgtaagctcgcggacggggaacgcaacgccttcggtaaattccgtctgcacaaactgcgagaactcgcccataacgttaccgtggtaatcgagcttgacggcgccgacctcgataatctcattgcgcagtccacgtcgctggcgctgctttggcaccagcgcaaactcaaagtccagcacaatctggcgcgcaaagttcgtcgtatcgatagccgagatgcacggcgtcttttcagctgacacggttatggcctctctccgtcaaatgccgctcgttacataagcggctacattgccgtaaggataggcgctcgtgcggacatgaaagcggggcgcaataccatgcgctggtcgcacgccatgcagacggccccaagagaatcgcccgctctattcaaatgcatgaaaaagatttaggcccggtgacttgaatcagcggtcatcccgggcccatcaatatgcagtgtacctacagagggctggttaatcaaacgggctttcggtgacgaagacctgcgcgtctatccccaatcgcccagcgccgtcttctgccgcccttacgaaaggctgctattcgagggaatcacgttgctgttattatcgaacatatattcgtatttatgaccgcgctttgatagaatggcagttgttgacggcagttccatgtgccgggcagcgccctccatgcgacgggaggtgatgcccatgaccgatctgattgatttcgtgaagctcctgaccgctttggtctcgctcctcacggcgcttatcggactttccgaggcacttaagcagcgtacgaagcaaaagacgatatgagaaagccattggggtcgcctcccccgcgttgcagtttctttccgcgatacgcataaaaagcctcccatttctcgtgtccaagaaatgggaggcagttcaaagtatgcattcgacggggcggtttatgcatttggccgattaaggatgcgctgtcaaactactagaacttgacggtcggggcctggcgggctgcttcggcggcctcgaagccctggcgctccttaaactggaagatgccggcaaagatgacagccgggaacgtctgaatggcgttgttgtagctgagcacgcaatcgttgtagctctggcgtgcatagctaatcttgttctcggtatcctcgagcgatgcctgcagctgcgtaaagttggtgtttgccttaagatcgggataggcctcggctacggcgaagagctgacgcagcgcaccggtcagcacgttgtcggcttccatcttggcttcgggcgtggtggccttgacggcggtgttacgcgcgctgatcacggcggagagcgtctcctgctcgtgcttggcgtagcccttgacggtctcgaccaggttggggatcaggtcgttgcgacgctgcagctgcgtatcgatgttctgccaggcgttatcgatgcggttacgcttggtgaccatgttgttgtagatgccggcgatggcgcaggcaatcacaatgacaacaacgatgccgatgatgacgggaagcatgatgtctccgtttcgaatggccgcggcggcatgcgccagctgccgttggtataacgctactagtatacccgcaacgttttgtcgtgccgaactttccggtaagcgttgtgttttcggcggggttggcaccggggcaaagcgcgcgaggtacaggtgtaagatatgcgacagattgacgagtgttgtctttgccctgaggatggcgataccagtggaccttcgcatcaagaaaacctaccgcgccctgttcgatgcctttaccgagcttctcgaggagcatcgttttgaggacctgacggttgccatgctgtgcgaccgcgccatgattcgccgcacgacgttctacaagcactttcgcgacaagaacgattactttgccttttatatcgatgagctcatgtcgggcttgccgcaaaaacagcccgatgaggccggcgcggtatctgccgaggacgtgcgcgcgcttcggcacgcgattttggacgatgccatggatttgattctggcgcacgagcggctcatggataacattttggcaagcagcatgtcgggcatgttgaccaacgttatttgcgaccgcattgcccgctccatccgcgagcgtgtgatgaacgtgcttgccgaggatgccctggcccccgtgtcactcgagacgacgtctgagtttgtcgccggcggtattattcgacttttcacgatatggtgggaatcgggccacgatcttgagcgtcgacctgagatagccgatgtggtcgatgcactgtttgagcggaccatgacaccggtgcatcactaggagtggcggagagagggggattcgaacccccggaacgctctcgcgctcaacggttttcaagaccgccgcattcaaccgctctgccatctctccgtgagtcgtaatgatagcatcgttttggatttgcaacagggaaggcgaacgatgacgatcaccgaaatcgatgagaagttcatgcgtgaggcgctggccgaggcgcgcgccgccgctgcggtgggcgaggtgcccatcggagccgtagtggtgcgcgacggcgagattgtcgcgcgggcgcataatcgccgcgagctcgaccaggatccttcggcgcatgccgagttttcggccctgtgcgccgccgctcagtcgcttggacgctggcgtctttccgattgtacggtctacgtgacgctcgagccctgctgcatgtgcgcggggcttatggttaacgcgcgcgtggggcgctgcgtgtacggcgcggctgatgctaaagcgggcgctctggggtcgctatacgacctcaatgccgattcgcgcctgaatcatcggtttaatgtgaccgccggcgtgctggcagacgagtgccgcgcggtgctgagcggttattttagtgggctgcgtggcaccgatggtgctggctgcggttgtggggccgatcttgaggcgcataccgcccacgccgaggcgcttgcgggtgtcgaagatactgccgttggggcggtcgattttggtgccgcgtgccgccggccccgccgtgtgcagctggcgatcgactcctttaagggcagcgtttcgagcgcgcaggcggaggaggccgttgccgaaggtgtgcgccgcgtgtggcccgatgcccaggtaagcgcgctgccgctggcggatggcggcgagggaacgctcgatgccgttgccgcgtgcggcggtgaggtcgtggcatgtgaagtcgcaggccctctgggcgactgtgtgtctgcccggatgctggtggacggcgagtacgagtcggctgtaatcgagatggccgaggcggcgggtattgggtattcgccttgcacagagccggcggcgttggccgctacgacctatggcgtgggcgagctcatgcttcgagcggttcgtgctggggcaaagactatctatattggtctgggcggcagtgccaccaacgacggtggcgccggcatgctgcaggcgctgggcgcgcgtgtggtcgatgatcagggctgcgatgtcgcccctggtctcgcggggcttgagcaggtggcgagtatcgatttggcaccggcgcttcgggcgctgaatagcgcgcgtatcgtcgtgctctctgatgtcgagaacccgctcgtggggcgtcgtggggcacttgcagtgtttggcgggcaaaagggcctgccgacagacgatgtcgaagcgctgggcaggtacgacagttggatggtcggctacggccgcctgctcgatgcggcgattaccggggtgcgggctcaggggttgttgcgcgtgcccgagggcgtgcggacatttggctcggtgctcggcgtgcctggcgcgggcgcggcaggtggcttgggcgccgcgctgctggcgctcggtgctgagttgcgttcgggcgtggagacggtgctcgatctgattgggtttgacgagcgcgtgcgcgatgtcgacctggtcattacaggcgagggcaacatggacgagcaatccgctgccggcaaggcgccggtgggcgtggcccgccgtgccaatcgctatggcaagccggtagtcgccgtcgtgggcggtcgtgcggataatttggatgcggtgtatggtcagggcatcgacttggtcctgccggtctgccgcaggcccatgcctcttgaccaagcgctcgacccccaggaagccacaaccaacctcatctgcgccggtgaagcagccgcccaagcctacgacctcgcccgcctctaaaacccaactccctataagttgcggtggaatagttcctgtttggcggctcaggcggcaaaaacaggaactattccaccgcaacttcgagaatggctatccgaggctggtcgccttgggccttgggtcggaccgtccgccatgaaatgcggccatctactacgtttagccgagcgcccttgaccatcccggattttgtgaaattaaaaccgcaggtagaaagcttgccgattttcgaaaaagccggctatggttgacccctgcggcctaaacgtagtagataggccccttttgtggcacggcagcagaccagtctttttgggacggggcttatttgactacctgtcgatctgattgcccaagtagtcaaaaagccccgtcccaaattagctaccttgccccatcgggcgggagcgggtaagatatatcgagcgcctagcgcgttcgatgggttcggatgacgacatgttccgaatctggtcaggtccggaaggaagcagccataaggagcctctgtcgggcatccgaatccatcgagtgcgcaggcgttttttggtgccgcggctacccgcgagtgccggcagggcgcttggtgtctcgctggtcctcggcttcgcctgcgggatcgctcgactaccaagcgccctgccggcacccgcgggtagccgaccaaaaccgcctgaagggtcacatttatctgataattgaatccccggcgttatgccgctcgctggcgttgccaaaacatcggctgctacgtgccttgggcgctagtgaccgttgcccttacatctgtaacgagttgcttacgcatctccagggttctccgtactatcatgaatcagattgaattgagatgatgatagggagcgcctttttatgattgagctgctcaggcgttttggtggtaagtttcgccggtatatggtgattggccctgcgtgcaagttgattgaagtgatctttgacctgctgacgccgctggtgattgcccagatgatcgataaaggtatcggtgcgcacgacgtgagtgccgtcgtccgctacggcatggtgctcgccgccatggctgtaatcggcatctcgtttacgcttgtttgccagaagatggcggcgctcacctcgcagggcatgggtactgacattcgcggcgcactctaccagcacatcaacaagctgagctatgccgagctcgaccgctttggcacgccgtcgctcatcacgcgcattaccaacgacgttaaccaggtccagctcgctgtggcgctgggcgtgcgcatgctcatccgctggccctttctagcggtgggctccatgtgcgcggcccttgccatcgaccttaagctcggcatcatctttttgatctgcacgcccgccattggcctggtgttctgggttgtcatggcgcgctgcattccgtactacaagcagctgcaggcaaagctcgaccgcatcgcgcttatctgccgcgagggcctttcgggcgcccgcgtggttcgcgccttcgtgcgcgaagatcacgagcgcgagcgctttgcgcaggccgccgacgaccaggccaatactgccatcgcggtgggcaagctctcgtcgattctcaaccccgtcacgtttttggtgatgaacctgggcgtgtgcgccatcctgtgggtgggcggcatccaggtcagcgtgggcgagcttacgcagggccaggtcatggcgtttgtgaactacatgacgcagaccctgacctccatcgtgtacgtcgccaacctggtcgtggtctttaccaaggcgagcgccagcgcgtcgcgtatcaacgaggtgctcaattgcgtgccgggcatcgctgacgagggcaaccagccggtcgcgctgcccaagccgggcaatgtcgcttcagttcccgcgctgagcttgagccatgcgagcttctcgtttggcgctggcgcggccaatgctgtcaacgatgtgacgctggaactcccgctgggcaagacgctcggcattatcggcggtacgggtagcggcaagtccacgctcgtctcgctcatcccgcgcctgtacgatgcgagcaccggcagcgtgagcgtgatgggcgtcgacgtgcgcacctggccgctcgaccagctgcgccgtgtggtcgcgaccgttccgcagcgcgcatcgctggtgagcggctccatccgcagcaacctgacctggcgcgatgaagctgcgaccgacgaggagctctgggtggcactcgacatggcgcaggccagcgagttcgtgcgcaacaagccgcagggcttagacgccccggtcgaggcgggcggcaagaactttagcggtggccagcgtcagcgcctgactatcgcgcgtgccttggttggttcgcctcagatattgatcatggatgactccgcgtcggcgctcgactttaagaccgacgcggcgcttcgccatgccattcgcgagcgcagcatgcgcggtgccgccaagggcgggctgccgctgaccacggtgattgtgagccagcgcgtttcgaccgtgcgcgatgccgacgtgatctgcgtgctcgaccacggctcggttgccggcctgggcacacatgacgagctctatgcgacctgtcggctctatcgcgagatttgccagtcgcagctgcgccgcgaggagcttgagggccagcgggggagcacagcgcccgcgcccactccggcgcccgcgtccaccctaagccccgcgtccgccccgactgccccggcatccatttgcgcaaaggagggctgctaaatgaatccgtacacttcctccggttcggtcgccacgatgacggccaacgtgtccggtaacgataacctcaacgacctgggcgacggtccgcgccagcccggcgaccccgagcgctatcccgtgggtgcggtgactcgccgtctgatgggctacgttcgtccgcatcgcatttcgtttgttgcgtcgtttgtgagtgccgccatctccgtgattctgcagctctacacgcccattctcatcggcgagggcatcgacctgatcgttgccgtcgggcaggtggacttcgacgcgctgctgccgcttgtcaccaaactcgcgctcgtcgtggtgggagccgcggccttccagtggctgcagggctactgcgtcaaccgcctgtcctacgaaacggtgcgcgacatgcgcgtggaggcgagcgacaagctcagccgcatgccgctcagctttatcgacagccatgctcacggcgacctcatgagccgcgtggtcaacgatgtcgaccaggtgggtgacggcctgctgcagggcttcacgcaactctttaccggtgttattaccatcgtgggcacgctcgcgtttatgctttccatcaacctgaccatgacgctcgtggtggtgctcgtcacgccgctttccatttttgcagccggtgctattgccaagctctccaacaaaagctttacggcacagcagcgtattcaagggcagctcggtggtcatatcgaggagtacgtaggcgagcaaaagcttgtcgacgcctttgcctacggtcccaacgcccagcagcgcttcgatgccctcaatgccgagctttacaccgcgggcgagcgcgcacagtttatgggttcgctctccaaccccggcacgcgctttatcaataacatcatctatgccgtggtcgctgtgatcggctgcgtgggcgtgatcacgggcgtgcccgcggcgcttacggtgggcggcgtgcagatcttcctgtcctatgccaaccagtacaccaagccgttcaacgaggtcaccaacgtcattacgcagatccagacggcgtatgcctcggcgcgccgcatgtttgcgctgctcgatgcccgcgagcaggagcccgatgcggcggatgccgtggaacttgctgccccgcagggcgaggtcgcctttgagcatgtggactttagctacgtgtccgaccgcaagctgctgcaggacatctgcatcgaggccaagcccggcatgcgctttgcccttgttggccccacgggctgcggaaagacgacgctcatcaacctgctgctgcgcttttacgatatcgatgccggccacatcacggttgatggcaggtcttcgcgtgactacacgcgcgcaagcctgcgccatgcctttggcatggtgttgcaggatacgtggctgttcgagggcacggtggcggaaaacatcgcctacggctgtcccgacgccacgcgcgagcaggttatcgaagctgccaagcgcgcgcatgcgcacaagtttatcgtgcagctgccaggcggctacgatacggtcatcggcgaggacggcggcacgtttagccagggtcaaaaacagctgctgtgcattgcgcgcgttatgctcaccgatccggcgattctgctgctggacgaggcaacgtcgagcatcgatacgcgtaccgagctgcaggtgcaggcggcattcgacgagctcatggccggccgtacgagctttgtcgtggcgcatcgcctgagcacgattcgcaacgccgactgcattctggtcatgcgcgacggccagattatcgagcgcggcacgcacgacgagctgctagcggcaggcggcttctacgccgaactctaccgcagccagtttgcccagtaagcaagcccgtggggcaaattaatcaatcgacagacggtggtttacatctgtcacgttagtactaagatagtcatctaataaattgcattagtggctttagttttgggggatacgaggcaacgtgactatgacgtgctctttggtggttaacagcaagagcggtaataccaggatggtttcgggtgcgatcaagcgcactctgcaggctgcgggtgttgagtttgtccatgccgcggcgttgagcgacgatgcggatgcagatcaggttgcgctcgaggcgcagggcgcctgcgcggccgacacggtgctcgtcggtttttggtgcgacaagggcgcgtgcacgccttcggtcgcggcgttgctctccgctttgcacggcaagcgcgtcttcctgtttggcacctgcggctttggggccgatcagagctattaccagcagattatcgaccgcgtgacctccaatttggctggagatgccgagcttgcgggctgggcgatgtgtcagggcaagatgggccctgcggtcaagcagcgctacgaggccatgctcgagcaagatcccgacaacgcccgatttaagatgctgctcgacaactgggttgccgcaaaggaccatcctaccaaggaggacctggacaacatggccgcagccgccaagaaggccgtgctgggcgagtagcttcgccgtccgcgatccttcgtgcaaaacaatacaaatgtgaaagcctcgaagttctcgaggcttttttcttgacacttgtaggcgcaaccgtggcaggcgtttggggtgacattttccattaccccgatgacgagaccgtcctggacgacacactcgcatgcgttcgctggatgtattcagagtgggacgggctttccggatggatggggtttcggaaagtgtgtcccggaatttgcctttggaatgggatgcggtttccggttgagggctctggtggaaaatgcgacccggaatttgcaatcggagtgggatgcagtttcccaacggggccgtaagcggaaactgcatcccactccggacgtgaattctgggacacggtttccggatgcaaaaaaggccacaagacgtggccttcaacttatatatgttgcggatacccccatgacaagccgcgctccaacaacagggcgtctgtccaggcggaggcatataaggttcatcgcgagttccgcacgcaaagaaggccacttaatgtggccttcgtcttgcgcaggactgtccgagcagggaaccttacgttccgcgccgtccgggcagacgaaccgggatacaggctcgctacttgatcttggtcgtacccggtgccaggttggggtcggtctcgttagcctcggtctggaagtgctcggtgtacacgttcttgccgtcgcggaacatctcgtagtactgcatcttggcgtaatcttcgcgcgccttggtggcggctgcggcggcggcatcgtcaccggtgacgttggaggagagcgcccagcgcaggctggcgtcctcgtagccgaccgagttgatggcgggcagcgactcgcgtagcgtcatgtgcgctttctggtagtcggtcagcggtgcgccgatcagctgcataagctgcgtggacaggtagttggtggacaggtcgtcgacctcgctcgtctggtcgcagccggcaacgtcgtagttggcccagatgatgtagtcggtctgccacagacgctcctgatgcgtagcgtcgtcctcgccggtaaaccacttgtcattgaacttggacgggaagaacggctggtggtcgccccagaacaccacgaccaccttgcggtcgagcttgctcaaggcgttgaggaagtagcgcagcgcctggtcggactgctcgatgcacgagacatactcgtcgacatcggatagcgtgccgtcctcgacggtcttggcgtccaggtcggtcgtgtcgatgttcaggtgcatctgcttgtcgaccggcagcaggcccgtatcgtagcccgagtggttctgcatggtcacgtcgaagataaactgcggatcggcgttctggtcgagcagctcaagaatcttgtcgtaggtagcctggtcggtcaccatgccgcgcagggtgtcggctccctggaaatcgttgatagacaggaactggtcaaagccaaagtccttgtagacgttctcgcggttccagttggtcgcgtggttggggtgcatggccgtggtggaatagccgagcgatttgaactgctctgccagattaccggtcgtttccatgttgtagatggtgtaggggtacacgcccgagcccaggttggccatagagttgccggtcataaactcaaactcggtattggcggtaccgccgccgtaggcgctcacgtagagcttgccgcggctgaggcagttagacaggctcttaaagtactgcgggccctcgtagccggcgcgcatgttctggtagatcgacaggtcggagaacgtctcgttcatgatggcgatgaccgtgggcttctcgctatcgaactgctcctttgcggcggcgcgctcgtcgctcttggccgcgtcggacttgtcgtaggccttggcgtactttttgagcgtggccttggcatcgtcgacggagtagtcggcgggtttgggcggcttgatggactgcgctgcactaataaaggcgggcaggtagccctcgcgccagtagctctcgagcgggcgccaggtgtagacggtgatgccgagggtgttgtagtagtcgatgagcgtgacatgcgcggtcacgccgcccaggcacagtacggcgacgagcaggttggtgagcagcatgcgcttggcgttggcggcgcccttctgacggtgcggtgccaccaggccggcgtactcacacagcagcatggcgatggcggtaaagcccatggacagcacgcagaacagtgagatcgagaaggtgtagccggtgccggcgaccgcggcggcggtggagatggccgaaaggtcgcccggctggatgggcatggatttaaacgtgatgacgaagaactcggcaatgcccaggacaaagagggcaaaggccaggaccgcgggagctacgccgtggcgctggaacaggaagaacaggccgaccatgagcacggtgatgatggcccactcgagcaggatgcacagggggtagacccaggtaaagtcgtggttggacgagacctccatgcccagcagcgcaaagacgccggcgagcagcaggcacaggacggcggcgacgagtggtttgcccacaaaggcgccgcgcaggcgggcgagcttgccgatgggggcgggggcgtcgggcttggcgaacgcaaagacgcgcggggcgatgcggtcgcgtgcgatgctggcccaagcgcagccggtgaggatggcgttggtcaggatgagcatcacaaaggcgagcggctcgttttgggcgacgaggccaatggcgccccaaatggtcaaaaagagctggaacaggccgaaggcgacgctccacccaagagcgcttttggcaacggtgcccgactgagcgcaaatggccttggcctcgcgcaagacaaggtagacggtcgccgcaagaccgacgagcgagatggcggcagcgaacatgctgagactcctcacaaactaaaacgtacgaaagcggaggtttacccgattgttaccaagatatgcgctgcaattggtggctgcgcacaacaaccagccatattaacgcgcacgtgtggcggtgtggcgcaatgtagtggcggcctgcgcgataatggacgggaattacacggaaacgtaaaggcttcttaaagaattagcgaggatagagctatgggcgagcaggtttgtatgacgggcaccgagtactgcggcggagctgtgggcgtggacgcgggcggctatccggtcgagactacgggcaacgcggcgctggacatcttggaacaccgctcgtccacgcgtgccttcgcgcgtgatgacgacgaccgtcccgtggcggtgaccgacgagcagcgggcggcgatcttgcatgcggcgagccgcgcgccgtcggcgggcgccatgatgatgtattccatcgtgagcgtccgcgagcgggcaacgctcgaccgcctggccgacctgtgcgaccaccagcccatgatcgccaaggcgccctgggcacttatatttgtggtcgactatgccaagtggatcgatctgtttgagcacgtgggctgctttgagcccgagtttgtcgagcgtacgggcaaggcgccccgccgcgcgccgggtctgggcgactttgccatcgcggctcaggatgccgtgatcgccgcgcaaaacgccgtggttgccgccgaggccctggggctggggagctgctatatcggcgacatcgtcgagaacgccgaggaagttgccgcgctgctcgatctgccgccctataccatgccgctgtcgatgctcatcatcggcacgccccgtaaggagcgcccggcaatcgcgcaccccgtggtgaacctggtgcacgaggagcgctactgccgtgcggatgccgcgactatggatgcgcaggtggccgagatggatgcgatgtttcgcccgcacgcccgcgaggtgggggagcgcgtcgtggatatctacacccgcaagcacacgagcccctttatggccgagatgagccgctccatggagtggtggttcaaaaactggctcggaaaatgacgaatgtgacaaggggatagtccctttgtcacacttcatatcgccgcggtagcctaaagactgtataaatctttatctagctgggaaaacagtgcattaaaacatgggccgattacctataatcccttcgaacattaaagttgggaggaaaccggcttatggaacaaaaggccaaggaggcagcctcgcacgctgcgattcctgtgagcatctcggcgatgctcgtcacgctaggcgtggtgtacggcgatatcggcaccagccccatgtatgtaaccaaggcgctcgttgccggcaacggcggcatcggaagcgtcacggaggagttcgtgctcggcgcgctctcccttgtcgtgtggacggtcacgttgctgaccaccatcaagtatgtgctcatctcgctgcgcgccgataaccatggtgagggcggcatctttgccctgtacagcctggtcaggcgctgcggcaagtggcttatcatccccgccatgctgggtggcgccgcgttgctcgccgacggcatcctgacgccggccgttaccgttaccacggccatcgagggcctgcgcactatcccggcggttcatgccgtgctgggcgatgaccagggccgcgtcgtcgccattacgctcgccatcatcatcgtgctcttcttggtacagcgcatcggtacggccaagatcggtcacgcctttggccccatcatgacgctgtggttcctattcctgggcggcacgggtttgttctttgtcttacagcaccccgccgtgctgctgtgcctcaacccgctccgcggcatcgcctttttgttgagccccaacaaccacgcgggcatcatgattctgggcagctgcttcctcgccaccaccggtgccgaggcgctctactccgacatgggccacgtcggccgcggcaatatctacgctacctggccgttcgttaagtgctgcctgctgctttcctatatgggccagggcgcttggcttatgaacaacgctgccaaccccgagctcatgggcattgccgacctcaacccgttctaccagatgctcgccccgggcctgcgcccgtttgccgttggcctttccaccgtcgcggccatcattgcctcgcaggcgctcatcaccggcgcgttttcgctggtgtccgaggccagccgtctggacctcatgccgcacatgcaggtcttctaccctgccgagaccaaaggccagctctacatccccatggtcaacaacgtcatgcttgtgggctgcgtcatcgtggtgctgctgttccagaactcggcgcatatggaagccgcctacggccttgccattacgctgactatgatgtgcaccacgctactgctcttcttctacctgcacgaggagcgcaagctcaaggttgctccgtggatcttcgcggccttcttccttttgctcgaaggcttcttcttcgtgagctcgctcaccaagttcttccacggcggctatttcaccatcctcatggctgcactcatcatgggcattatggtgtgctggtacaacggcacggcggtcgagcagcgccagtttacgctgctgccgctgcgcagctacctgccgcagctcaagcgcctgcgcgacgacgaccgttacgagcgcatgagtgacaacgtcgtgtacctgaccaaggacacccataccgactacatcgaccgcgatatcgtctattcgatcttggacaagcatcccaagcgtgcccgcgcctggtggttcgtgaatgtcgagaccatggacgaaccgcacacctttgcctattcggtcgagacgttcggcaccgactacgtgttccgcgtgcacctgtacctgggctacaagatcaaccagcgcgtcaatgcctacctgcgtcaggttgttcaggacctggctgccaccggcgagctgccgccgcagacgcatgactactcggtctacaaggatccgggtaacatcggcacgttcaagttcgtcctgatccgtaagcttctggcgcccgaaagcgatgtggagcccagcgagcgtacggccatcacgctcaagtacatcattcgccgcgccgccggcacgcccgcgcgttggtacggcctggagaactccaacgtgagctttgagtacgtgccgctgttcaccaagttcaaggccgtgaacaagatgcagcgcctggcccccaacgagcggccgtaggcgccgacgggttgcacggagttggttttcgatggacaagattgagaccggggaggcaaacatggatgcaaagatgcttgatggccgcgaggtggttgccgagctggtacgtgaggcacgcgccgacgccgccgaagatcggttccttacgaaccgtgccaacatggatatggccgatcgcgtaatttcgatcgtggcactggtatttggagcggtgtgcgtgtgtgccctgctcgcgcacgtgctgtttgtctagcgaccgccggttgcaaaggctatacacttggaaccaccacaagggaaaccaccacaaaggtgcctgtcccctttgtggtggtttttgttttgagagaggggcgggacgctgatggacgtccgtacggacggcgatattgccgatagcttttggtggcggcgcacaacgctgacgcgccgcactcctctgtatgacgcctgcgtatcggtggggctgctggtcgcggcgacgattgtgggcgcgctgctcgaccatccgggtctcgcgccgagcatcatgatcgtctatgtgttcgccgttcagctgtgcgcattctttacctggagtcgcctgtattgcttgctgagctcggctgccgccgtggcgctctacaacttcttgtttgtcgacccgcgctactcgctgtcgcttatcgaccgcggctatcccggcatgttcttcatcatgttcgtggtctcgcttgtgtcgagctcgattgcgttggccctgcgccgcgccttggcacaggctgccgccagcgaccgccgcacgcatatggtgctcgagaccaaccgcatgctgcagcggtgcgccgatcagcatcagatcgttcacgccatggccacgcagctggcacgtctttcgggctgcccggtcgtgtggtacagcgccgacgccgagggcgatgacctgctgccgcgtgcgacatacacggccgtgggcgatgccgcaccggtgcacgaactggcgccgcagatgccgccgcggctctcggcgtccgcctatgtgggaacgccgctcgatgccacctatggcggctcggcgttttatggcatctacctgacggttcgcacaggcgacggcttcgcgcgctcgggcgaccccgcctcggtggtgggcgtgctggctatcgttgccgagcccgacgtgctgacgcatgaggagcggacacttgccgatgccatcgtgagcgaaggcgagctggcgctcgatcgcgcccgcgccatggaggcccgcgaggaggcggcggtgcttgccaaaaacgaacagctgcgcgccaacctgctgcgctccatctcgcacgacctgcgcacgccgctcaccagtatttcgggtaatgccgatgtgctgctcgaccagggctcgaccggcaccgcggtgctcgatgcccagacgcgccgcggcctgcttctatccattcgctcggatgcgctgtggctcaacgccaccgtcgagaatctgctcgccatcaccaagctcgagggtggcggtatgcgcctgtcgaccacgctcgagctcatggacgatatcgtcgaggaggcgctgcgccacgtaaatccggccgtgcgcgagcacgaccttaaggtggtggcgtgcgatgagccggcgctcgtcaacgtcgatgcgcgcctgatggtgcagctggtggtcaatctggtgaacaacgccatcacctatacgcccgcgggttcgcatatcgtgatttcgattagcgtcgacgatggacgcgtggcgtgctcggtggccgatgatggtccgggcatcgcacccgaggatcgcgagcggatctttgagtcgttctataccgccaaccatggtctggccgacagccaccgcagcgttggcctgggtctttcgctctgccgttccattgcgttggcacatggcggtagcatagaggttgccgcggcggacccgcacggctcggtctttacgattgagcttcctgccgccgacgtttcgtttgataaggagtagcgctgtgccgaactctgccgtaaaaccgctcatcttggtcgttgaggacgaccccgccgtccgcaatcttattgttgccgcgctcgaggcgcacggcttgcgccatatggctgtggagaccgcccatgccgctatcgccgccgcctcgtcgcagacgccgagcattgtgctgctcgatctgggcctgcccgatatggacggcgtcaaggtggtggagtcggtgcgcgcatggtcgggcatgccgattatcgtggtctcggcgcgcagcgaggacgcggacaaaatccgcgcgctcgatgccggtgccgacgactacctgaccaagccgttttcggtcgaggaactgctcgcgcgcattcgcacgacgctcaggcgcctttcgtatgcgcagacgggcggcgttgtctccgagggctcgttcgataccggtgagctgcatatcgattttgatgccggcatcgccacgatggatggcgaggaactgcatctgacgccgatcgagtataagctcctgtgcctgctggcgcataacgccgacaaggtactgacgcaccagtttatcctgcacgagatttggggcacggcaactaagagcgacctggcgagcctgcgcgtctttatgggcacgctgcgcaagaagatcgagtccgaccccgcgcatccgcgctatatccagacgcacgtgggtattggttaccgattggtcatccagggataggtcggcatccgccatcccaatatgagttgcggtgaaatacggtctaaatttgcctaattccaggcaaaacagtccgtattccaccgcaactttgttatttgcccttgggcttgctggcgtagaacttcttctttttggacttgccggcgggggagggcttgccagcaaagttggacttgccgttgccggtctgcacgtgcgcgggcactgccgcgcgaggcttacgggcctcggggttacgcagctcctcgacgcgctcggcaatttcctcggcgctaaagccgacctcggccatggcgtcctcgatgggcaggcggcgcacgatatagcagtggtgcaccttctggttgcgcgcgaagtcctcggggatggtctgtgccgtaatgtcctccagcaccacgcccgcgcgcgcgagcttgcgcgcctcggggcggaagccgcgcaggttgcagctaaagatggcgtggccgccctgtgcgagcaggcgcgatacgccggccaaaagctcaacatggtcgcgctggacatcccaggtgcggcggcccatcttggacgagttcgaaaacgtgggcgggtcgacaaagatcaggtcccagcggttgcgcgtctggcgctggtcgcgaatccaggcgagcacgtcgtcgcgcacaaaatgatgctgcggaccaacaaagccgttctggcgcatattgcgctcggcccagtccaggtaggtgttggaaaggtcgaccgtcacggtctcctcgacgccgccatcggccgcgtagcaggtggcagtgccagtgtaggcaaacaggttgaggaagcggcgcgcctgcttggcgtgctcgcgcactaggttgcgggtgacgcggtgatccaggaagatgcccacatccagatagtcgtcaaagttgacggcaaaggtaaggccgccctcttcgatgagtggcagacgacggcgtgcgatattggcgcgctcgcccgagccgcccttgccggcgccctgcttgccgtactgcgagccgccgcgcgaacgcatgcgggccttggcgtgcacatgctcggccggaacatcaaggatgcgcggcgcgatggccagaatgtcgagcatgcgggcctgggctagcgcggggtcgatggtcttgggcgcggcgtattcggcgatgacgagccagcggcccggcgtctgcgggcaaccctcgtacaggtcgatggcggcggagtagtcgggcaggtcggcatcgtagacgcggtagcagcttacgccctcgcgcttggcccacttgcggcgcaggcgcgcgttcttgcgcaggcggttggcgaactgctcggacccggggatgagcacgggcagcggcttgccgtcgcccaagtcgagcgtggcggcaggttcgggcatggaggaagcggcggcttcgtcttcgacgtccgtggactgttcctcggcgtttatgctggtcgcagcctcgaatgccgcggcggcgtggtcgagcgagtgccaaacctcaagagccgcctcctcgttattgggcatgacggcgatggagcgcgcgggctcggcatggagcgcgcgggccataaggccatcgcgggtgagcgcagcgaccggcgccgcggaaagctcgggcgcgcggcgcagctcgccgaccagcgtcatggcgtcgtgcatgagcgaaagcggggtctcggtggtgtctgcgaccacggcggcaccggcgacggcgcccgcatggtccagcacggtggcgggcttggcggcgcaaaagtcgacaaaacgcttgtagccagcgctcttgaccatgcgctcggcggtcttgcgagcggcggggtcgatgtctgcggccacgatgcgcgcctggcgttcgcgcgctgccgcctcgcgctcgcgcgcctcggcaagcagctgctcccacagagcggcgttgtgcagctgccagccctcaaagccccagcgctcgcgtgcggcgcccggggcgcggtcggtcagaatgttcacggcttccagcagcaggccgccgccggcgcacgaggcatcgatcagcgtgggaagggcttcattttcgtaatcgtcggccgtcagctcgcgctcgcatagcgcggtccagccgacctgcgccagcaccagggcggcgtagtcggggcgcagcacgtgcgcgccctcgccggcgcgggtcgctgcgggcggcaggcgtttgaacagcgggtcgcccgaaaggtctaggcttatgctcgcgcggcgctggcgcagcgaaagcagtaggtgaacatcggggtcggcggcatcgacatcggcgcgacggcccgtggtctcggccaggcggtcgcacagcgcgtctttggcgcgcagggccgagaaacgcgtgttgcgcagctgctcggtcacgccgcgggcggtgatggcaatggtggcgccggggcggacgatgttctcccaggcgatgtcgtaaacgctatcgtacagctcgtcggcgtcctgcgcctcaaagcgcccgagcaccgcaaacacgcggctcgccagacgcgaccacagacaggcgcggtagccttcttcgagctcgccctcaaacgtggcgcggcccttcagccggcgaacatgcgaaagcccgaggcgtttaagctcatcggcgagtgcggactcaaagccctcggggcagcttgcgtaaaattccatgggtgacctctctggttgcgtcgctccattatatgatggatgcttcgtttactctcgcccccgaaaggaacccatatgattgatgcgtgccccgattctgccgtgctcttttttgacgtggacggcacgctgacgtcgttcgatcccgacaacatgaccgacaaggacttttcggcggttcgcccctcgcaggcggtgatcgaggcgtttcatcgcctgcgcaatgcgggtcaccaggcatttatctgcacgggtcgtcccttgtggctgattgccgatggtctgcgtgctttggagcctgcgggtgtcgttgccatggcgggagcgacactcgaggtcgagggccgcgtggtacacgaggactgctttgacgaggacattgtcgaggagcttgcacgccgtatggccgcggcagggattgaggcctttttcgagaccaacgtggctacttttgccttggaacccgcgggcgttgagcagtcgtctctgatcggcacttctgtggtgcacagcgccgaggaaatgcgcgtcgacggcagtctgcgcgtgggcaaggtatgcctcaatgtgcccagtttggctcgcgtagccaacgatgacggctttatcgatcgcgagtttgagctgtgcaacaccggtggccagaatcgcgagctgagccccaagggcatcgacaagggcgtgggcgtggcgcgagcgctggaatacctgggtcgcaccggcaacgcgcgcacctttggctttggtgattccggcaacgacctgggcatgctcgctgcggtcgagacggctgtcgccatgggcaacgccatgcctgaggtcaaggcggtcgccgactacgtgaccgacgatgtcgcacacgacggcaccgtcacagcgatgcagcatttcggcctcatctaatgaatcccgcgttctgacgtttgctcaaactgcgactcttcgcttttgcatgctcaatcgatttatcaatccaaacactgaggtgtttataccgttcgccgagaagataaaaaaccgcagctcacgccttgataaacgtaggtaaagtgtttagcagtttaacgcccatgtgcaagcgaaaggaatcaggcagatggcaatcaaggtgttcgctgacggtgcaaacctcgagggcatgctcgacatgtacgagaacggcaacgttcagggtttcacgaccaacccgtcccttatgaagaagggcggcgtgacggattaccgcgcgtttgccaaggaggtcctgacccacatcaccgatgtgtccgtctcgtttgaggtctttgccgatgacgtcgagactatggaggtcgaggcgcgcgagatcgctacctgggccgagaacgtctacgtcaagattccgtgcgtgaccaccaagggcgagtccaccgccgagctggtgcgcaagctgtcggccgacggcatcaaggtcaacgtcaccaccatctttacgcctaagcaggttgacgagatggtcgaggccgttgacaccgagacgccgtccatcatctcgctctttgccggccgcatcgccgacaccggcgtcgaccccattccgtttatgacggagtcggtcaagaaggccgccatcaagcccaactgtgaggtcctgtgggcgtccacgcgcgagctcatcaacatttaccaggccgaggcctgcggttgccagatcatcacggtgcccaacggcatcctggccaagcgcaagaacatcggccgtgacccgtacgaggtctcgctcgacaccgtccgcggctttgccaaggatatcgcggcgctcggtttccatatcctgccgtaacgcgaacactggctacgccgcgggttgttcgccccggcttttcctttccctaccgctcacgcgcttcgcgggggtcgcgctaggcaaaggaaaggccggggctgccggcacgagcttgccagcaagttggcgcttggcttccatatcctgccgtgggcaaaggtacccccgcctgcgccgtgcaaaattgagagtattcagcaaggtaaaggcttttaccagttaaccgaagcacggaacagcccccgttttggctctgatgatgctaaaacgggggccgtttttgactttattgcctctgaggggcgttcggggcggcggaaattgcagaatactcgcgattttgcacgtcgcgagaggggggacccttgctttaggtggtttacttcccctgcaccatggtgagcgagatcttcttgcggtcgcgatcgaccttttccacccacacctttaccgtgtcgccgacgcgcaccacgtcgctcgggtgcttgacgaagcggttggccagcttggagatgtgcacgaggccgtcctggtgcacacccacgtcgacgaaggcgccaaagtcgacgacgttgcgcaccgtgcccttgagttccatgccgggctccaggtcgtcgatggaaagtgccgagcggctaaaggccacctcgggcgcgtcgtcgcgcgggtcgcggccgggcttcttgagctcgttgacaatgtcgatgagcgtcagggtgccgcagtccaggtcgcttgccagcgccgagatgctgcccaggcggcgctcgatgtcgggcacgccgccgcggctgagctcgcttgctttaacgccggcgcgttccaagacggacgtggccacctcgtagctttcggggtggacgctcgttgcgtcgagcgggttcttaccgccgctaattcgcaaaaagcctgcagcgttgagatatgccttgggtcccagcttggggaccttcttgagctggcggcgatcggtgaaggcgccgttttcctcgcggaaagccacgatgttcttggccacgctcggcgtgatgcccgaaacgtatcccagcaggctcgcgctcgcggtgttgacgtcgacgcccacgcggttgacgacgtcctccaccacgtggcccagggtgcgcgagagctcggcctggtcaaggtcgtgctggtactggcccacgccgatggactggggcggaatcttgacgagctctgccagtgggtcctgcaggcggcggcccaggctcatggcgccgcgcacggtgacgtccaggtcgggatactcctggctcgcgagctcggaggcggagtacaccgacgcgccggcctcgttaacaatggtgtatcgcagcccaggcgcctgctcggcaatgaactccgagacgacttcctcggtctcgcggctggcggtgccgttgccgatgacgatggtgttgacgccgtcctttttgacgaggcgggcgagctcgcgcttggtgccggcgacgtcgtggcgcggcttggtggggtagaccacgccgtggtcgagtagcttgccggtctcgtccatgacggcgaccttgcagccggtgcggtagcccggatcgagcgcgagcacgcgggcgccgcgcacagggcgcgccgagagcaggccctcgagattcttggcaaagacgttgatggcctcggtctgagcgcgaacggtgagtttggcgcgggcctcgcgctccagcgagggggccatgaggcgcttgtaaccgtcagcgatggcggcatcgaagatgggcgcgaagacgccctggcgtcggggccaacggctgctgaggcgcgctgtggcggcagcgccgtcgacgttcacgcgcacgcggagcttgccctcgcgctcgccgcggtcgatagccagcacgcggtggttgggtatacggcgcagcggctcatcatagttgtagtagggctcgtagggagtcttttcggcggggtcggtggcctcgacgacgatgtcggcggtgttttgcgtaaaggcgcgcaggtcggcgacgttctcggggtcttcggccaccgtctcagccacgatgtccgccgcgccggcgagcgccttctcgggcgtgtcgaagccggcttcctcgttgacgtaggccgcggcggtgtcgagcgcgctgcccttggccgaggcctgcatgatgatcatgttggcaagcggctccaggcctgcctcgcgggccttctgtgcgcgggtcatgcgctttttgcggtagggcttgtagaggtcctcgacacgctggagctgcgtggcctctcgaatctgctgctcgagttcgggcgtgagtttgccctgggcgtcgatgagcagaacgacgtcctctttacgctgctcaagattgcgcaggtaggacaggcgctcgtcgagtgcgcgcagggcgacgtcgtccatgccgcccgtggcttccttgcggtagcgcgagataaaggggatggtgttgccctcgtcgatgagcttgacggccgcctcgacgttggcggccttaaggttgagctcgcgggcgagctgggcgataagatccatgaaactccttgcggtaaaggtgcgtttgcagcacagagctaccaaggataccacccgtcccaaaagactgttttgggccgtgccacgaaaatgacctatctactacgtttaacccgtatgggtcgaccatcccccggttttccgaaaatacgcaagccgtctacctgcggtttttacttcgcgaaatttggcacggttgagggcgatcggttaaacgtagtagataggcgcatttcgtggcgaacgaatcaggccgaggtgcaaaatggcccctcgccccagaaaaatcgtcggaaaggtagcaaaatgccccgcgggcaggaggctgctcgcggggcaaagaagaggggcttgttggtggcggaccgaagggttcggcatggggcttctgccgcggtctgccctaaggcgttacagctcgacgagctggccggtctcggcggcctccttgatggcgttgagaagcgtgagcgtcttgacgttatcggcgggcgtcacgacgggctcgacctcgcggcggacaaccttcacaaagtgcttgagctgcatcttgtgcggcagcgcggggtcgactgccggaatctccatctgcagcggcttgtgccagttggaggcgccgtcgtaggagaactggtgcaggcggggcagcgaaagggcgcccttagttccgccgataaagtaggcgtcggcgtcgaagggacggtactgcgggtcctcgcgagcggtggcctcccagttccaggggctggcggtggcgtcggagatggtcatgctcgcaagcgcgccatcggcaaaacggacgttgaccacggcggagtcctcggtctcaaaaccgcgggcggcgctggactgcatgccctggacggcaacgggctcgcccagcaggtaacggagcaggtcgacgtcgtgcaccaggttgaccaggatcgggccggcacccttcttgcggcgccactcgacgtcgaagtactcgtcgttcttatagatcatgtagtggaagctcgacacggtgagcttgcccagctcgccggactcgatgatctccttggccttgttgacgaaggggttgtggcgacggtgctgacccacgagcacgggcacgccggcggtctcggcctcggcggcaaaggcctgggcatcctcgaggtcgttggagatcggcttctcgaccagcggcacaatattgcgcttcacggcctcgcgggcaacgcccaggtgcaggtcgttgggggtggcgatgatgacggcctcgggcttgacctcgtccatcatctgggcgggatcggtgaagaacggcacgccggcggcctcggccgtggcgcgggcgccctcaaaggcgtcggcgatggcgacgagctcggcctcgggctcctcggtgacgaagcggatgtggttgcgacccatggcgccggcgccgataacggcaatgcggacggggttgagctcagacatttcgactccttaatactgttggcgatggaatgcgacaaagggacagtccctttgtcgcattggcaattactaagcgggcttcttcttgctgtcggagaccatcatgtagacggtgagcacgacggcgatggcggcgatcacgatggcgccgtagaaggactgctggtaggcggcgctgccagcctcggcgtgatacagcacggcggtgatgggctggctgatccaggtggaagcggcatagcccaaaaacatgatgccgtagttgacgccgatgttgctggtgccaaaggcgccaccggtgagcggcgggtagatgacgagcagggcgccaaagctaaagccgagcagggcgagcgccacaaagaacatggcctgcgtaaagctcatcgacatgatgacgagcgcgacgatggtgacgacaaggctgatgagcagcgacttataggcgccgagcttgtcgatgatctgaccaaaggacagacggccgaccaggttggcgcaggtgttgacggagacgaccacgccgccgagggcgacggccgcggcgctcgtggggtcggcgaagagctggacggcggcgatggaggcaaccttgcccacgagcagggtgcccgcggtggcggcgaaggcgaaggtgatgatgaggacccagaaacgcggggtcttgaccatctcgcccggggtgaggtcgccgaaggtgccggcatgtgcgccacccttgggggcctcgaagccctcgggcagccaaccggcctcgggggccttcaggaacagggcggaggcggcgatcatcacaaagaagatgacgccgagcgccttaagggcgccaaagatgcccaggctcgggatgagcagcgaggcgagcaccggggacagcacggcggggccggcggtcgaagcggccagggtgatgccggaggcgaggcccttcttgtcgatgaaccacttttggccggtggtgagcgccgggttgtagcccaggccgttgccgatggcggcgacgagcgagaaccacaggtagaactgccacggctcggtgacggtgccggacatgaaccagcccaggccgtagcacacggcggcggcgataacgacgttgcgcgggccgatcttatcggagatgcggccggcgaagatgcccgtcacggccatgatggtctgaaagaccgggaaggcccaggtgagggcgctcgaccactcggggtagacggcgagcaggttcttgctcacgacggaatacagcgcgatggagctgatgaagaacatggtgacgcacgcggcggaaagcacgacggcgcgacccttgttggagttggtggaagccattggactctttctgatcgatacgggggaggagcgggcgtgtccgcgggacctccctgtcaggttggtttactggtcagtcggcttggcgacgccggactcatcggaccagagctcgacacccttgttcttaaggtagttgtcggcataggcgcgacggccgccgggcttggcggtgaggtcgcccatcatgttggagaagccgccgtcgaccttgatggcgtcgccggtggtgaagtccgagcgcgtggacgccaggaacatgacggcgttggcgatatcgctgacctcgccgatgcggcgcgtggcgatcagacggctgcggctcttttcgacctcggggtcggcgtagaagttggccgacatcggggtcttaacgaagcagggttcgacgcagttggagcggacgccgtaggggccccactcggcggcgagcatcttggacatcatgttgacgcccgccttggtggagctgtacacgcccgagaacgtctcgggggagtggctggcgacggtcgagatgtgcaccaggcgaccctggccggccttgatcatctcgcgaccaaagcgctgcgaggtgatgaagtaaccggtgaggttgacgttgagcacctgctcccagtcgctcagcggcaggtcctccatggcggcgaagcgcaggataccggcggtgttgacgaggacgtcgacgcggccgaagttggcgatggtggcgtcgacagcagcctgaacctcggcctcgtcggtggcgttcatcttgtaaccctcggcgtggatgccaaactcggcggcgaggtcggcggctgcggccttgaccttctcctcgtccaggtcgagcatgacgacgttggcgccattgcgggcgaactcgcggcagatctcggcgcccataccgccgagcgcgccagtcacggcgcagacatcgccctcgagcttaagccaattgctcataggaacttcccttcttgtgcctcccggtgggtcgctcccattaatcgacccacgtggttttcgctggttatcgtatgctttgcatttgcgcaggtgaattgcatatttgttagaattgcgttaaccgtaggtttacactgtgcgatgcagtttattctcaattgagcgtgtgacctgcgaaaacaaccccctgtggcaccatgcggtcacaggcgcgaaaacgggagattgacgtgtacgatcgacgactcgaggccatatcggctgccgcggagctgggaagcttctcgcgtgcggcggcaaaattgcgtgtgtcgactccggcgctcgtcaagcaggtgtcgggcttcgaggccgagttcggcatcacgctgttcgaacgctcgcactcaggcgttaaggtgacgccggccggcgcactactggtggacgacgcgcgctcgatcatgcggcagtccgaggacgcactgcgccgtgcccgacgtgcggcgggcgacggcggtgccgtgcgcctgggcgtgtcgatgatgtgtccggggcgccaaacgctttcgatgtggacgggcatccacgatctggagccgtcgctgcgatttgagattgtgccggtaagcgacctctacgacgagcgcgaatccgtcatgcgcagccttggtcgcgaggtggatgtagtgcagtcgagtttttcgacgccgcgctggggtgatgcctgccaaaagctccgcatcgtcaacgtgccgttttatatcgacgtgccgcgcacgagcccgctggcgcgcaagacacgcattacggtcgccgacttggagggcatgcgcctgcgcgtgctccgccacggcaacgacgccatggacagcctgcgcatcgacctgttggccgacggcggcgtggacgtgattgacgtggatagcttcgactttgcgctctttaacgaggcggaggaaaagggcgacgcggtgctcacctgcggcgcatggtcgggcgtgcacccggcctttgtgggcgtgccgttcctgtgcggtcgcgaggtaccggtctttctgcactacccgctcgagcccaccctccaagtccaaaaattcgtcaacgccatggcacaacttctcaaatagctatcgtgtcgatgattctttaattcccgtcctagaaaaatcatctggtagagttgacctcacgtgaattccagcacgttgcgtactacctgtgcttttgtcatttgggggagtgaacttgtgaatacttctgtcgccaagaaagccagccgggcggtgcgcctgctcatgatggtgctcacggcagttctcatcttcttcttcatcaatgttatgctgctcgtctccgatatccagggcacggcgcgcgtggtcaattacgccggtctggtgcgcggtaccacgcagcgaatcgttaagctcgaggatgcgggccagcctcaagatgacctgctcaaagccgtggattcatacatcaacggtttgcgttacggaagtgacgacctcaacctcgtccgtctcgacgacgatgagtatcagacaaagatgaccgagcttgcaaattattttgatgagctttgcgccgagatcagccgcgtgcgcgaagtcggctacgagagcaccgatatcatcgcgatgagcgaggagttctttggtatttgtgacgatgccacacgactcgcagaggactactctcaggagaaggcgtcggcgctcaactatctcgagggcttggtgatcatcgacatcgtgggcttggtggcgacctttgcggtcgaacttgttcgcgcggtgcgcactgccgcgctcaaccgcgagctgcagagcaaagtctatctcgacgaagccacgggactgcccaacaagaacaagtgcgaggagatcttggggcaggagcggcctgtctccgcggaggcgcccgttgcggtgtgcgtcttcgaccttaacaatctgcatacggtcaataacaacttcggccacgagaagggcgacgaatacatccgttcttttgcccagcagctggggtgcgtggcgtccgagacctgctttgtgggccgcgacggcggcgatgagtttatcgcggtgctgtgggatgccgatcgaactgctgtggagtcctgtctcgctcgggttcgtgcgaacgtgaacgagtattccgaggctcaccccgacatgcctatcagctatgcggtgggctatgcactttccagtgattttgatgaaccgcctacgatgcgcgagctcttttcccaggccgacaaaaacatgtacatcgacaagaaccgcgtaaagacagccgaggcagccgggccgcaacgcgaggaacggtaagcttgtaacaaagggcatagaaaagcctccgcagctcgtgtggctgcggaggctttattcgttgcggcgcattgtgtttgggtcgttgagatgagtcgatttgccccgaaagaggagggcattgaccttagggtcatgcccgacgaatgagcggcaaatcggccatctcggcgagccgaactactccagctcaaacgctccggtatagagctggtagtaatacccgcgcttggcaatcagctcgtcgtggttgccgcgctcgatgatgcggccgtgatccagacagatgatcgcgtcggagttgcgcacggtggacaggcggtgcgcgatgacaaacgtcgtgcggccttccatgagcttgtccatgccggcttgcacgatggcctcggtgcgggtatcgatgctcgacgtggcctcgtccaggatcatcgccggcggatcggcgacggcggcgcgtgcgatcgagatcagctggcgctggccctgcgacagctgggcaccgttgccggtgagcatcgtgtcgtagccgtcgggcaggcgggtgataaagtcgtccgcgccggcgagctttgctgccgcgatgcactcctcgtcggtggcatccagattgccgtagcggatgttatccatcacggtgccggtgaacaggtttacgtcctgcagcaccacgcccagcgagcggcgcaggtctgccttgcggatcttgttgacgttgatgccgtcgtagcgaatcttgccgtcggcgatgtcatagaagcggttgatgagattggtgatggtcgtcttaccggcaccggtggcgccgacaaacgcgaccttctggcccggcttggcaaacacggacacgccgtgcagcacctcgtggtcgggcgtgtagccaaagtcgacgttgtccatgaccaggtcgccacgcagcggcacgtactcgatctcgccggttgcgcggtgcggatgtttccacgcccacatgccagtgtggtggtcggcctcctcgagctgccaggtatcggggttcacctgagcgttgacaagcgtcacatagccttcgtcggcttcgggctcctcgtcgatgagctcaaagatacggtcggcgccggcgaggcccatgaccacggcgttgatctgctgcgagatctggccgatctgtccacagaactgcttggtcatgttgaggaacggcaccacgacggcgatggacagcgccatgcccgagatgctcaggttgggcacgcccagcgctaggaaaatgccgccggccagtgcgaccagcacgtagagcaggttgcccaggttcataaggatgggcatgaggatgttggcgtacatgttggccttctgcgagacctcgaagagcttttcgttgcgctcgtcaaaatcggcttcggcggcagactcgtggcagaatgccttgacgaccttctggccgttcatgacttcctcgatatggccctcgacaacgccgagctcggtctgctgcgcaataaagaagcgcgcggagttggagccgagcagcttggtcataaaggtcataaaggcgacgcctgccacaatgaccaggcacatccaaacgctgtagtacagcatgataaagaacaccgtgacgatgacgatggtcgtcatgagcaggttgggcagcgactggctgatcatttggcgcagcgtgtcgatgtcgttggtgtagtggctcatgatgtcgccgcgctggtgcgtgtcgaagtagcgaatcggcaggtcctgcatgcggttgaacatcttctcgcgcagcttctcgagcgagccctgcgtgacgatggccatggcgcggttccagaacagcgaggacaggatgccgacgccgtagatgcaggcgagggtggtcacgagctgtgcgatcttgggctgtgcagcttcccaatcgcccgactgccacgattcgctaataatctgcagggcgctctgaaggaaggtcgcgccgatggagttgatgatggcgcagagcaccacgccgacgacgacgaggggcaaaagcacggggtagaagccaaagagcgtcttgatgaggcgcgacatggtgccacccttgcggttgagcgcgcgctcggcggtcgttgccttactcatgtgcctcgcctccttcctgggtctgagcttgtgttgcggatgcctcggtgtcggcttcgacggcctcttcgccctcggcagacatcttgttctgcgaggtaaaggtctcgcggtagatctcgctcgtcttgagcagctcatcgtggttgccgatctgcgcgatgcggccgccctccatgacgatgatgcggtctgcatcctgcacggaactaatgcgctgggcgatgatgagcttggtcgtgttgggcagatagcttgccagccctgcgcggatcttggcgtcggtcttggtgtcgacggcgctggtggagtcgtccaggatcaagatcttggggcgacgcagcagggcacgcgcaatgcacaggcgctgcttctgaccgcccgagacattggagccgccctgctcgatccaggtgtcatagcccttggggaagccatcgacaaactcgtcggcgcaggccagatgtgccgcctcgcggacctcttcgtcggtggcgttcgggtcgccccaacgcaggttctcggcaatggtgccgctaaacagcacgtttttctgcagcaccatggccacttggtgacgcagagcgtccaagtcgtagtcgcgcacatccacgccgcccacgcgcacggtaccttcggtggtgtcgtacagacgggcgatgaggtttacgagcgtggacttggccgagccggtgccgccgatgatgccgatggtctcgccgctcttaatgtgcaggtcgatattgtcgagcgcctggcgcttcgcatgcgcggaatacttaaagctcacgtggtcaaagtcgatggaaccgtcggcaacctcgagcacgggctcggcgggatcggcgatcgtgggctcggcggccagcacctcggtaatgcggtgtgccgattcgtcggccatggtcaccatgacaaagatcatcgacagctgcatcagactcatgaggatttggaagccataggtaaagatcgaggagagctggcccacgtcgaacagcgtgccctgactcgtgatgatgagcttggagcccaggtagatgatgacgacaaacgcgccgttgacgcagatgttcatcatgggattgttaaaggcgagcagcttctcggcgcgggtgaagtccatctggacgtcgcgtgcggcggtcgcgaacttctccttctcaaagtcttcgcgcacgtaactcttgaccacgcgcatgccggtgacgttttcctcgacggactcgttaagggcgtcgtacttgcggaacacgcgggcaaagatcgggcgcaccttatagatgataaagaacaggccaaagcccagcagcggaatgatgaccaggtagaccatggcgacgctgccgcccatggcgtaggccatggcaaaggcaaagaccagcaccagcggtgcgcgcacggcgatgcggatgatcatcataaaggcctgctgcacgttgttgatatcggtggtcaggcgcgtgacgagtgaggagctcgagaactcatcgatgttggcaaagctgaacgtctggatcttatagaacaggtcgtgacgcaggttcttggcgaagccgcaactcgcatggctgcaggtgatgccggcagcggcgccaaaagcaagcgacgtcagcgcgatgagcaccaaaaagcccgcggtgggaagcatctcggctacggtggcgccgtctttgatggcgtcgatcaggttggcggtgataaatggaatcagcatctcgcagagcacctcgccaagcaccagcagcggcgtggcgatcgtgaccttcttgtaatcgcggatgcttcccatgagggttttaatcatccagttcctcccaggttgcgcggattttttcgagcatctcggcgagctgttcgcgctcgtcgtgagtgagggcactaaaggcctgctctctaaagcggatgcgggccgcctgctcaacgcgggccttttcccatcccgcatcggtcaggcggatggtgagctgccgacggtctttgggattgcgactgcgctcgataagaccgcccagttcgagcttggacagaatctcggaaagggaccccggcttgaggtcgaagtgcatgccgagctcctgttgggacagctcgccggtcggctgcttggcgagtaggcagacaataggcgccttgccagatatgccgccgccgtgaaaatgcatgtaatggccgcaaaaccccagcccattgaggattcgcttggcgagacggtctttgtcggactgggtctcgggctcgtctgctggccgtgaggggtcgccgccgggttcatgcggataggcgagtggttcaacacgcatatctaatcttcgctcctttctttagttaggtagtgaaattgttttgtgcctaaccaatttaggagcatgagaaatgaatgtcaaggtaccaaactagtggttacgcggttttaccaaaccgcgtaacggctcgacgctgcaaacccgccagagcggcaatctgcctttcaacttcggcggcatgaccagaaggtcaatgccgcctcgtttcaaggcaccttgctcactctggcgggttttcgctcatatgacccaatccgctgtcaagagccacaatggccccgccgaccgcttgcaatcggtcggcggggcctgccgttgaacccgtcccggtccgcccccggcatgtcgtcgacgccttcggctcagtctcatatccgcggataccgctccggcggcccgcaatcctctccttcggcggggctccccaagtctgactacgcgcatgcggccgctgccgcgcgcccagcgaaagcgggggtatccccgaaggctgcccggctcgccgggacgggggctatgtctattcggttgcctcccggcacatcgcgccgagggcccacagccacctcacgagctcggcggcggtggcggcgttcgccttcgcctggggcatgcccctggcgagcatctcctcgcggcgccggagcaggcgctcggaacccttcctcccgtgcatcctcacctcgagcgggacgccgctgcccttgggcatcagcttcggttggtggctcgcctggacgtagctccaggacccctcgacggccagcctcctgacgagggcgttgccggccccgctgatcccgccgaggcgcacggagttgttagcgtcaatataattttcaccatttccaccaacgcattttcgccaatcgcgagggcttcttcgggcgcctcaagaacgagttcttccactacagggactgggagggcgtgacggccgaggagttcatgggaaggctcgaggcctacctcgtgtactatcgtgaggagcggatcaagaagtccctcgggtggctgagcccgatggagtaccgcaggaagcttggatacgcctaggcgcggtccaagaaatcgtccgcacccccatagtagtagcattttgataaagcgatttagcaaaaacatcgcacttgacctgcttttttattgcagtggtatcttcataaggtaaccacctttacctaccgtttaccgccagttttagcacgtttaccaaaccgcgcaccctctgctcaagcctgcccaaaacccgccgtatagttccctcacggcccgcattcggcgggtcgattcgttaccacggtcgtgcgcgagagcgcatggaaggggaagtgtcgtgagcgattgcaagagggtttaccgttttggaaccgacgcccagggcacctgtgtcaccgagggcgacaagtccatgaacttcgcgcttggcggcaaaggcgctaaccttgccgagatgagccgtatcggcctgccggttcccggtggctttactattacctgccagacttgcgtcgagtactccggtgccggcaacgtgtggcccgagggtgcactcgatgagatcgttgctgccgaggcggacctcgaggcccgctgcggcaagaagctcggcgacgcctccgatccgctgctcgtgtcggttcgttcgggcgctccgttctccatgcccggcatgatggacacggtcctcaacttaggcctcaacgacgactccgttcaggggctcatcgcccagacgcaaaatccgcgttttgcttgggatagctaccgccgctttattcagatgttctccaacgtcgttatgggcgttgacgccgacctgttcgagaacgcgctgacccaggcacgcctggtcgccggcgtccgcgtcgactccgagctttcggccgaggatctgcaggagctcgtcgagacctttaagggcatcttctccgagaacgtcgatgcctccctgtatcccgagctcgaggtcgctgacggcaagcccgttttcccgcacgacccggagcttcagctacgccttgcaattcaggccgtctttggcagctggatgaacgagcgtgcctgcatctaccgcaagcagcatggcatttccgacgaactcggcaccgccgtcaacgtacaggccatggcctttggcaacaagggcgagacatctgcgaccggcgttgccttcacgcgcaatccggccgacggcaccaaggagttctacggtgattttttggttaatgcccaaggcgaggacgtcgtcgccggtatccgcaacaccgagcccatcgccgacctcaaggccaccccgggcctcgagtccgcaggcaaggagctcgagcgcgtcttcctgacgctcgaggatcactatcgcgacatgtgcgacattgagttcaccatcgagcagggcaagctctggatgctccagacccgcgtgggcaagcgaactgccaccgccgccctgcgcatcgccatcgagatggtcgaggagggtctgatcacccgcgatgaggctgtgagccgcatcgatcccgcgcagctcgaccagctcctgcacccacagttcgacgcctccaagaagtacgaggctctcgccagcggtcttaatgccagccccggtgccgccgtgggcgaggtcatgttctcgagcgacgacgccgtcgcgcgcgccaacgagggccacaaggtcattctggttcgttgggagaccaaccccgacgacctgaagggcatggtcgccgccgagggcattctgaccagccacggtggcaagacgagccatgccgccgttattgcccgcggcatgggtacgccctgcgtctgcggcgttgagcgcttccatatcgacgccgccgagaaggtcgtgcgcatcgagggcagcgaccgcgtgctgcatgagggcgatgtcatctccatcgacggcacccagggtatcgtcgtcgacggcgccgttgatctggtttcggccgagctcaccggcgacctggacaccatcctgtcctgggccgacgagattcgcctggacgagaccggcggccacgccaaccatgtgcgcgtcaacgccgacaaccccgaggatgccgcgctcgcgctcgagtttggcgccgaggccatcggcctgtgccgcaccgagcacatgttcctgggcgaccgcaagaacatcatccagagcttcatcctctccgatgatgaggccgtgaagcagcaggccctggcggacctgcttaaggttcagaccgaggacttcctggcgatgttcaagaccatgtccggtcgcgacgtagttgttcgcctgctcgatccgccgcttcatgagttcctggataatcctcgcgagctcgaggtcgccatcaccaagaaggaagccgctggcgccagcgaggaagagcttgccgtcctgcgtgcccgcctgcgccgtatcgatggcatggtcgagtcgaaccccatgctcggcctgcgcggcgtgcgcctgtccgttgtctttagcgatctgccactcatgcaggttcgcgccgtcgccacggctgccgctcgcctcatcaaggagggcgtcgatccgcgtcccgagatcatggtcccgctcgtctccatcacggcggagcatgtccagacccgcgaggtcatcgagcgcgtgatcgccgaggtttccgtcgaggagggcgtcgagctcaatattcccgtgggcacgatgctcgagctgccgcgtgcctgcatggttgccgacgagatcgcccatcatgctgacttcttctgctttggcaccaatgacctcacccagacgaccttcggcttctctcgtgacgatgccgaggccaagttcatcccgctgtacatgcacaagaagatcttgaaggacaaccccttcgagaccatcgactcggcggtgctggagctcgtgcgcatggccgtcgagaagggtcgcgccaccaaccccgacatgcactttggcgtgtgcggcgagcacggcggcgaccccaaatccattaagggcctgttcaacgtggccgatgtggactacgtgtcctgctcgccctatcgcgtgcccctcgcgcgcctggcggccgctcaggccaagctcgaggcgaagcgctccgcctaacgttttgggtttagacgcctagcgtagcccccttcatgccgcccgtctcattcgcgaggcgggcggttatcatgtgcgggttttgtctttttgtctgcgtaaaaaattgttcttgcagcagaaacccgcgcgtgtatactcgaatacgtttgttcaactacgtgccggccaaggtggtacggcacctctagaagagtaaggaattgcacatggattacatccgcgcaatcgagcgtcagcagatccgcgaggacattcctcaggttcgcgtcgccgacaacgtcaaggttcactaccgcattaaggaaggcgaccgcgagcgcatccaggtcttccagggcgacgtcatccgcatggccggcgccggtgcccgcgagaccttcactgtccgcaagatgtccttcggtgtcggtgttgagcgtaccttcccgcttcacagccccaagatcgccaagctcgaggtcgttcgtcatggtcgcgtccgtcgcgccaaactgtactacctccgcgacaaggtgggcaaggctgctcgcatccccgagaagcgctaagaagatcgcagcgtctgtccactcgtttggacgtaagggtcaccttcgggtggcccttctttttatctgatttgcatgcaaggagggcctggtatggccaatatgacgagctcggtttcggcatcgcaggttgccggcgagctggcgagtgccacgttcgaggagattcccgccctcgtggagcattatcgcgaggatccgcgccagcaggtgatcaaggcttgcgagcgtgcccttaagcgccatgccaaggagcttgccgagcgcgagcgcgtcaacggcatgtacgagcttatgcatgagctcggcggtgatggcgtggtcgtgggcgtcgacgaggtgggccgtggctcggtagcggggcccttgaccgtgtgtgccgtgtgccttccgatggagccgcgcatctggggcatcaacgattccaaaaagctcacgccggcgcgccgcgagctgctctcggttaagattgccgaggtggcgactgctatcggcttttgccatatcgctcctgcagatatcgatgagatgggtatggcccgcgccatccgcgctgccgttgcgggtgcggtggccgatacgggacttgaacccgactgcgtcctcatggatggcaaccccttgggcgccgttcccaatgagcgcgacgtggtgaagggcgatgccaagatcgcctgtatcgccgcggcatccatcatggcaaaggtcacgcgtgacgagatgatggtcgagtacgacgccgagtaccccgagtaccatctggccgaatcgaagggctatgcgagccccgagcacatcgaggccattcgaaaacatggactttgtccactgcatcgtgtgagcttttgcggaaactttctgcagactgagcgccttttctaggtcaattgtggagacagggacctctagggttttataaacctgctggtagcgggccgtatgcaacagcattgctgcgtacggccctttttttgacggcatttggtcagcttttggtttgcttcctgtacttacccgcatgaaaggtgccctcatcatcggggcaatgcagtgtgcgggaaaggagaccccatgagtgccgcaagcaaaaagagcaagacgcagcagctcaaggagcgttgggaaaacggcgagctcgactgcggggcgatgacgcccgagtttatcaagggactcagtccccgtgagctgggcatgctgggcgagctgatcaccatcgactactttaacgagcgcggctacaccttgctggagcagggttatcgttgcaccgagggcgaggccgatctggtgctgctcgatgagcttgacgatgtcgtggtgatggccgaggtcaagaccaggcgcgtcgccctggattgcaccacgcgggtctttcccgaggaggccgtggatgcccaaaagcagcgtcggtatcgccgtatcgcaagttgctatctcatggagcactatccgctcaaggcgatccgcttcgatgcagtgggtgtcaccattcgcggcgggcatatcgccgagatcgagcatcagtacaacgcgttcgattggcaggtgtcgtgatggcgttcgagacgtttgccgttcacgcggcctgcatccgcggcgtcgaggcgattcacgtcacggtcgaggtctcgcttgccggcggcgttccgggcattcagatgctcggcatcccgagtatggaggtgatggagtcacgcggtcgtattcgctgcgcgatgcgctccgccgggttcgagatcccgcgctcgggcattaccgttaacctggcacccggcgatatccgcaagaccggtagcggctttgacctgcccatcgccatcgcggttctagcggccgatgagcagattccccgtgacaacctcgatcgctgccttatcgcaggtgagcttggtctggacggtacggtgcttcccgtcaagggcgaggtggcgtttcagctattggctcgcgacatggggctgtcttttatcgccggcaggtccgaccagcatgtgccactcgcgggcgtagattgcggctttatcgaccatctgtctcagcttgctcacggcatgggcgatgccgcacggcactacttggattccgagggtgtcgaggcgacctttgagcccgagctcgactatgcagacgtgctggggcaggaagtcgctaaacgcggcatggcgcttgcggccgcaggagaactcggcttgctcatgatcgggtctccgggatcgggcaagacgatgctcgcacgccgtatgaccggcatcctgcccgagctttccgttgaggatcagcaggaggcactgtgcatccattcggttttgggtgagaacattgatggcttgttggcggggcaccgccccttccgcagtccccaccacagtatttcgaccgcaggccttatcggcggcgggcgcccggtgcacccgggtgagatcagccttgctcatggcggcgtgctctttttggacgagcttgccgagtttcccactggcgtgctgcagacgctgcgtcagcccatcgagcgtggctacgtgaggatcgtacgcgtcgacggggcttttaccttcccgtcgcgctttcagctgctggctgcgagcaatccctgcccctgcggctttttgggcgatcgcgaggtaccgtgtcgctgctcggcggcgatggtcgagcgctatcggtctaaactgcgcggtcccttggccgaccgtatcgacatgatgatcgatgtgacccgtcccgaccctcaagtgattatcgagggtgcggagggtatgtcgtcggccgagttacgtgactacgttgtgcgcggtcgtgcctttcgcgcctggcgcgagttccgtatggacgatgcggatgccgaggccgaggatgacgagacgcggtctattgacggcgtcgtttcgaccttcgagctcgatgatgctgccgagaaatgcgtacttggcctatccaaacgcacgcatctcacgggccgcggcatcgtacgcctggtgcgtatcgcgcgtacaatcgctgacgtcgccgagagcgagcaagtgacgcaggaccacgtgctcgaggcggcgatgtaccagggaaggagggaccaatgatagctgaggggaccttcgagctgcatccaggtgatgcgttgtatcccgagagcgttttggagctatctgatgtaccccagacgctctatgtgcgcggcaaccccgaggtgctttcgacgcccgcgctctccatcatcggtgcgcgaaaggcctcgccgtatggtcttgccgtggcagagcttgcggcgaaggtggcggttgaggcgggagtgacggtagtttcgggcggtgcggtcggttgtgaccaggcctcgggttgggctgcggtcaacgccggcggcaaacacgtcgtggtgctggggacgggcgccgacgtggtctacccgcgttcgagcgcggggcttattacgcgcacgctcgatacgggcggcgcggtcgtgtcgatctctccgtggggcatgggtccgcgcaagtttgcctttccgcgtcgcaatcgcgtgatcgcggccctgtcgcaagccctctttgtatccgaggcgggtatgccttccgggacgttttctacagccgaggctactatggatttggggcgcgaacttcttgccgtgccggggtcgatcctatcgcccgagtcgcgtggcacgaattacctcattgcgaacggtgcctgctgcattgtcgacgaggagtccatcgagatggctatctctcgcatatacggcaccctgcgctactcgcgccccgatgctcccggcattgccgacctgaatccaacacagcagaccgtgatgcatgcgctcatcgcctctccgctcaaggtcgacgacatcgcggcgctcgtctcactcgatgctgtcggcgtactcaaactcttgggttcgcttgaactcgagggccttatcgagcgcatgatggatggaaggtatgcgccctccaagtttgcccttcacgcccagacgcccttcggtcacaatggaaaacgtgtcaattagaaaggtgtttgtagatgcagttcgatcaggtgacggttatcggtggcggtctggcgggttcggaatgcgcgatccagctggcagaccgcgggtttgccgtaaagctgtgcgagatgcgcccccaggtgagctccccggctcaccataccgatcacctggcagagctcgtctgctccaattcgtttaagtcgacccgtccggattccgcggctggtttgctgaaggccgagcttgagcgcatgggttcagtcctgctcgactgcgcccatcgcgctgctgttcccgctggtggcgccctggcggtcgaccgtgttacattctccgagctcgtcgaggctgaggttgccgcccgccccaatatcgaggtcgttcacggcgaggtcacccagatccccgagggccacgtggtcattgccgcgggcccgctgtgttcaccggcgctgagcgaagaggtcatgaagctcgtcggtggcgacgcccttgcgttcttcgatgccgcggcgccgatcgtcgatgcctccacgctcgatatggacgtgctgttttcgcagtcgcgctacgaggagcaggggagcggcgactatctcaacgctccgctcaacaaggaggagtacgaggcctttatcgaggcgctcaccacggccgaccgcgtggtgctcaaggactttgagggcggcgatctgttccaggcctgccagcctgccgaggaggttgcgcgcaccggcaaggacgccattcgctttggcgccatgaagcccgtcggcctcaccgacccgcgtaccggacgtcgcccttgggcggcgattcagctgcgtgccgagaacaaggagaagaccgcctataacctggtgggcttccagaccaacctgacctttggcgagcagaagcgcgtcttccatatggtgccgggcctggagaacgctgagttcttccgctacggtgtcatgcaccgcaatacctttgtcgacgccccgcacgtgctcgatggcacctttgccgtgcccggtaccggcgtgcgcctggccggtcagatcaccggcaccgaggggtacatggaagccgtggcgaccggtctgctcgcggcgctcaacacctatgcagaggctatcggcgccgattccgtcgagttgccccgcgtgggcgccctgggcgcgctcgtgggctatgcgaccgatcctgccaccgtgggctaccagcccatgcatgtcaactttggcctggtgccgccgctcgaggacggtaagcgtcgcagcaagcgcgaccgctaccaggcctatgcggaccgtgcgcttgaggcccttgatgcctatctggccactcgccccgatctgtttggaggcgaccggtcatagcctttgacctgtacgatgccgtcgactcgtttatcgcctatatcgcacgtgtcgagggactttctcccaacacggtgacggcctatggctcgaggctggagcgctttgcttcctggtgcgagcgcgaggatatcgatgctttcgctgccgacgtgcgcaccattcgtcgctatcttgccgagctttcgcgtgaacaggtggctccccgaacgcttgcggcgcatctgtctgccattcgctcgctctatcggtggatgactgccgaggggattatcgagggtgatgcggtctcggcgatcgcatcgcccaagctgccgcgcgacctgccgggcgtccttacgacccagcaggtcgaggcgctgctcaagacgcctgatacctcgacgcccgcgggactgcgcgatgcggcgatgctcgagctgctctatgcctcgggtgctcgtatctctgagctcgcagcactcaatgtggagtccatcgcttggtccgaatgcacgctgcgcctgtggggcaaggggggcaaggaacgtatcgtccctctgtatcgtcgtgcgctcgaagtgacgcgtctctatattgaggaggggaggccggagttgctcgctcaggcaaagcgccgtgacctcgctaccgggccgcatccgctgcttgtatcggcgcgcggcaaccgcatgagcgccgccatgctccggcggcggttccatacgctggcgacgcgcgccggcattccggccgacatcgccccgcatgcgatgcgccatacctttgcgaccgacttgctcgagggcggtgcggacctgcgctcggttcaagagctgctgggtcatgcgagcctgtccacgacgcagatctacacgcatctcacacccgatcggcttaagcgggctgtggctcaagcccatccccgcggcgaatagtggctgggacgtcccgcgccgcactcaggtgtgtggttttgattgcgggttggcaggaggaagcattcctgctatcattcatcgggttgcttcacggcaacatgtttttatcacgcacgcgcggctacttcataccgtggtgcccgggctttggtagcacatgtccgggttggttttggaggatgaccccgcgcggaggcaaaccacaggaggtttaacatggctaccaagattaatatccgcaccctgctcgaggccggctgccacttcggtcaccagacccgtcgctggaaccccaagatgaagccgttcatcttcggtgagcgcaacggcatctacatcctcgacctcaagcagaccatcctcgacgccgaccaggcctacaccttcgtcaagaacgtcgccaagggtggcaacgtgctgttcgtcggcaccaagaagcaggctcaggaggccgtcaagaacgctgctgagcgcgccaacatgccttacatcaaccagcgttggctcggcggtatgctgaccaacttcgtcaccatccgctcccgcatcaaccgcatggaggagctcgaggccatggtcgaggacggccgcatggctgttctgcccaagaaggagcaggctgtgctcggcaaggagctcaccaagctccagaccaacctcggcggcgcccgcgacatgaagggtctgccccaggctctcttcgtcatcgacaccaagcgcgaggagaacgccatcaaggaggctcagcgcctgaacatccccgtcgtcgctctgatcgacaccaactccgatcccgacgaggtcgagtacggcatcccctgcaacgatgacgctatctccgctgtcacccttatgtgcgagctcatggctgacgcctgcctcgctggctccggcaaggagcaggtctccgaggccgagatggccgctgagcccaaggccgagtaaatcagtcttagttaattctttttcatctctttgaaaggaaccacaatggcccagattaccgccgctatggtcaagcagctccgcgagatgaccgactccccgatgatggagtgcaagaaggctctcgtcgaggctgacggcgacatggacgccgctgtcgacgttctgcgtaagaacggccttgccaaggctgccaagaaggctggccgtgagaccaacgagggcgctgtcgccgcgttcgtctccgaggatggcaagaccggcgctctgctcgagctctcctgcgagaccgacttcgttggctctaacgccaagttcaccggctttgcttccaaggtcgctgaggttgtcgctaccaccgagcctgctgacgtcgacgctctgctcgagaagccgatgggcgaggagaccgtttcctccgagctcaccgagatgattcacatcatgggcgagaacatgaagatctcccgcttcgctgcccgcaaggctgagaacggagcgctcgcttcttacatccacatgggtggtaagatcggcgtcctcgtcgagttcgccttcgagaaggctgagaccgctcaggctgaatccttcaagaccttcgctcacgacgttgcccttcaggttgccgccgtcgccccgatctgcgctacccgcgatcaggttccggccgagaccgtcgagcacgagaagcagatctacatggctcaggctgccgagtccggtaagcccgaggctatccaggagaagatggctgtcggccgtctggagaagttctacaagcagtccgtgctcaccgagcaggagttcatcaaggacagctccctcaccatcaagaagtacgctgagcaggtctccaaggagctcggcgacaccattaccgtcgttgcctttgaccgtctggtccgtggcgagtaaataagctcttgtagctggtaatgagcaggctgtgggttttactcacagcctgctttttcatggctcttatcagagcctttgatatcatattgagagtctaattaaaggaggatcgctttgtccgacatccgatataaacgcgtgcttcttaagctttccggcgaagcactgatgggcgacggccaatatggcatcgaccccaaggttaccgaccatcttgccaagcaggtcaaggagctgctcgccgttggccatgaggtcggcgtcgttgtcggcggcggcaatattttccgcggcatggcaggcgctgccggtggcatggagcgtgctcaggccgattatatgggcatgctcgcgaccgttatgaacgcgctcgccctgcaggatgccttcgagcacaacgatgttccctgccgcgtgatgagcgctatccagatgaacgagatctgcgagccctatattcgccgtcgcgccatcaaccacctttccaagggcaacgtcgttatctttgccgccggttcgggcaatccgtactttacgaccgacaccgccgcggctcttcgtgcgtgcgagatcggcgccgagattctgattaaagccaccaaggtcgacggcatctatgacaaggaccccgtcaagtgtgccgacgccgtccgctttgacaagatcacctatcacgaggttctcgtccgcggtctgcaggttatggattccacggctacggcactgtgccaggataaccgtatgccgattttggtcctcaacatcgatggcgaggacaccgtcaagcgcgcgctttcgggtgagcccgtcggcacgctcgtctatcaggaggattaagcatggcagagaacatcaccgcccatatggacaagtcgctcgagtccctcaagcataacttctccaaggtccgtaccggccgcgccaatgccaacattctgtccgacatcaccgtcgattattacggtgttcccacgccggtcacgcaggttgccgccgtcaagacccccgaggcccacatgctgctcatcgagccgtgggacaaggcgctcatcaatgctatcgtcaaggccatcggcgcttccgatctgggcattacccccaactccgatggcaccgtcgttcgtctgccgttcccggctcccaccgaggagcgtcgtcgcgagctcgtcaaggagtgccgcgagtacgccgagcaggccaaggtgtctatccgtaacatccgtcgcgacttcaacaacaagctcgagcgcgatgaggagctcaccgaggacgatgtccgtcgcgagcaggccaaggtccagaagcacaccgatgagtatgtcgccaaggtcgaggagcttctgaaggaaaaagaagccgaggtcatggagatctaaggtgcaatacgacgagcataaactggtcgagtactttgccgacgcccccgcgggcgtcggtttttccgaccttgacctcaataacattccgcaccatatctcgtgcatcatggacggcaacggtcgttgggccacatcgcgcggtcttgcacgcaccgagggccacaaggcgggtatcgtctcccttcgcgagattattaccgcctgcgtgcgtctgggcgtcgacgtgctttcggcctatgcgttttctaccgaaaactggaaccgcccgcagcatgaggtcaacgtcttgatgcacctgtttgccaagacgtttatcgacgagctgccgcttctgaagcgcgaaaacgtgcgcgttatctttttgggtgacatttccgcgctgcccaagaagacccgcgacgtttttgaacgcggtcttgccgagtgcgccaatcacaccggcatgacgctggcgcttgccgtcaactacggcgcgcgtgccgagattacccgcgctgtccgtcagatcgcactcgacgctgccgccggtaagatcgatcctggcgcaattgatgacgacatggtggcttcccacctctataccgccggcctacccgatcctgagcttgtgattcgcacctctggtgagcttcgcctttcgaactacctgctgtggcaggtggcttattcagagttctacgtcaccgatacctattggcccgactttgatcgttggggccttgtcgacgccattttggcctatcagggccgtgaccgtaggtttggtggactgagcaagaccgaggaggcttaatcgtgtctgatcgtcccaaggcatctgctcccaagacgcctgcgcgcaaagctgccactgcgggagcgcctgcagcgaagagcggcaccggttcgtggctggcgggctttattacccgtgccgctgccggtatcgtctacgccgttgtctttatcctgtgcttggttttgggtattgtgcccacggccatctttgtttctgtcatgagcggtctgtgctgctatgagtttttccgtatgacgaggctcgatggcaagatggctaacgagcgcatgggtatcgctgccgccgtactctttccgctgtcggcgttgggcgattcaatgttgctgaatgccctgctttttgccctgatgctcgctgtgggcatttggtatgtctggtcaccgcgtacccgcatctctgatgtggccgtgacgctcatgggtcccatctacactggctttatgctgtcggctatcgtgctgctgcgcgatgccgtgcccggttttgccggcgccctgctttcggtgggcgtttgtgcgtccctttgggtctccgattcgtttgcctacatcgtgggcagccgtatcggtaaacacaagatggttcccaagatttctcccaaaaagagctgggaggggtttgtcggcggcatcctgggctcggttttgatttggctcatcctgtgggcgacgcatttctacaagctcagcctgccctatgcgctgctgtgcggcgtggtcgtgtccattttgggcgttatcggcgaccttatcgagtctcgcatcaagcgcggtgtgggcgttaaggattccggtaaccttatcccgggccacggcggcatgctcgatcgtagcgattcgcttatcttcggctgcatcacagcgcagctgatgctgatgatcggaggcgtgctgtaatgtcattccagacgacgtatggctccgatggacgtctccgtgttgccatcctgggctgtacgggctctatcggcactcaggcgctcgatgtgtgccgtcagcatgccgatcgcctgcaggtgacggcgctatccgttaactccagtacctccgagctcgttgccgctgcccgcgagttctcggttccggcggttgccgtggccgatgtcgctcatggcgatgacgccgtgctgcaggagttgcccgagggaacgaagctcggcgttggcgcgcaggcggtttgcgagctcgcgcgtcgcgacgatgtcgactgcgtgctcgtcgctattgtgggtgccgccggtctcgaggcgagccatgcggccttgacctcgaataagcgtcttgcccttgccaacaaggagtccctcgtcgtcggtggcgacttgcttatgccgttggcgcaaccgggccagcttattccagtcgactctgagcactccgccatctaccagtgctatctgggggagagcccgcgcgaggctcattgtatttggctcacctgctcgggcggtccgttctttggccgcacgcgcgacgagctagatcgcgtgacgcgtgccgatgccctcgcacatcccacgtgggccatgggtgctaagatcaccatcgactccgccaccctcatgaataagggcttggagcgcattgaggccatgcatctgtttaactgcgacctcgatttcattaacgtggtcgtgcagcgtcagtccaagattcactctatggtcgagtttgccgacggctccgtgatggcgcatctcggtgcttccgacatgcgtattcccatccagttcgcgttctcgtatcccgagcgttgggataccccggcgcctcgtatcgatttccgcgagctggggcagctcacgtttgatgctgccgacatgaataccttccgctgcctggcgctggccgagcgtgccggcaagacgggcggcaccatgccgtgcgtgcttaatgcggccaacgaggtcgctgtcgatgcgttcttacacgacggctgtagctttaccgatatcgaccgcgttgtggaatcctgcatggatgcgcatgacacacaggcggttacctcgtttgagcagcttcgcgacatcgatgcctgggcgcgcgaaaaggccgctctggtgctcgccgcaacccattcctaaccataaggatttctttttcgatttatggatactgttctgagcgttctctcatcggtcttttggggccttctgatgctttccgtcctcgtgtttttgcacgagggcggccactttttggcggcgcgtgcctgcggcgtccgtgtgaccgagttctatttgggcctgccgtgccgttttgacatccatcacacgtcgcgtcgcatcggaaccaagtttggcgtgacgccgctgctgctgggcggctatgctgccatctgcggcatggatcccacggacgtctcgtgtgccgattgcgtgcttgcggcaatctatcgtcacggtcgcgtgaccgtggccgaccttgccgccgagctcgaactgcccgaggaggacgtactcgaggcctgtgccttgctgctggggtggggttccatcgctccctggtacgaggagggggagaaaccctcgccgagttattaccccaccaagtaccagacgctgccgcgcgatgctgcaggatataccacctttgacggtcgcaagttcgatcgagagcatgcgactgccgagggcgatgtatgggaactgccgtgcggcgaggctgaattcctcgcacgcgagcgctcgcacacctatttgggccaaggctttctcaagcgagcctttatgttgctcgcgggcattgtcgtcaatatcctgacgggctttttgctccttatgagcatctattccatcgcaggtgtcgcggtgccgttggataccaatgtgatcggtcaggttgacgaaggctcgattgccgccgcggcgggaatcgagggcggtgacgcgatcctttcggtcgacggagtatcgtgctctacctggatagacgtttacgacgccatcggcaaggctgccggtaaggacgatatcgccatcgagtacgagcgtgatggcaagcagcattcgaccacggttgcactcaaagaggacgagcgcctaggtgtgtacgcctctacgcaggtggtccgtttggaccccatcacgtcggctcgcctgtcgttctcctatgtcgtgcagacagcggagggcgtgatgcgcctgctccagccgcagcacacgatggagattctcgaccagtcctcttcgatcgtgggtattagcgttatgtcctcacaggctgctgctgccggtcctgccacgttcctctcgtttgccgccctcatttcgttctcgcttggctttatgaacctgctgcccatcccaccgctcgatggcggcaagctggtcatcgagatcattcaaaagattgcgggccgcgagcttccgctcaaggtccagacgattgtgagctatgtgggcatcgcgctctttgcgctgttgtttgtctatatgcttcgttccgacgtccttcgatttattttgtaggggagtgtttggattgtctttatcccatcctttgcctcgcgagctgacgcgccccgtgcatgtgggcggcgtgcagatcggtggcggcgcgccggtggtggtccaatccatgacctgcaccgataccgctgatgcccaggcaacgcttgcgcaagtgcgcgcgttggcgcaggctggctgcgatatcgtgcgcgtgagcgtgcccaccgaggccgcgcttgagggtttccgcaccatctgtgccgagtctccggtgccgattgtcgccgacatccactttaaccataagctcgccattggtgccgtcgaggccggtgctgccaagctgcgcatcaaccccggcaatatcggcgattgggccaaggttgacgcggtgatcgatgctgcgggtgccgcgggctgcgcaattcgtatcggcgtcaatgccggttcgcttgagcaggatatcgccgagcgcgaagacctcacgcagcccgaaaagctcgtgatgtcgagcgagcgtttcgtcaagcattttgaagaccgcggctttacgaacattgtgctttcagccaaggcccacagcgtgcaaacgacgctcgatgcctatcgagccctgtcgcgtgagattccccacgttccgcttcacctgggcgtaaccgaggcaggtaccaagctgcagggcaccatcaagagctcggtgggccttggtatcctgctgtctgagggtatcggtgacaccatgcgcgtctcgctcacggccgatccggtcgaggagccgccggtcgcctggggcattttgcagtctctgggcctgcgtcgccgtggacccgagattgtctcgtgccccacgtgcgcccgctgccaggttaacctgattgcaatcgccgaggaagtaaccgagcggcttaagaactatgccgcgccgctttcgattgccgtcatggggtgtgccgttaatggccccggtgaggcttctgatgccgacctgggcgttgcttgcggacgtggtcaggctctgctcttttcgcatggccagatcattggtaaagtagctgaggaccaaattgtcgacgcgcttatggccgaggtcgacaagcttattgaggagaaataaatgacccgagcaatgtatatgtctaagctctatgcgccgacgctcaaagaggatccggccgacgccgagcttgcaagccatcgtctgctgcttcgtgccggtatgatccgcaaggaggccgccggtctgtattcctatctgccgctcgcttggcgctcgattcgtaagatcgagaacatcgtgcgcgacgagatggacgccgccggcgcccaggagctcatgatgcccattatggtcgatgccgagctgtggcgtgagtccggccgcatcgatgcctatggcaaggagctcgtgcgctttgacgaccgtcatggtcgcgagtttgtgctgggccccacgcacgaggagaccgtcacggccctggtgcgcaacgagctgcgctcctataagcagctgcccgtcaacctgtaccacattcaggacaagttccgtgatgagttccgtccccgctttggcctgatgcgcggccgtgagttcatcatgaaggacgcctacagcttctctgccacgcaggagagtctgcaggaggagtacgacaagatgaagcaggcctacgccaacatctgcgagcgctgctacatcaaggctctgcccgtcgtcgccgattctggcgagatcggtggcgatacctccgtcgagtacatggctttggctgacgccggcgaggcttcgctcgtctactgcgacgattgcggcttcgctgccgatgacgaggctgcaagcaccaaggtcgtcgtgaccgagggtcctggtgacggtacgctcaccaaggttgagactccgggcatgggcaccattgaggctgttgctaagttctttgggttccccgagaacggcacgcgcaagtcgctggcactcatcgacgccgagggcaagccggtcgtggccattgttccgggcgatcacgagctcaacgattgcaaggccgagcacgtctttggcaagggctatcgcatgatgaccgacgaggagcttcaggcgaacggtctgcacaagggctttatcggaccggttaacctgcccgatggcattcgtctggtgtgcgatgagagcctgcgcgagtccaagcagtgggcctgcggtgccaacgaggtcgattatcactttaccggtgcctgccccgagcgcgactttaccgtcgacgagtgggccgatctggtcaccgtcgtcgccggcgatccctgcccgcactgcggcaagccgctctctgctgctcgcggcatcgaggtttcccaggtcttccagctgggcaccaagtactccgaggccatgggtgctacctttatggacgaggacggcaaggagaagccgcttatcatgggttgctacggcgtgggcgtgtctcgctcgctcgctgccgtcgtggagcagcacaacgacgagcatggcatcgtctggccggtctccgttgccccgtacgaggttgcggtgattccgctcgaccccaagaaggaggagtgcgctaccgtttgcgaacagatcgttgatggcctgtgcgccgagggtatcgaggttgtcgtcgacgatcgcgatgagcgtcccggctttaagtttgccgacaatgaccttatgggcttcccgtatcaggtggtgctcggcaagcgtggccttaagaacggcaccgttgagctcaaggaccgtgccacgggcgagcgcgaggacgtggcgatcgacgaggtcgtcgccaaggtcgccgagcttgtgaaggctgcccgccgttaatcggcgatttcgcttgtagttcgatatacgggacggccccgcatttctccagataggggagatgcggggccgtccttttatcttgtcggcgcgctcaatcgctaaaaggaaaaaccccacagcccatgcgagctgcggggttttcctttgtgcctccgatgcgaaatgaatcgctcagatattactgataatcgacgacgtcgatccagttcttaaggaactcatcgttcacgttgcgcttacgagcgagctcggaagcggcaacgatgctcgtccactgacgcacgacctgcatgggcatgtcggcgcggtcgcagtagagctccaggtaggcctcggcctgatccttgctgttgagggcaaagagcaggtaggtggtggcaacgtcggcagcaggggagccctgggtggcgtgtgcccagtcgcagacgtacagctgaccgtcgtcgccgacgatgacgttggaggggttgaagtcgccgtggcaaaccttgaactccttggtcataccgtccagacgctcctgaaggttgtagcgcgtggtggcattgagctgatcaaggctgtcgatcatgcgggcgaacttgtcgcgctgacggttgagcagcggggaggtgtagccgtggatctcgatctggaggtcgacgaacatctcgaggtactcaccgaagcgctggggctcggcagtcatcttctcggcaagggtagtgcccggaaccttctcggtcacgagcgcccagccgttggcgttctcgagctgggaaacctcgagagccttggggctgcggatgccgcactcattgatgcgggcaagattcaaagcctcgttgaacacgtcggagacgggcttggtctcgttaaagaccttgacgatcttgtcgcccaggtcgtaaacgaccttgttgccacggcggacgagctcggtcttggaatcgggtagcagcatggttgcatcctttcaacgatgcgatagaagcgacggcgggggtgtgtgaaacacccgtgcacccccgccgttaaaaaccgtgctagaactagcagacggcgtaatcctgaggctctcggccgtagtaggcgtccaggtagagctccttgatctcgctcatgagcgggtagcgcgggttagcgccggtgcactggtcgttgaatgcctgctcggtcatctcgtcgagggtgtcgaggaagtacttctcgtcaacgccgtactcagcgatggtgtgcttgacaccgatgaagtcgcagagctcggtgagcttggtgatgaagttctcgaagacctcacggtcgtccttgccgtcgatgccgcagtaacgagccatctcggcgtagttgtgcagcgcgttggggtaaggatactgagagaaggttcccatcttgacaggagcctcggcggcgttgtaacgcatgacgcgggtcaggatgacggcgtttgcgaggccgtggggcagatggtggaaagcgccgagcttgtgggccatggagtggttgaggcccaggaaggcgttaccgaatgccataccggccatgcaggatgcgttgtgcatctcctcgcgagcgtgcggatccttggcaccgttggtgaaggagctcgggaggttctcgaagacgagctttgcggcgcgctcggagaggcccttggtgtaatcggaagccatgatggagacgtaggactcgatggcgtgggtcatgacgtcaataccggaagctgcggtgaggcccttcggggcggtcatgcagttgtcggcgtcgacgatagccatgttggggagcagcgcgtagtcggcgagcggccacttgatgccggtctccttgtcggtgatgatggcgaacggcgtgcactcggagccagtgcccgaagaggtcgggacggcgacgaagtaagccttcttgcccatctcggggaaggtgaagatacgcttgcggatgtccatgaagtccatggccatgtcctcgaagttcgcctcggggtgctcgtacatcatccacatgatcttgccggcgtccattgcggaaccgccgccgacggcgatgatgacatccggctcgaagagcgtcatctgcttggcgccgcgacgtgcgcactgcagggagggatcgggctcaacgtcgtagaagcagtcgtgagcgatgcccatctcatcgagcttggcctcgatggcacgcgtgttgccattcttgaagaggaactggtcggtaacgatgaaggcgcgcttcttgcccattacggtgccgagctcgtcgagcgcgacgggcgtgcagcccttcttgaagtagaccttctcgggtgcgcggaaccacagcatgttctcgcggcgctctgccacggtcttgacgttgatcaagtgcttcaccccaacgttctcggagacggagttgccaccccaggagccgcagcccagggttagagacggcttcatgccgaagttgtagaggtcaccgatgccgccgtgcgaggacggggtgttgatgacgatgcggcaggccttcatgacgtgctggaacttagcgatcttctcgctctgtgccgggtgcacgtagagagaggcggtgtggcccgggccacctgcgaggacgaggtgctctgccttgtcaacggcctcctggaagtccttggcgtgatacatagcgaggaccggggagagcttctcgtgggagaactcttccttctcgggatcggtggaggtgacctcggcgatcaggatcttggtcttggcgggaacctcgatgccggcgagctcggcgatcttggcggcagccatgccggggatgcggtgatcgagtgcgccgttcttgaacatggcggcacgcagggcgtccatctcggcaccctgcttgacgaagtagcagccgcgacgctggaactcagccttgacatccttgtagatggagtcgaggacggtgacggactgctcggaagcgcagatcatgccgttgtcgaacgtcttggagtggatgatggagttgacggcgagcttgatgtccgcggtatcgtcgatgatgaccggggtgttgccggcgccgacgccgagtgcgggcttaccggaggagtaagcagccttgaccatgcccgggccaccggttgcgagaatgatgtcgacgtcgcgcatgaccatgttggtcagctcgatggacggcttgtcgacccagccgatgatgccctcaggagcaccggccttgacagctgcgtcgagaacgagcttggcggcggcgatggtgcacttggcggctgccgggtgcggggagatgatgatggcgttacgggtcttcaggcagatgagcgtcttgaagatggccgtggaggtcgggttggtggtcgggatgacagcgccaacgataccgatcggctcggcgaccttggtgatgccgtaagcgtcgtcgcgctcgatgacaccgcaggtcttggtgttcttgtaagcgttgtagatgtactcagcggcgtagtggttcttgatgaccttgtcctcgagaacgccacggcctgtctcctcgatggcgagcttggccaaaggaatacgagccttgttggcggccatagcagcctcgtagaagatcttgtctacctgctcctgagtgtactcagcgaatttagcctgggcctcacgcatagatttgagtttggcctcaagcgcctccacgttgtccacgatggcgggagtagtgttttccggtgactttttcaccatttgtgtctccttgcgatcggagatttaccctacgccttgcatgatagcaagaaataattcggtaaacggtcagattcccgtaaaaggcatactaaaacgcttcaatcaaatgaaccgtttcaactaaattatgctacttagcgtaggaaagatcggatgctttgcgccttgtaggtgccctgaagccgtattggccagcatttggttccagagggtttttggcttaaaggcgtcgggttatcgagaacgacttttgcatattcatatgttagtagttgtcgtcttacgatcagttggtagtcaataaaccaaaaaggcgccctccgtaggggagggcgcctttggtaagttctatgtgaacgcgaggtctttgacccggagagtccgaggtacttgttggtaagaccttatttaggagcgcgcaaccttgccggacttgaggcaggtggagcaaacgttcatcttgcgacggtgaccgtcgacgacgacgtaaacgcgctggatgttggggcggaacttacggttggtgacgcggtgagagtggctgatggagcgaccggcaacggggtgcttaccgcaaacttcgcaaactttggacataactgaccctccttgggcgacaaacgaacatgtcgcgttaacaaacaagcctgaactatagcacagaagcagctccctgtgcgtaatctacacagagatatttctcttttggcgatagtgcccacgccacggccctggacgtagatccgatttgcgtgcagcagaggggattatgccagctcgcaacaaggttttcaagctcgtcccacaaatatatataggtttattgagcgttgggctccgtttacggattgctccgtatttatgctcgcaattaagctcgaggttggctacactatcccttgaccattaaaggggtacgagatacccacatggaattacatagctgccatagagcagcccttccttgtgggtgtctggtccgctttgagcggtcgggcatctatttttttgactgtgtcaacagtcaagacatgtgaggaaggagatcgatgggcacgacttcccccaaggcggtcatcatggacgagaccgccgtcaaccgagcgatgacccgcatcgcgcacgagatcctcgagcgcaacgagggctgtgaagacctcgctctggtcggcatcgtcacgcgcggcgaccttctggcaaagaagctcgccgaggcgatcaaggagatcgagggtgtcgacgttccgcttggcagcctggacatcagcttctatcgcgatgactatgcgaccaatttcgctcccgcgatccacgctaccaacattcccttcagcgtcgacggcaagcgcgtcgtgctggtggatgacatcctgtacacgggccgtaccattcgcgccgctctggacgccgtcatggatctgggccgtccgagccgcattgagttggcagttctcgttgaccgcggtcaccgcgagctccccatctcgccggactttgtcggcaagaacgttccctcgtcgcacgaggagaacgtgcacctatatatgaaggaagtcgacggccgtaccgctgtcgagatcaacgacgtcgcgccgggctcccacgtgggttctgcgccgctgggaggtgagtagtaccgtggcgttcaaccataagcacctgatcgacattaccgagtactccgaagaggacattaagctcatcctcgagaccgccaaggcgttctccgaggtcaacgagcgtgcgattaagaaggtccccacgctcaagggcaagaccatcgtcaacatgttcaacgagccctcgacgcgcacccgcagctccttcgagctcgccgagaagcgtctttcggccgacagcctcaactttggcggctcctcgacctccacggtcaagggcgagagccttgtcgacaccgtcgagaccctcaacgcctacaagatcgactgcatcgtcgtgcgcgacaagcacgccggcgcgccctacatcgtcacgcagaactcgcccgcgagcgttatctgcgccggcgacggcaagcacaaccaccccacgcaggccctgctggacctgtataccatctgggagcacaagggtgacttccacggtctgaaggtcgccgtcgtcggcgatatcgcgcactcccgcgtgtgcggctcgctgatccccgcccttaagatcatgggctgcgagacctacgccgtcgcccccggcacgctactgccgccggcgcccgaggtcctgggctgcgaccacgtgacgagcgacctcgattccgtcctgcccgagctggacgtcgtctatatgctacgcgtgcagcaggagcgcctcgagggcgcaccgttccccacgattcgtgagtaccacaagctcttcggtctgaccaaggatcgcgagaagctcatgaagcccgatgcgatcatctgccacccgggccccatcaaccgcggcgtcgagttcgactcctatatggccgaccacccgcaacgctccgtcatcctggagcaggtctacgccggcatctgcgtgcgtatggctatcctgtatctgctgcttggaggtgccgataatggccttgcttcttaagaacgcccacgtcgtcgatccgtccgtcgagcttgacggtgtcgtcgacgtcctgattgacggcgacaagatcgccgaggtcggcgagaacctcgccgccgagggagccgaggtccgcgacctttccggcaagtatctcgtccccggcctggtggatatgcacgtgcacctgcgcgagcccggctacgaggtcaaagaggatatcgagagtggcacccgtgctgctgccaagggcggcttcaccggcgtgtgcgccatgcccaacaccgatcccgtcaccgataacggcactgtcgtggagttcgtcaaggcccgcgctgccgaggtcggccactgccgcgtctatccgtcgggcgccatgacccgcggtcttaagggcgaggccatgtccgagatgggcgatatggtcgcccacggcgccgtcgccttcaccgacgacggtcgcggcgtgcagggcgcgggcatgctccgtcgctgcatggactacggcaagatgttcggcaaggtctttatgagccactgccaggacgaggatctggtcggccacggtcagatcaacgagggcaaggtctcgactcgtctggccctcgagggttggccggctgccggcgaggagcttcagatcgcccgcgacattgagatcgccaagctgaccggtgccaagctgcacatccagcacatctccaccgctcacggcctggagctcgtgcgtgccggtaaggccgccggtgtccaggtgacctgcgaggctaccccgcaccacatgttcctgaccgagaacgacctggacgagacctacaacacctcgctcaaggtcaatccgccgctgcgcaccgacgaggacgccgaggccatccgtcagggtgtcatcgacggtaccgtcgacgttatcgtcaccgatcacgctccccacaccccgtgggagaaggcccgcgagttcgagcttgcgccctttggcatgatcggtctcgagacctcgctgtcgctcgtgctcaccgagctggtcaacacgggcaagatgagcatggctcgcatggtcgagctcatggccatcaagccgcgtgagattctgggcctcgaccaggttcaggtcaaggcgggctccgttgccgacctgaccgtgttcgacccctccgcaacctggacggttggcgaggacggttacgagtcacgcgccgagaactccggttttgccggccgcacgcttaccggtcgtgccaccgatgtgtttgtcggcggtaagcagacgcttgccgacggctgcatctgctagcatagccttatcgcttttatgcgcggtgcccttgcggtgccgcgctttctattcgtttggaccatgcaaccgcatgggggattggagcgtctatgcccacaccttccactgcacgcatgcacgacttcgaggtcgtctcgaaccgggagattgccgacggcatcttctcgctcgtcatctcggcccccaagcttgcaagtgcgctcaagcccggtcagtttgtgaacatcgccgtacccggcgatgcgtcctcgctgcttcgcgtgcccctgagctactaccgcgccgacgccgaggccggcaccgtcgagctgtggtacgccgtcgtgggcgacgatacccgtcgtttgtcccagatgggccctggctccaagtccaacctgttgggccctggcggccgcggctggcttgttcccgagggcaccaggaaggcgctgctcgtggcgggcggcatcggtgttccgcccgtgctgtgcctcgccggcattcttgtcgagcagggcgtggatgtcgacgtttgcctgggctttggcaccgcttccaaggccgtgggtgtcgatgagttccgtgcgttgggcgccacggttaacgtgtgcaccgacgatggcacgctgggcacgcacggtttttgcaccgacccggcagccgagctgctcggcgagggcggctacgactatgtggccagctgcggccccgctgtcatgatgaagaaagtcgccgctgccgctgccgaggccggtgcgtactgcgaggtgtcgcttgagcgcatgatgagctgtggctttggcgcctgcaacacctgcaatgtcgaaacggtcgacggtatgaagggtgcttgcatgtgcggccccgtgttcgatgcttccaaggtggtggtcttctagtgggtaccgtgaacatggccgtcgatttcggcggcgtcaagatgcagaaccccatcaacaccgcagccggtacctttggctacggttggcagttccagaacttctttgatgtttcccagctgggcgccatcaccaccaagggttgcgctgccgagccctggcccggcaaccccgcgccccgcatggccgagattcccggcggtatgatcaactccgtgggccttcagaaccccggcgtggccgcctttgcccgcgagtccggtccgtggctcgagcagctctccaaggacggctgccaggtcatctgtcaggttgccggccactccgttgacgagtttgtccgcgcactcgagatgtatgtcgaactgtgcccctgggctgccggctacgagatcaacgtgagctgccctaatatcgccgccggcggtgccgccatgggctccacgcccgagggcgcctcttccgttatggctgcctgccgcaaggtgaccgataagccgctgttcgtaaagatggctccggttaacgttgccgagattgccaaggccctcgaggctgccggtgccgacggcctttcggtcatcaactccatccagggcatggccatcgacgtccatacccgcaagtcccgcgtggccaagcccaagggcggcctttcgggcccgctgtgccaccacatcgccgtgcgcatggtctgggaggttgcccaggccgtcgatatccccatcaacggtgtcggcggcgtcatgacgggcgaggatgcggccgagtttattctggccggcgccacctgcgtgtcggtcggcatggccaacttcgtcgatccgtgcgcttcgctcaagatcgcgcacgagctcgaggcctgggccgagtctcagggcgtgaaggacatcaacgaactggtaggtgcgttcgaatgctagagaccgatgcccgcgaccgtgttatcgtcgctctcgactgcgaccgtgagcgtgcgctcgagcttgcccacgagctttcgggccatgccgcctggctcaaggttggcatgacgctctattacgccgagggtcctgagatcgtcaagacgttcaaggatttgggctttaaggttttcctcgaccttaagttccatgatattccgcatcaggttcgcggcgccgcccgttcggcctcgcttgctggtgccgacctgctctcggttcacggcttgggttcgggcgccatgctcgctgcctgccgcgagggtgccgaggaggcgcgcgaggaccgcgccaagctcgtcgccatcaccgttctcacgagcatgaatcaggatgccttgagcgagatcggcgtcgagtcgcccgtgtccgaggaggccgcccgcctggcaaagctcgctcaggccaacggcatcgatggcatcgtgtgctcgccgatggaggctcacgacatgcgtgagctgctgggttctgatgccctgatcgtgactccgggcgtgcgtccggtgggtgccgcccttggtgaccagtcccgcgtggcgacgccttcccaggctatcgagcgcggcgcaagtcatattgtggtgggccgtcccatcaccggcgccgacgatccggttgccgcctttgacgccatcgtcgccgagctggtcgaaaacgtcgcgtaaaagattcccccaagtcaccacttttgggtctcattagcacaaaatagcccctgtgcctgcgtaaactttcccatcctttgtgtggaatcgcaggtcaggggcttaactttgggcgcagtatattgcactttttgcgggtatcgtctaacctatggagccgcgattgggcattttgtacgttctacgtgctaaaatgccaattattgaatcagatataacccaactacttggaggtacgaatggcactccctcagcttaccgatgagcagcgcaagcaggctcttgagaaggctgctgccgcacgtcacgcccgcgctgagcttcgcgagcagatcaagaagggcgagaagtccctcgagtccgtgctcaactccgatgaccccatcgcttcccgcatgaaggtttccaccctcatcgagtctcttcctggttatggcaaggccaaggccgccaagatcatggaggagctcggtatctccgctacccgtcgcgtccagggcctcggcgtccgtcagcgcgagcagctcctcgagcagctgaccaaataagtgagcgctcaggattccaagctctttgtgatttctggaccgtcaggcgcaggcaagggtacgctcgtcactcgtgtgcgcgagcgccgctcgaacctgggcctgacggtttcggctaccacgcgagcaccacgcaaaggtgaggtcgacggcgtcaactacttttttctgacgcgcgaggagttcgaccgccgcgtggcaaacggtgagtttgttgagtgggccgaggtccacggtaactgctacggcacgttggtgagcgaggtccagtccaagctcgcctctggttcgtctctgattttggagatcgatgtccagggcgccctgcaggtgaaggagcgtttccccgaggccgtgctgatctttatcaagccgccttcgcttgaggtgctccgcgagcgtctagtcggtcgcggtaccgagacgcccgagacgattgagctgcgtatggcaaacgccgccgatgagcttgcccttgccgaccgctacgacgacgtcgtggttaatgacgatctcgaccgcgcgaccgatgagctcgttcgcgttctcgatatgcatgaaaggatctgaggtccgtgtccgttgtaaagccttgcattgacgatcttctggagaagaccgatcacaaccgcttcctgctcgcttcgcttgcctccaagcgcgcctgcgacatcaatagcatgctgcgtggccagcacaaccgcgtgcttgccgtccaggatgtcgatgacatcaccatcgggctttccggtgccgataccatctcgatggctatggacgagattgtcgacggcgacatctcttacgacgaggcccgttacgagaaggcgctcggccacaaggttgctgaagcctaaatggcggctcgcgtctgcctggtccactatcacgaggttggactgaagggcaagaaccgcgcacattttgagcatatcctcatggataacattaaggcggctttggccgccttttccgtgaacgccgtgtctcgaatttccggttatatcctcgtgacctttaacgagcatcaggccgatgatgcggcgcgtgttattcgcaccgttcccggcgttgctcgtgtgtctttggcgtatcacactaaccgcgacccgcaggagtactgcgccgccgccgtcaaggcgctgcgcgagtttggttccttcgattcgtttaaggtgcacgctaagcgctccaataccgactatgagctcacctcgattgacatcaatcgtcaggtgggcgaggtgttgtgtgaggccttccccgataaaaaggttcaaatgcacgaccccgatgcgatggtgcacgtactggtggtccagggtagcgtttatgtgtacgcgcgctccgagcgcggcgtgggcggtctgccggtgggttctgccggcaaggtcgtgacgctgctgtcgtcaggtatcgattctccggtggcgacctggatgctcgcgcgtcgcggcgcggtgtgcgtgccggtacatttctccggtcgtccgcagacgcccgatacgagcgagtatttggtgcaggatatcatccgtgcgcttgagccgggtgtccagatcggccgcctgtacgtggtgccgtttggcgactgccagcgtgagatttcggtcacctgtcccagtaaccttcgcgtgatcatgtatcgccgcattatgtattcggttgccgagcgcatcgcgcatatcgagggcgctaaggccatcgttacgggcgaatcgcttgggcaggttgcctcccaaacgcttgagaacatcatggctgtcaacgaggccgtgaagatccccgtgttccgtcctctcatcggttcggacaagcaggagatcatcgcgcgcgccgaggagatcggtacgttcgatatctcgactgaggccgctcccgactgctgcacgctgtttatgccgcgccgtcccgagacgcacgctaaactcgatgccgtgcatgaggcctgggagttgttcgatcacgaggagatgatcgagcgcctgctcaagcagaccgagtacatcgacttcgagagcaacacgtataaggcccctaagaccttaaaacgcaaacattcggagcttgctccgcgtgagatttaccaagatcacgagtaattttgtgcatagaccgacgatgcgtctgcatcgtcggtcttttgctatctgggcattttgcggctaagtgttcatttgctgacgtgtgcctgaataaatggacagtatttcgcaaggttttggtcggcttttggtttgaccgcgaaaaccggttttggagaatggctgttgcaggactcttttcctgacacgatgttgttgggaggttttgctatggcgcagcgcgaacaacacgaacgggtcaaacggatggaccgcttggcggacaagctgctcggtcataaggcagtggtgatggcgatactggtcgtcattgcgatggcgagtggactggcgatggcgaaccttggcggcggtgccggcagtgtgtcgtttgagcacactgatggttcgggttcgttagtggagccgggatccggcgatgcctcgagcggaaagacatccgaaggctcttcgcctaaggcgtctgccgcggcagaggtttatgtcgatgttgatggcgccgttgtgtcgcccggtgtatatcgtctcaaggacggcgcgcgggtggctcaggcgattgatgccgccggcgggctggcgcccgaggcagacgttacggggctcaatcgggcatctaaggtcgtcgatggacagaagattcacgttccaacggtaggggagcagcaggcgtccattgcggaagctggtgttgatggtggggcttccgcatcatcgggcgtgagtggcgtaacaggcctagtaaatatcaatacggcaagcgcggcagagctgcagacgctctcgggcatcggtccctccatggcccagtcgattatcgatgagcggacaaagaacggtggttttgcctcggttgacgatctgatgcgtgtgtcgggaatcggcgagaagaagcttgccaaaatcaaagattccatctgcgtatgagtgcgaccgagcgcgagcatgtgatgcctccgcggcctctgatgccgtggtcatggcgccgatcccggcgcccgacgtggtcgtcaccgacggcgggagcgggttcgccaaggccgtgcgcgagacctggccgcgcaccagggtccagaggtgcaccttccatgccttctcgcaggtcaagcgctacacgacgacgcggccgaagctccaggcggggcgcgagctctacctcatcgcgcgcgacctcatgggcatcgagacgctgcaccaggccgagctctgggtcgagcgctacctcgactggtgcgggttctgggccgacttcctggaggacaggaccgtggtggacggcaggagggtctacacccacgagaggctgaggcgggcgcgctcgtcgctgtcgtcgctggtgtcggcggggacgctgttcacctacctcgaccccgccctagccaaggccggcccgctgccgtcgaccaacaacatgatcgagggaggggtgaactcgcagctgagggccgtcctgcgcaaccaccgggggctgacgtcggtcaagcgcgtgaaggcggtgttctggtggtgccatgcgcactcgggggacgcgaggacggcacgcgagaagctcgccgcgatgccgaccgacgcggacatcgacttcctgttcagcgtctactccgcctcgccgtcgcgcgaggacggagggccggagtggggcgacagggcagtgtgggaggacctccaccacagggacccgtacccgttctggctggattaatggatggaaacggatgttctatcgggacacacattttgtcctataagcccttttttatttgagggcttatatggggcgtggtggcgtcgttccgtaggtcggatttgccgagcgcgccacgccctgtgggtgcgtctgctactgaagcgcctgtgcgcccagggccaggcagcccatgatgccctgcttgccctcgaggctgttgttgacgatgtagttatcgatgtcgttgacctcgggcgtgacgatatagccgttgagcatctcggcgcactttttgcgcgcgagcggcacgatgggggtgtggtcggccacgccgccgccgatgatgatcttttgcggcgcgtagcacagcgtgtaggtcatgagcgcctgtgccagatagcctgcgagcaggtccatggcctccgggtcatcggccatgtctccggcgctcttgccatcccagcgctttttaacgccggggccggcgatgaggccctcgagacagttgtcgtggaaggggcaggcgctgtgctcgccaatggtgtcgcgcgggtcacgcatgaccaggatgtggccagcctcgggatgcatcatgccgtgcacgagcttaccgcccgagagcacgccggcgcccacgccggtaccgatggtcaggtagaccacatcggtgaggcccttggcgcaaccaaaggtgacctcgcccaggcaggcgacgttgacgtcggtgtcgtagccgcaggggatattgagctcgttttggatagtacccagcaggtcaaagtagcgccatgccgttttgggcgtctccaggatcttgccgtattggggcgaggcagggttgactgcagtagggccaaaggcgccgatgcccagcgcggcgatgcccttgtcggcaaaccacgcgttgacggcctcgacggtctcctgcggggtcgtggtcgcgatctgctcacgctccaggaccgtgccgtctgcatagcccgtggcgcagaccatcttggtgccgccggcctcgagcgctccgataagctgctgctctgccataatattcctctctctgggacgagttgctccatggctaaagtataacgctctaaacaaattaagaaggcgctataaaaagaagccccgcaactcggctggcggtgcggggcttatttggttgctttagttgccgggccgtccttacccgcgcggtttgattttatcacgcagggacttgaggttctccagcgccgcgttgagcgtctcgtcacgcttggcaaagtggaaacgaatcagatggttgacgggctcgcggaagaagctcgagccgggcacggcgcccacgcccacctttgaggccaggtcctcgcagaactcgaggtcgctgtcgtagccaaactcagagatgtccagcatgacgtagtaggcgccctgcggcacgttatgctcaagaccgatgctgtcgagtccctggcagaacaggtcgcgtttggcggtgtagaggtcgaggacctcatcgtaatagctgtcgtcgaatttgagggcggtgacgacggcttcctgcaggggagcggcggcgcccacggtgaggaagtcgtggaccttcttgatgcgctcggtaatttcggcaggggcgatagtgtagcccagacgccagccggtgatggagtaggtcttggacagcgagctgcagccgatggtgcgctcaaacatgccgggcagcgtggccatatagacgtgctcgtggggcgcgtagacgatgtgctcgtagacctcgtcggtgatgcagtaggtgtcgtactttttgcagaggtcggcgataaaggtgagctcatcgcgtgtaaagaccttgccgcaagggttggaagggttgcacaggacgatggccttggggtcgttgtcgcggaaggccgcctcgagtgtctcgcggtcaaagtcgaatgtgggcgggttgagcggcacatagatgggctcggcacccgaaaggatcgtgtcggcgccgtagttctcgtagaacggcgagaagatgacgaccttgtcgccggggttggtgaccgtcatcatggcggccatcatggcctcggtggagccgcaggtgactacgatattctcgttggggttcaccggcatgcccataaagtgctcctgtttggcggcgagcgcctcgcgcatggcctgggagctccaggtgatggagtactggtgatagagcggcttggggtcgctggcgatggcgctgaggctatcgagcagctgcgctgggggatcgaagtcagggaagccctgcgagagattgacagcgccatacttattggagatgcgtgtcatgcggcggatgaccgaatcggtaaatcttgccgtgcggttggagagttctttcatgacggtcctttcgaggatttgcagtggggcaagtttactcctatgaaaccggtgggatttgctcgaaatggtctcgaaaaactcttttcaaaattcttgaaaattggggcttgcatcgcgtggcgttccttgcaataatagtcgagcgcgaagcgcacaggacacggtgggtgtagctcagttggctagagcgacgggttgtggtcccgtaggtcgagggttcgagtccctttacccaccccagttcttgctttgtgttgatatcgggtcgttagctcagttggtagagcaggggactcttaatcccaaggtccagggttcgaccccctgacggcccaccacacgatatctcctctaaagtccgccataacggactttagctttgggtcgttagctcagttggtagagcaggggactcttaatcccaaggtccagggttcgaccccctgacggcccaccaaagcaagttaagacggtcaacttcggttggccgtcttttttgttgaccttgcatggggtcgaacccgaaagggcgcggagctgaggaaacgcgtaagcgtttgccagcgcagcgcgcaaggcgccttggcgccgcagcggccgcctgcgcagcgggctgaccccctgacggcccacccaaagatcgttaaagcgactggcttaggctggtcgtttttttgttaacctcgcatggggtcgaacccgaaagggcgcggccgctttcacagattgagtctaccctggggatcggtgaaaccgtcagtaccctccttgagtttcttctcgtctgccttcacgcgacgctcgagcttttttgtatcctcggcaggcggtaggttctcgggaacaattccgcggtcgatgaggctgccacgcacgctcgtgttgttctcgacgtgttcttgtttgatctggtccagaccgtacaagtcgtgttcctcggcgttgaaggccgtcatcgagttcgtgaggtcctttgctttgatgagaacatcggctagcttgtccgccaatgcagcactcttggacacaccaagctgccgcttcatgtccgccgtgcttctgccgccgaataacgcctcatcgcccttcgacttgatgatcgcgaatcctttggagtccacgcctcgtttgaacgcaatgcccgagagctgtttctctgaatcggatagcgagtggcacgcctgcaagcgctgaatctctgcgaagcgctgctctatgagctcctgacggcgtgtctgcacggcgaagtacgcctgtgcgagtgcgatttcgggcttgtttgggtctccgttttgggcgattaaatagcatgcgtagcgcgtcagcttgtagtctttaaccgcgcgagcggcgacaccggcagttaccattttcgtggtgtcacgaaaatgggaatcaactggagttttgtttgtttcgcacgagacttttgccctcttaacaacttcggcgaagttctcccatcgagtgtaccccatgggttccattaaatcgcgtgcgagccaatattcaacgccgtcttccacattggcgtagctatcaagttcgacacgccacttctcgatatctctactgtccatatctcctcctcgctggtctattgtctatgcgggctttgcccactctgtattcagaataaggatacgctgccgtgcggacacgaatgggcccgtgctgcttcgagctcacggggcccatggatatcgattggttgtgttctgctttagataggtgtccggtttaatccgctcgatagtgcgacccgagactttcagttcgcttacgcatggctttgaccatttcctgtgctagttgaatctgcgattgcaggcgggcgagggctgcgacttcgctgtcctgggctttctgtgtgctcaaggtcgttgcctctgtcttcaagccctcaagctcgtgtagtgcctcggataggcccgtctcggtgcggttgatcatgcagtagctactcatcgtgtgcttgaggctgcgagccagacgctctgcatctgccttggcgaggccgcgctgggggagggcgatatccgtcttcaagggcgtctcaggggcgtccagcgccgcctgagtcgccgatgcacccgcaatccgtccgaacacgataccgttggcgcttgacaggccgccaatgcggtcggcgccgtgcatgccgcccgttgcctcgccacaggcgtagagacccgcaacgccggtcgcggctgccttgtcgatcttgattccgccgttggaggcatgggcgtacatcgctacgcgcatctcgtcagtcggagcaatgccgtgctcgtcctggagccatgtggcaaaggtctggacaaactcggggacgtcctcactggggaagtcgtaatgcagcgctaggccctcggcgcccgcttggtcgatggcaaggtcgatagcacgtgaatccaggcgtgacgtgaaggggccgtatccggagcgctgctcaagcagcttgtccagtttgtcgtcgtcgatgtcaaccgactgatcgaatttgacgtagcgccaggtcttctcgttaaagacgaggttgcgcttgggctcaatgaagccgggcatcatctgcatgaactctatattagtaagtgttgcgccgtgcgccagcgcgatggcctgcgaggaactgagcacatcagccgacgtaaggctgcgctcgaacaggccgcctgtgccaccggctgcgatgaccgtggccttggcagcaaagggcacgattcgattttcggtaaggtcgtagagtacggttccggttattctgccgttcgtgtcctcaacaaggtcgataagctcatggcgggggagcaggcgaatgccgagcgactcgatccaggtcgtcagagcgtcctcaaggggcttgcgggtgaggccgcgccacatgcgcgtcttgtggtcaaagcaggggataaattgcttttgttgagcactcttggcgctttgcggacgctggagctcaacgcccaggtcttgctcgagccagttaatcgcttggggaatgccgtggacgaacgcttggacgagttcggggtcggcaacgccgccgccgacggccaggatggtgtcgatgaggtcctgctcgtcgtcttcgttaacgggtccgataagccctaggccccaggttccggggaagaagctcgatccactcatagtcttgccggcgcttgccacagtgacggttgcacccgtgcgtgccgcttcgatggcggcgcaaaggcccgcaatgccagatccaattaccagtacatcagtcgattccatcggattcctttctcgtccggcgcattgtcgcacgggtgatcggcaatggggccgcaaagactcggcaaatcggtaaagggcaagtatggcaggtgggcgtcatggacgctctgacgctccatctcatcacatcttgtatttcgccccaactgatatatcggcattagctaccctgcgacagcgcaaacaaaaagagccgctacctgggtgggtagtggctccaaagctcaactatatgagcatcgcgcgggcgcgattaggccttgagggcctcctcgacggcgacagcgcaggcgacggtggcaccgaccatggggttgttgcccatgccgatgagacccatcatgtcaacgtgcgcaggcacggaggaagaaccggcgaactgggcgtcggagtgcatacggcccatggtgtcggtcatgccgtaagaggcagggccggcgcccatgttgtccgggtgcagggtacgaccagtgccgccaccagaagcgacggagaagtacttcttgccagcctcgaggcgctccttcttgtaggtgccagcgacggggtgctggaagcgcgtggggttggtggagttaccggtgatcgagatgtcgacgttctcgtgccacatgatggcaacgccctcgcggacgtcgtcggcgccgtagcagttgacggcggcgcggggaccatcggagtaggggatggtctcgacgaccttgagctcgcccgtgaagtagtcgaactgggtcttcacgtaggtgaagccgttgatgcgggcgatgatctgagcagcgtccttgcccagaccgttgaggatgacgcgcagcggcttcttgcgagccttgttggcgtttagagccaggccgatagcaccctcagcggcagcgaaggactcgtgaccggccaggaaggcgaagcactcggtgtcgtcggagagcagcatagcgcccaggttgccgtggcccagaccgaccttgcggtcctcggcgacggagccgggaacggtgaaggcctggatgccctcgccgatgatggcggcagcctcagaagcggacttggcgccacgcttgacagcgagagcgcaaccgagggtgtaggcccactcggcgttctggaaggcgatggactgggtgttgttgacgatctcacgcgggttgaagcccttgtcggtgcagatctgcagagcttcctcgagggaggcgatgccgttgtcggcgaggcacttgttgatcttgtcagcgcggcgctcgtaaccttcgaacgtaacagtcatagttatttccctccctttctactcgtgaaccgggaacacgctggcgacggagtgagtctcctcgtcggtgcgcgggtcgatgtacttggcagcgttctcccactgaccatagtggcccatagcgccagcgatggcctcctcgggggtcttgccggccttgacggcgtcggtgaacttgccgaggttcaggaactcgaatgcgatgatctcgttcttgtcgttgagagccatgcgggtgacgtagccctgagcgagctcgaggtaacgagcgcccttggccttggtgccgaacatggtgccgacctgagagcgaaggcccttgccgaggtcgtcgagggaggcgcccacgggcaggccgccctcggagaacgcggtctggctgcggccgtaaacgatctgcaggaagatctcgcgcatagcaacgttgatggcgtcgcagacgaggtcggtgttgagggcctcgaggatggtcttaccgggaaggatctcggaagccatggcggcagagtgggtcatgcccgagcagccgatggtctcaacgagggcctcctcgatgatgccgtccttgacgttcagcgtgagcttgcaggcgccctgctgaggtgcgcaccaacccacaccgtgcgtaagaccggagatgtcggaaatctccttagcctggacccacttgccctcctcggggatgggtgcggggccgtggtatgcacccttggcaacggggcacatgttctccacttcctgtgagtactgcatgcctctcctctctatcgtgttggcgtcccgtctgggggccgtggctggcgattgccgggcgacccttcgaaagggacatgacatgcagcccctataataccgcgaaatgcacggaatattcggcgaacggctcagttttcgtagcgagaagtccggaagttttaattgaaacggtttaactctatgttctgtggtcgtgaacttccgtagagggggtccgtcttgggcaagctattggtcagctcttgtaagcattgcgggggttgacctgttgcaacgatgccgttcgccgcctgattactgcctttggccgcgcgagtgtattgttttgcgtgaatgttttgatggcacgcttcaatcgtgctgtattggatggcaagcagatcccggcgaagggagcgccatgcagcgcgtttggagaacggttaccggcttttaccatgtctgtgcccgcggtacgggcaagcagctcatctttgagggcgatgaggaccggtgggagtttttggagctgatgcgcgagtgctgccgcgaggagggtgtgacggttatcgcttggtgccttatgggcaatcacgtgcatttggtgcttgcagattacgaggacaggatgagcgcggcgatgcaccggctgcttttgacgtacgcgcggcggttcaataaacgcacgaggcgcacaggccatctgttccagaaccgttttgaccggcgctcgctcgataccgactggcaggtgatggaggctattcgctccgtacacgccgatccgcaggaggcgggcgttagcctaatcgagcgttatccctggagtagctttgcggagcatttgtgcgcttacgacggtgacgcggctgatgtcgcgaggggattttctgatccttcttgcgtgcttgagctttttggttctgccgagggctttattgcctattcgctttcgacgcccgacggcagcaagccagcgctgtgcgatatgaaagagacagagtgggaacgcaatgcctttgccggcaagttggcgaagagtctcggggttccgctcaacggggttaaaactgcaccgccggcgcagcgcgatactgttattgttggattgaacaatgccggctttacggtgcgccagattgagcggtataccgggattggcaaaagtaccgtctctcgtatcgtgcgcgcccgcgcgcgaacggcgatgcgggctggcggaaacgtgatgtaaggtcgcctgttcaccgcagctggggtcgtccatacgccgcaaccagcgttcaaaagcttggtacggtaactgcacttcttaatatgcatagaacaatcgtcatcttgcataaaataacagctcagtccgggtttgcccgtgcctacccccgtctgcgccgtgcaaaaaacggagttttcagcatcgtgttgctgtcggcaccgccgcaatcttgcaacatacgggtcccgaagctattgattcctgccgttgcgcccccgaagcacgtgcctgcgtcccgtcagaccgcgatgcttgttctaaaacacaatatatatgcgcctaaagacattgattaacgctttcgatgcgtatacacacagcttggcgtgctgaatactcgcaaaaatgcacgccgcttcctatgggacccgtctgcggcaggcgcgaagcgagtcggagcttcgcagaacggggcttggcgcattgcttggcgggcccggggccctgccgcaggcctttggtgctgtggaaaacgcccgtgctcgcgtctggctgtgtggcaaatgtcagacggggcgccggacgcgcggactttgtgcgttcgcgctcattaggtaaaaacagagccgcccgtatcgggcggctcggcaatcaaaaaacttggattcggggcataaactactggtttgcttgcccctcgagcatgccgtcgagggtgcgccaagcgagctcggcgcatttgacgcgggcgggcatgtgcgagatgtcctggagctgggcggcttcgtccaggtcttccaggtcgtcctcggagagcttctcgccgcggatcatggcgaggaagagttccgccaagcgacgcgcctcctcgaccgtctcgcccgtgatgaggtcggccatgatgtcggcgcttgcctggctgatggcgcagccgtggccggtaaaggaggcttcctcgatcacgttgttctcgactcgtagctgcaaggtgagctcgtcaccgcagctggggttgataccgtcgtgctcgtgcgtgggagcatccatctcgtacttatagtcggggtgcgagttgtgctccataaacgtggtggaggtgtacagattacccattgaacgtgctccaaacgtgatgcaggccggcgatgaacttgtcgatgtcggccttgtcgttgtagaaggccacgctggcgcggcagcaggcaaggttctcgacgcccagccaggtgagcagcggctgcgcgcagtggtggccggcgcggatgcagacgccgtccatgtccatgatgctcgcgacgtcgtgcgggtgaattcccttgacgttaaagctcacaacgccgtggtggttgtcccagtagatggaaccgatgatttggacaaagtcgagctgcatgagttcgcccatcagatagtggacgagtgcctgctcgcgggcctggatgttctcgtaacccaccgtgttgaccaggtaatcaagggcggcgcccgtggcgaagatgccggcggcgtcctgcgtgccggcctcgaacttctcggggacgggcgcccagacggcgtcctgctcggtgacagagtcgatcatctcgccaccggtgagcatgggcggcatggcgttcagcaggtccatcttgccccacagcacgccgatgcccatggggcccatggccttgtgtgcgctaaaggcaaagaagtcggctcccaggtcggccacatcgaccggcatgtgcggcagcgactgcgcgccgtcgacgaccagatagccgccgtacttgtggacgagcttgccgaggttcttgaccgggttctcgacgcccagcacgttagaaacctgacccacggccagaatcttggtcttgggaccaaccttggcaagaacctcctcggtggtgagctggccggtcttggtggggtagaggtagacgagcttggcgccggtttcgcggcagacctgctgccacgggattaggttggagtggtgctccatgatggtgatgacgacctcgtcaccgggctcgagcaccgtgggtgcaaagctcttggcgaccaggttgagcgactcgctcgtgttacgggtgaagacgacctcgttggcctgtgaggcgccgatgaggtcggcgatctgctggcggaccttcgcgatggcgtcggtggcctcgacggacagtgagtacaggccgcgcagggggttggcgttcatgcgctgatagaagtcacgctcggcgtcgagcacgcaggcggggcgctgcgcggtggcggcactatcgaggaaggcgatctcggggtgctgctggaaaagcgggaactgtgccttgtagggattggtctcgatgtcgacggtaggccagccgcgcgaggcctcgtcactggcgtcgagctccataggctccggtgcggtacaggtatcgcatttaacgtgctcggtgtcgatcatgcgagctcctcttcaaagttgttgatcaggttgttgcccaagcggacgacggctgcgcgggtgcgctcgtcggtggcggaaagcgcggcgtcctccagcttggcgcgaatgaacaggtcctcggcggcgttttggtcaaggccacggcaggcgagatagaacagttgctcgtcgcggacgtggccgattgtggcgccgtggttgccggcgacgtcgtcctcgtcgcagagaatgacgggaacggtcttgttgtcgacgcccttgttggccaaaagcaccgtctcgcgctcggtgccggttgcgcccttgcagccgtgcacgaggtcgatggtgccacggtagaccttcttggacgtgccagtcagcacgccgttggcgtcgatctcgcactcggtcttgcggccgcggtggcgcagctcgtagttaaagtcgcgcacctgctcgcgggcgcccaggtaatcggtatcgatcgtcaccttggcggtatcgcccagcaggtcgccggcaaggccggtggcgctggcgccagcacccaggacggtgtgctgcacgttgacgcgcgcgccctcgtccaggaacaggccggtgtcgtcgagcgcgatccagctatcgtcgagcgtctgcgtgcaggtcacgttgacggtggcgtactcgtgggcgcacacgcgtagcgcggagcccacgacgccttggccggcaacgggggagtccagggctatgcgcaggtcgagcgttgcctgcggactggcgacgacatcgatggcggcgatggctgcggcagcgtcgacgccactcacgcgcacggtaaccgtggcgtgcttgtatgcgggcacatcgatgacgacgcgcttggtggtgtggtcggccaggtaggtgtaggtagcctcgcccatgccagtctcgaaggcctcggcaggggagagctcctcctcgagcttgatggcgccggcctggtagatggaggtggcgggcacgtcgagctcggtctcgggcgtgatgcgggcgcggtcgacggcgtcgccgggggcggaggcacggcgctcggggaagcgctcggccatggcgtccatggcggtatcgaaggcgtcggccgagccggcaaactgctcgtccaggccctcgacctcaacggcctcggcgggagcggcggcaagttcgtccgaaagctcgagcttggtctggttcatcttgagccaaccccaagtggcggccggcatagcgttgacctgctcgagcgtggtagcagcggtgttggtttcctgtttcattatccgatcgctccttccatctcgagcttgatcaggttgttcatctcgacggcgtactcaagcggcagctccttggagaccgggttggcaaagccgttgacgatcatggtgcgggcctcttcctccgatatgccgcggctcatcaggtagaacaccttgtcgtcgccgatgcggccgatggtggcctcgtggccgatgtcgacgttcttggcgcggatgtccatggcggggatggtatcggagcggctctggtcgtcgagcatcagcgactggcagctcacggttgctttggaaccttcggccttaggcgtggccacgatggagctgcggaaggtctggatgccgccgctcttggagatacccttggtctcgacggttgccgaggtgtcgggcgcgttgagcacgaccttgcagccggtatcgaggttctggccggcgccggcaaaggtaatgccggtaaagctcgagcgggcgcgacggccgttgagcacgctcatggggtagaggtagcccacgtggctgccgaaggagccgctgatccactcgatgtcgccgtcctcgtccacgcgcgcacgcttggtgttgaggttgtacatgttcttggaccagttctcgatagtcgagtagcgcaggtgcgcacgcttgcccacaaagagctcgacagcgccggcgtggaggttggctacgttgtacttgggcgcggagcaaccctcaatgaagtgcaggtcggcatcgtcctcgacgatgatgagcgtgtgctcaaactggccggcgcccttggcgttaaggcggaagtagctctgcagcgggaagtcgagcttggtgcccttgggcacgtagacaaacgagccgcccgaccacacggcaccatgcagggccgcaaacttgtggtcggtgggcgggatgagcgtcataaacttctcgtggatgagcggctcccactgcggatcgtgcagggcctcctcgatgccggagtagacgatgcccatcttggacgcggtgtcctgcatgttgtggtagacgagttcggagtcgtactgcgcgccgacgcctgccaggtagctgcgctcggcctcggggatacccaggcgctcaaaggtgttcttgatgtcgtcgggcaccgactcccagtcgtgcttttggtcggtgttgggcttgacgtaggtgacgatgttgtccatgtccaggccctcgatggaggggccccacgtcgggtcgggaaaacggttgaagatctcgagggactttaagcgcaggtcgagcatccactgcggctcgtctttcttggcgctgatctcgcgcacgatgtcgggcgtgatgccggcgtcgaggcgctcgaatccctcctcgccataggtgaagtcgtagaggctgcggtcgatgtccgcgacctcggtgcggttcttggtcattgcgtcgcccctttacgcctgctgctcggcagcggcggcctcggcctgggcgcgctgctcggcggcctcgcgctcgaaggtctcaaaaccgttcttgtcgatccaggggatgagcgaggcgtcgtcctcgcgcacgatgtggcccttgaccataacgtggacgcggtcgacatccaggtgctccaggatgcgcgtgttgtgcgtgatgatgagcatggagccgtcgcagctcttgcggtaggcgtccatgccgtggctgacggtggacagggcgtcgacgtctaggcccgagtcggtctcgtcgagaatggcgagcttgggctgcagcagcagaagctggagcatctcgaccttctttttctcgccgcccgagaagcccacgcccagctcgcggttgaggtaggcggtgtccatgttgagctctgccgcgagctccttgacgcgccggcggaactccttgcccttcatctccaggccggggcggccggcgatgctggcacgcaaaaagctcgacagcggcacgcccgggatctcgaccggggcctggaagctcaggaacaggccggcgcgcgagcgcttgtcggtggtgagctcggtgatgtcctggccgtcaaagacgatgcggccgtcgttgacggtatagacagggtcgcccatgaccaggtggccgagggtggacttgccggcgccgttgggtcccatcagcacgtgggtctcgccggcggcgacgttgaggttgacgttgtggaggatggtcttctcgtccacggaggcggtcagaccttcgatggaaagcagcggatttgcgctcatgctgtccctctctgtatatggtgtactcataggtgtactaaaccctaggaatcttctcggaataaagttactatgggttcggcgttagtcaagggaaaacccgactaatccactcgacttttcaaattctgggacaaaataacctgttgtgtttgtcccatttacttaagatttgggacaaacaaacctggttatgttgtcccagatgcgatgggagggtaggtatgctcatttcttccaagggccgctatgccctccggctgatgatctatatcgcggcgctgggcgacgccgagggcaagattgccctgcgcgaggttgccgaccgcgagcatatctcacaaaagtatctggagcagctggttcgtccgcttatgaaggcgggcctgcttaagagcgtgcgcggcaagggcggcggctacatgatggccaaggacccggccgaggtgcgtgccggcgacatcctgcgcgccgtcgagggcagcacggctccagtggcgtgcgatggcatcgacaacagctgcactcgcagcgatctttgctcgaccgtcaagttctggcgcggcctggacgacgtgatcgaaaagtacgtcgacggcgtgacgttggccgacctggccgccgtccccgaaatcaactttgacattaagctgtagggctgcaaatggcatctctcgacaaggtgtataagcaaattgaagtttttgctcgggagtgtgacgccgagaaggttgtgctgtttggctcccgcgctcgaggtgacaacttgcctaagagcgatattgacatcgcagtagcaggttgccgggatttcggccggttgtcatatttgatcgaggagcgtcttgatactcttttagatgtagatgtcgtcaatctcgatgagcccttatcgcagcaattgctcgatgaaattgccagggatggtgtgattctgtatgaaaaaatatgagaactttgccagcgccttggcgaatcttgaggatgcgcccaatcaggatctcaacaatgattttgttcagagtggattgattaataagttcaatcttcaatttgaactgagctggaagctccttaagcgtctgctcgagtatgaaggcgccacgcttgccgcgtcggggtctcctcgtgccatcttgaaggagtcgtaccgattctacgactttattgatgaggcggcctggctagatatgctcagagaccgcaatacgaacgtccatatctacgacaacaagctcgctcaagacttgattcagcgcatcttgaacgtctatatccccgctttctgtcagttgagggacgggctgatggagcgatacggcgagcttctgatggcgcccgacgaccagtttgtttaattccttaagatttcgcggagggttgttgccgtttaccgaggggttgttgtgcaacaacgggcgagctgcaatacttatttctatctttgcaaactgcactttaactataccaatgcagggaggatcttatgcagctcaagcattccgcgattgtcgcgggcctgacgctggcgctttcgtttggcgccatttccgcgccggcacccgctgctgccgaggagcccacgccgggcgttgcctcggatgccaccgatatcgataagggtctctacacccagcagtccttctcgggcgtactgaggtcggtccagggcgtttcgtttgtcaacgtgactcccgagatgaagtactttaccaagtacgagagccatggcaactacaaccagggcttttcgtacggtgacggctataacgcgctgggttattaccagttcgaccgtcgttggtcgctcattccgtttatgaagcaggcctacaactacaaccccgaataatacagcatgctcaaggatgcgattgatcgcggcagcgagatttccaacacgagtaatgtcatgtacgagaacggccagctcaccgagctgggccatatcgcgcaggatgccttccaaggtgcgtacaacaccgatcctgttgagttctcagcacttcaagatgcgtatgcgtacaactcgtactatgcggtgaccgaggcgtggctcaagagcggcctgggtattgatatttcgggccgcgccgattgcgtcaagggcatggtgtggagcattaccaacatgtgcggcaccggtggctgcagggactttttccgctgggcgaatctttccaatgatatgtccgaccgcgagtttgtgacggcgctctccaacagcgtggtcaataacgtggcgaccaagtattcgagccagccccagtatcatgagggctggaagaatcgttataagaatgagctgaaggactgcttggcttatatcgccgaggacgaggcagccgctgcgacgcccgtgcagcccgagcccacaccggcgccctcgccgacacctgattcgaatgacgactcgagtgacgatcccaacgatgacaggatggatacgccctcgaccgatgctgacggtaatggctcggctggtggcactaccaacgacggctctacctcgaacggctccaattcgaacggctctgctgcgggcgattcgtcttcaagctctgccggcaatacggacagcgacgcttctggttcgaccggcgctgacacctctaactcatctaccggctcgagcgattcgtccgttgataccggctctaacaacggctccggctctgacgcaacccctgattccgatgcttccaaggacgactcgaataaggcgccggacgctcccgttgcttcgccggacaagaagccttctttctccgagcagcttggttctacgctgggctcttcgctgatggctggcgtcaataatggttcgactcagaacaaggacaactctgatcaggcttccacggaaaagaccgaagccgtaaagggcgactccaaggataaggcttccgagaaggttgaatccgataagggttctagctctgatgagaaggacgacaagtccgctcagaagaaggacgaggacaagaagtctgaatctgaggagaaggacaagaacaaggacaagaccgaggacggaaagcagcagggcgaggacagcagtaagggcaacaccgacaaccagaaccaagagcaaaatgactccaagacggtgaccactacaaccaccactacaacgactaagacttcgggcggtaacatgcccaagacgggcgaccttatcgttatggcgagccttgccagcgcgagcttggccacgctgggcgctacgtctatcgtaagtggtaagtataagctcgatcagcagaagaaggcttctggggaggacgactcgggggagtaggctcttagttgccagataactaaatagtcgggacggggtccggtgcgaatgtatcgggccccgttttgttgtgcaacgattaattgtgccccctcacacctcttgttactaccgttgcccgatatgtttgcgcggcgacatcggtacatgcgatgcggtcattacaattggcatcgtgctgcgatttagggggaacgttttggtgtctgaacaggcaaatgttgattgtgctgctggctttggcgtgcgtttgatcggctgtgccgacgatgcggctttgcccattggcatgcacgactatgcggaggctcttggttgctgcacgctggtcgacaagaccatgtttattgccgatgcgttggactgcgacgcgtccgttgtggtgtgctgtcgacccgagggttttggcaaaagcatgaacttgtcgatgctcagggcttttctggagcgtccagcggttggtcgcgctgatcagcgtttgtttgccaatgctcagatttgggatgcagacggtgggcgttatcgggacgagtacgcttgctatccggtgatatcgctggatttttctggcgctgcgaggcgtggcgccgctattgccgacgtcgtgcgcgatgctctttcgggcgagtgcgtccgcctgctggcgcttttggaggctccggatttagctcgagacaaggtgcgtcacatcgaacgtgttgcgcgtggcgcggcgagcgaggacgaggtcgcctcggtgcttggcgtgctcattgagctgctggagatggcctgcgatgagcaggttgtattgctcgttgatgggtacgatgcggcatggttgggccgtgcaagcgcgaggggcgcttccggtgctgatccggcagggctattcgatcgcgtgctgttcgacgccattgccgctgcgcgcgattcgttgcggctgacgtgtctgatgggggagtgtcccggccctgccgaagcggcgctttcttcgcgcggctgctcgtattgtctgacgacgccgctgtcagcgtggtgtgaccgatgtttcggtttttcggatgccgaggtcgaggctcttttgaatcatgctgggcgcgaggaatacctggatgatgcgcgtgaatggctcgagggatatcggtttggcagggcctattgctcgagtccagagcgtgtgatcggttttctgggccgaggctgcacggcgcctgtgcgtgctgatctgtatggatatgccgattgcctgagtagggtagttgccgggtggaatctcgaccgcctttcggtcttgtttgatttgctcgaggcccatgggtgcgctgaggctccgctttgtttgggcacagcagagccagatgtctcgcctgacgatggcatgtggacagcgctgtatctgtccggttttctcacgacggatatgactgaggagccagagcatggcgattgcctccgtgctttgcgattgcccaataacgagcttcgccaggccttgcgtctagtgattattgagtggtttgagtgcgctgcagaagacattcgagacgtcgatgcgtttcgcgacgggctgtgccatgggaacgaggataccgtgaggcgggcgctaagccgcatcttgggggatgcgggaatcggtgggaccgacccagatacaccgctgccatatcacctactcttgcaaggactctgctttggattgccgggctatgccaatcctgcttcgaggcgaaagtgtggcgcggatcgctgggacatccaggtttttcctacgggcgccgtgttcgacatagccgatacgatcggtatgctcgatgaacgtccgctgataacgatcaacatgatgtatgaccccggtgtggatgcgctgggcctggaattgctggccgtgcaggcgctgctcgacatagagcgcgacggcatcgacgaaatccgtgtgccgcgacccggcattggccgcatgcgctgggggttcggttttgatgggcagcatgtggctacggtgtgccagcggctttaagcgccgaggtgtttccggcttccgttactcggtgtccttcatgggcggcatgggcttccagttggggtccttgatgatcttgcgggcgtccttcatgccgcggcgtagcgccggaattccggtcttaaagcacttgtcaacggcggccaggcgaatgaactccttgcagaaggtcgcggcgttgcctaggcggaacagcacggggtgatagtcgccgtaaatctgcatgtagcgggccagataaccgcggttgcgcatgatgtagtaacggttggtgtcgctcgtggagttgagctggcgcttgccggcgatatcccagttagagacggcgcgggcgcgcttgagcaccacgtcggcgaccacggcggcggggaagtgttggctggctacgtagccgtagcaggcgtcgtcaccgtagataaagaagcgcgcgtcaggcaggccaatcttgtcgaccacgcggcgcgagaacatgccgccctcaaagcacagctggttcatggcgcggtagccctcgggtcctaggtcccacttggcgacagggttgggaatgccgagtgaaaggatgagttggtattgccaaaagaaggcaccgccgtcaaagtccaggcgcgaaccctggatgacatcgtagcggtcggtccacttggcaagacgctcgatgccttcggggatgacgagcacgtcgtcgtccatcacccagaaccactgggcgcccaggtcgtaggcgcacttggtgccggcggagaagccgcccgcgccgccaccgttttcaagctgcggggcgtagatgacgcggtcggtgccgccctgcgcgtcaggctgctcggtgtcgatgccccacaggttggtcaggcgctcgttgaatgcggtgcacatggcctcggtctcgcgtgaattctcgttatcgacaatcacgatgcgccagggcgcggccgtgagctcggtcatggagtcgaacaaattggccaggagttcctggcgtttgtacgtaacgacgacgatggcgagcttatcgatgggggcggggagggttgaaggcatggggcaatatatcctttcacgtgcggcgcgcatgcgctgcacggaagctatcgaatacgtccttgggactgtcctattgtaaaggctcggcgcaccttgacggcaagctttgaataaaacgcaggaacctgccacgggcccgccgcatgacgtggggctgctttgcccgcaagaggctccatagattatataaacgcccgctggcgcgctggccctttgataccatgaaacgacaggtatttcctaaggagcacatttgtctactaacgcctctggcagccctgttctgtcgctgcttattcccatttacaatgttcagcgctacctgcgcgagtgcctcgattccgccctggcgcagacgctcaaggacatcgagatcatctgcattaacgacgggtcgaccgacaactcgccggcgattatccgcgagtatatggagcgcgatgggcgcgtcaagatgatcgacaaggccaacagcggctacggcgactcgatgaaccacggtctggagatggcgcgtggcaagtacgttggcatcttggagtccgatgactttatggcgtccgacgcactcgaaaaacttgtctcggccgccgatagcaataatgccgactttgcgaaggcgaactttgatttctactggtctaagcccgaggagcgccgttcgctgcacgagatgtttagacctcaggattgcggcaagccggtgcatccgagcgatacgacgcagttctttaagcaaaagccgtcgatttggtcggccgtgtaccgtcgcgattttcttgagcgcaacggcattacgttcctgccgactccgggggcatcctttcaggacacgtcgttcgcctttaaggtgatcgcgtgcgccgataaggctgtttacctacatgatgccgtgttgtcgtatcgccaggacaacgagaattcctcggtcaattcttcggctaaggtcttttgcgtcaataccgagtatgccgagattgagcgttggattcgagaggattatgcccgcggccacgcaagcggcgatgtcgcgcgcatgctcaagttcaatcagctcattaagtacgattcgtacatgtggaactacgtgcgcctggcgcctaagttctataaggagttcctggttcagatggccaaggagttccaagcggccttggacgcgggggagttttcgcttgacgacctcaagccgtggaagcgcgcaaatctcgctgccatcctcaaagatcctgagggctgggttgacgagcatccgagttttgcgacggatggtgccttggggcgtgctaagtattacgcctcggttggaggcccaggcgtggttgctgccttcctcatcgaatcgctgagggggtaggtcggcatgggagaggcctcgtgtcctaaagctaccattgtcgtccccgtttacaactctgcgcgctccattcagcgatgcctcgattcgctgttggcccagtctgagcgttcgattcaggttgtctgcgtcaacgacggttcgactgatgattcgttgaacgtgttgcgccagatcgcgcaggccgacgatcgcgtactggtgattgaccaggaaaacgcgggcgtctcgtgtgctcgaaatgccggtatcgatgtcgccgagggcgagaccgtcttttttgtggacgccgacgattacatcgatgcccagacggtcgagcgcgtgctgcatgccatggagtccgcagatgccgaggccgccgtttttggcggcgtctgtgaacctgccgatgctgcccccaaacgcgtccagcaactcatgagcaccaaagctggtgctttcggcgcccgtgatccccaactgctgttccattcgaatgcgcagccctatgcctgccgtgcggctttttcgcgcgagctgctcaatcgcgaaggcattcgcttcgcccccggtttggctttgggcgaggacgtcgtcttccaatttgcggcttatgcgcttgcccgcaggaccgtcgtcatgccggacaagttctaccactacgtgatggagagcgaatcggcgacgcacgagttcaacagtgccgaggctcgtgccaaaaagcttgacgcccacatgaggatgctcgaggaggtcttggaggactgggcagcctacggtcttttggacctgtgccccggcgagctgataacttggtttttggacctcattgtgttcgacttggcgcgtctggatgcggacggcttccaccgtgttgccggccgcgtcaacagggctttcacgacgtttttgggaacagagtgggcggatatgcctgctaagggcgccgttcgccgtgttgcccacaagctcgttgcggcgacctcgggcgtttcgatggcagacgccacgctgttctatctttcgactcgcggtctcaaagcctgcctggagcgctttctctaattccaagcgctgccgcccgccgcaactcggctgttaaaataaccctgttacacgctattcaacaggaggttctcttgcagaactctgatacccctaaagtttcgctgcttgttcccatctgcaatgtcgaacgctacctgcgcgagtgtctcgattccgccgtggcgcagacgcttaaggacatcgagatcatctgtatcaacgacggctccaccgatagctcgccagatatcatccgcgagtacatggagcgcgatccccgtgtaaagatgatcgacaaggccaacagcggctacggcgactcgatgaaccgcggcctggagatggcgcgcggcgagtacgtgggcatccttgagtccgacgacttcatgtttgaggattcgctccaaaagctggtcgccaaggccgatgctgagcatgccgatgtggtaaagggcgacttttacctgtattggtccacgcccagcgaacgccgtgaactgtttgggattatcgacgagcatatgacgggcgccgcgtattgccccgtcgatcgcccgggcatcttctaccgcaaaccttccatttggtcggctatctatcggcgcgagttcctcaacgacaatcagattcggttcctccccacgccgggtgcctcgtatcaggacgcaggctttaactttaaggtttgggcttgcgccgagcgtgccgcgtttattacggaccccattttgtgctatcgccaggataacgagaagagctctgttaattcgcccaacaaggtgttttgcgtgtgcgatgaatatgccgagatgcaacgttttttggacgagcgccccgagcttaaggctcagcttcagggcattttaatgcgcatgaaggtcgatacgtaccgttggaatgatgagcgtctggtcgatgagctacgcgagcagttttgggagaaggcttcacccgagctcaaggccgattgggatgccggtcgctttgacctgtcgctgttcgacccgcgcggcgagaccgacttgcgcctgatggtcaagtcgccccgcgcctatatcgattcgcgttttgactttaagaagccgggcaagctcaatacgtttaagcattactttaagattggcggcctaccgctggtctggcgcgtgctgacgtatcagcgcacctacggcgacaacccgcaccctgacgacgttccggcagcacagtaggagcgagtgactatggctacccccaagatttccgttgtcgttcccatctataacgtggaggagtgcctggcctggtgcctggactccctgcttgcacaggacatgcccgattgggaaggcgtgctggtcaacgatggctcgccggacggttcgcgcgatattgcggctacctattgcgaaaaggacgcgcgctttacgctggtcgataaggagaacggcggcctgtcgagcgcgcgcaatgcgggtatcgctgcgtccacggcgcctatcgtcgcgttcttggattccgacgaccgatttacgcccgatgcgtgccgtgtgatcgtagatgcctttgagcgcgaggactgcgacgttttgacctttggcgcgaatccgtatccgctggaggcggggtatccgtggcttaactatgtgctgagcccgcgcgatgtgtcgtttgaaggctatagctctgacctgctgtttaaggaagcatctcgcccctttgcatggcgcaccgcctgcaaacgtgagtttttgctgggcaacgggatcgtgtttgacgaaaccgttaagtatggcgaggaccaggtcttcgattttgctgtgtacggtcgttcgcacaagaccgcgcttatctcgaacaagctgtatgactaccgcgtggcgcgcaaaggctcgctcatggacaccatgcgctatgacgacgagacgcgcctgctggagcacgtgaagatttactccgcggtgctggctgactggcagcgcgacggtctcgatgtccagcatgccgatgacctggcgtacttcctatgcgatctggtgctgtacgatgcgctcaggttgctgggttcggactgcggcaaggtgtttgctgccgttgccacggcgcttgccggttctgccgtgggcagcgatgctgcgctcgcacaatgcgctccttctgttgctgctatggtgcgtgcggcgcttatcagcaaggcccccaatgcccgtgagtgcaaaaagctcatgttcgattacgacgtcttgaggtttgggcgcctgggtgcctgcaaacgcatggcagcgaacgccctgggaaagcgagaagtgtagatgagtatcaagcgtttggcgctttgccgcagtcagggccgtctgtttgtgctgcttcgttttgccggtcaggatgtcgccgcgcttattgagcgggagggctctcaggcgtttgcccatgcgacgacgagcggttcttgtgtgccgtcgctggtgctcccggtcgatcatggccgtgtgctggcgctttgtccttccgtttccgattacgagcgcgagctcgccgtcttggtgcttccgtttttggatggctcgtcgatggatgtcgtttttgcatccggtggccaaaggttgggctccattcgcctcgatagccgcgtggccaagctggaatccaaggttaactacaaagcaaagcctgcgctgtgcgcgcttatccgcgatgctcagcgtggcgaacactgcggtttctacgagatcgatgccactcgctatttgccggcagacgccggcgcggtgtggcgctatgaggttacttgggcgggagacctccagtgcgcgcctgagctccagatcttcgatgcgcatatgaatgccatcgatgtcaccgtgcatgtgtttgaatcgcaggtcgatgtgccgcagcagaacggatgccgcgtcaataaaacgtatctgagtgttgagatgcctcaggatatacgagattttgtcgcgattgtgagcgaccccacagagcagatccagagcgggttttgcgccatggatggtcgcctgtacaacggcatggtcgatgacagttggaaccgcatgaaggacgcgcgtgcagacgacgcagcttatcgacgttggtttgagcgacatcgcgcaaagccgggcgatttagcgtgccagcgtgtcgcttcggcggcctttgcctatagaccgctcgtgagcattgtggtgccgtgctacaagaccgatcgggtctacctgcgcgagctgctggactcggtgctcgcccaaagctatgacaactgggaattgctgcttatggacgcctcgcccgaatgggatgcggttgccaatcttgcggcgggcgtcaacgaggagcgcgtccgtcgtgttgagctgcctggtaacggcggcattgtggtcaacaccaacgcgggtattcagcaagcgactggagactacatcgcgttcttggaccacgatgacatcctggaaccggacgcgttattccagtatgtttccgcgctgaataaggcggccgagggcgagcgcccccaggtcctgttctgcgacgaggacatgttccagaaaacgggggagtggggccagccggtctttaagacgcagctcaacgtcgacctgctctatagccataactgcgttactcattttctaatggtggagaaggcgctcatcgatcgcattggcgtgtcgccagaagacgttgcgggtgcccaggattacggcctgacgctccgctgcctcgcggcgggcgcgcgctttgagcacgttgcgcacgtgctgtatcactggcgcgtgctccctggctctaccgccgactgttctgccgatagcaagccatatgctatcgaggccggacgcctggctctgcagcgtcactttgactcgctgggcattcgcggaacggtcgaggagtccgagacgccgtttgtctaccgcatgcgctatgcgctgctggagtctgcgccgctggtgagcattgtgattcccaccaaggaccacgtcgagacgctcgatgcctgcgtgatgtcgatcgcccagaaggccacgtacgccaactacgagatcgtcttggtggaaaacaacagcgaagaccaggagacctttgcgtattacgaaaccctgccggagcgcgtagccgctgcgtctggtggcaagggtgcagcacgcgttgagtggtggccgggcgagtttaattactcccagatcattaactttggcgttgagcatgccaagggcgattacctgctgcttctcaataatgacactgaagtcatctcatccgactttatcgaggagatgatgggctatcttcagcgtcccgacgcgggcgttgtgggcgccaagctctattttgccgatcatctggtgcagcatgccggcattttggttggcgtgcgcggcgcgcttgcccatgccaaccaggatttctcggcaaaacgtgagggctaccttgcccgtgctgtgcgtccgggcaactttagcgccgtaacgggcgcctgccagatggtccgtcgcgacgtgtttgagcaagtcggaggctacaacgaggaattcgccgtcggctttaacgatgcagatttttgtttgcgcgtgtgggaggcgggctatcgcaccatctttacgccctatgccgagctgtatcactacgagttcacctcgcgcggcagggaagaggccaacgaggaaaagatgcgccgctggaaacgcgagcaagcactgttcatgcagcgctggcctgagttcttcctgacgggcgatccatggttggggtcgaacttatccgctgagagcgagtatttctcgctttagaaaatgggttttaggaagtcctcaacttactttcgatatgagctgagaagaaagcagcgtctaggcgatttgctgcaatgcatcacgatagctcgatacttccgcgatacgtttatacagacttatacaactggatataattcgatatagtctacgataaacttttaaagctaagattgaccaataatcgattgtcttgagaggcaaacaagtgagcgccactgtattccataacccgtttcgtcctactgccggcgctgagcctccgcgcataattggtcgtgatgatattgcccttgagtttaccgagagtttgaatgcgggaattggcgcacctgcgaggctcatgcgcatcgctggaccgaggggctccggaaaaactgttttgctctgcgatcttagggatcgtgcgcgagagcttggatggaagaccgctattgtttctgctggccctaacctattgctggacctgagggatcaggttgctgattcttcccttgcgactaatgcttcggtcggcgtaaacgccggctttgtttccgcgaaagtcgatgttgcacccaaagagtcgagtcttagaaagttgctaagctcggcagcgaggtcagccaagggtctttttattgccatcgatgaagttcaggacgctccgattgacgatatgcgtgccattgcgtctacggttcagcttttgataggggaaagagtagatatcgcacttgcctttgccggtttacccgccggtgttatggatcttattaacggcaaggcgcttacgttcttgcgtcgtgccctccccgaagatctggcgcctatcaaccaggtggaggtagcgctctctatgggcgatagctttgtcgcgactggcttgaccatagaggacaatctcctgtcgagagccgctaaggccactaagggctatgcctatctggtgcaactggtcggttattccatttggcagcgcgccaacttgcatcgtgccaaaagtgccattgtgagcgagcgcgacgtcactgaaggcattgcgctggcagaggctcgttttcacgatgttgttcacgagcccgcgatttctggactggggctcaacgatatcaaataccttttggccatgtgcgaggataaacaacagtccaaatcagccgagattgctaggcgcatgggtaaaaagaccaatgagatcagctctattagggccaaattgctacaaagagaggttattcaggcaccacagaggggctacgtgcagtttgccgtgccggatctagatatttatctgcgagataatgccgaggaaattctcgaacggttctaggtcgaggtattattagttttttctacaatatctttttctatccaattggaagaactacggtcggctgctttgctgccataacaatctggtttgttgcggggaaagtcgaatactccataaacaaggctgtttaacagatagcttcaatcgaaggcttgtatttttgctgccctttatacttccggctttgcatgcgttggaccagaagctacatctgtatctaatagtttttcttgtctctgtctttggattcctgcgttatgtgccgctcttttggattcccatcgacgggctgctagtggattttattaaaatttgcgttcttatttgctatattagctggtatgtagacttgtcaacagtgaatttcgcattctcccatgtggcttattggttcgtattgaggatcggaacggtcatatctgttgtcttgttaaaccatcgtcgtcgttatattttgcttgttgctatggcctatctatacgttttgcagggcgggccttcttatgtcgctcgcgcggaaagcctgtttatggacatcgctaccgtcatggccggtcgtctcgggtgctggccgggctttgctcgatgctgatcatttggagctgatcggctatgtgggcgagactattggcgccgaaggaaccccggtggtagcgcttgtggggcaaaacgctgcggtcgagacgcgtatgcccgatacggacacgtccatgaccagtatggtggtttggatcgattcaacggatactgaggcgccagtggggaaggctaatccgaccgggtgtcgagcgcaagcacgtccgcaagtacggcgcgttcggcctgctcgtggtcgacgagtggcttctggacaagccggacactgagttcaggtcgatgctgctggagctgattgagctgaggtgcggcacggcctcgaccgtcttctgcacccagttcaagaagaaggactggcacccgaggctcggcggcggggtacacgcggacgcgattgtggacaggatcgtgcacagcgcggtctggttcgacatgggcgaggccaacatgcggcagcgccgcggatagaccggtagcgataaaaaggcaccggggccagtgtcggccccggtgcccaggcgcgatatcggcggtgctgtttcgcgatattcagcagtgctcaagcgagcaaatactcaacttgagttccgttgataccggtatttcgccttgtccagccaagtatttgggcatagctccgactctaggagtatattgctttcgatagtcgatcatttacttcatctgcttaggtatcgatgcaatatttagtttgagaatatcggtgactcctatgcgtgcccccaaattgtgatacggcttagttgcctgtcgactgtgaatcgtcccaattattatgttttctccttgagaggaagtaggggccacgctcctaagagcgcctgtttacttattttcgcggcaaacgaaacccatcacgcctttggtggaaatgctgtcgactccacgcgatggtacattagtttggaaatgaatatctccaaattgaccacctcctccctcaaacaaaaaagaaggattcatggcattaaaaattgttgacagatatagtattgagaacaagtgtcatataagtgttaagaggtatcttatggatattgtcgattacgtttctttcaaagaagtattttgctccatcatgggaatcaagagctctccaaataacgccagtgatgatttgacatgtcatttaaatctcagttatcgaattgaagaagagtttgaccccgagatttcggattttgagaagacaattattataaatgacgacgacttgaaacacgaatatgataaagcggttgaggccattggtgattttcatggtatggaatggttttcaaatggtaagaactatgagtgcatggtcgatatatccggattatatgcaactcattttacagatcaaatttcatgtaaatcggtaaatgcagatgctgaatttagaatgggtccggcgagcgttacatatattttttgtattatattaatgttattaaatgaaggttgttttgacggcaatactttcagaggcagaaatccttttttgcgacgcctgagatcgcattcaaccaccggtggaagaaccgtatctcataatgttgatgattggacatctgcttttgttgaaatcacaggtattctctccttacgaataactaccaaagggtttagaaaagcgaaacaacttcgtgaacgagcaacttccttccaatttaagtacatctcttgtttagataggccactgaggctaatttcatcgcttgatgagtttttagaaaaaggaagttacgggaggctatctgttgcgaagttagaaattgattgtgttccggatgtaaaatttgacgacagcgctgttaatcatttttgtcttggcgtgtcttcgagaagcccatatttgcagtttttgtccttctatcattcgattgaattttactttaattccgcctatcgaaaaatgacgaccgaattgttgagaaacgagctccagtcggttgaatttgcatacaacgatcagcatctgtattcgattgttagtaagttagaaaaagaaatatcccataagagcgaacttggttttggaaatgaaaaacgtgagcttgaatacttggttgagtcgtgtgtccatgtgcctcggctaatgaaatccctacgtcgctatcgtttcgattggtctgtgtggtattcgagcaatggggttgaatttgaatctgatgctccagttatagattgggaatccgataatgtagctggattaatagcttcccgaatttataaagtaagaaatgcgattgttcacagtaaaaaacaaactttcggtgcgtttattccttttaagcacgatcgcgcactttcctatgagattcctttagttaaatgtgttgccgaagaggtcattgataacaattcttcgcgcgtatagctttcgctttaaacttccgtttggttcatagtctttgtggtcaaacttagcattgagatatgaatttcgtttcgattggatggcgattatttcgatacggccatgacgccggttgcggatggatgagtcagtattcactgtctcttctagatcaggattgatgcgagcgatccctcgcttcttccaatattctgttagcgccgggcgattttagccgctaatagtcaaactattttgaccaatcccggtcaccgaataatggccaccgtgcctccccgccgccactacgctggtggtgccaacacgccggcgttaggaggaccattgaggtgaacgagagacacgatgacctacaggagattatagacgcggcgctccgggagatggccgcggaggagggcgacgggttcgacccgcaggcatgcaacctcgcggagttctgcaggaggacggggctcacccgctcccgcgcgaggacggtcagggcacacgggttcagggccctgccccacgggaacagcgggaggagggccgcgccgggcgtgctcgccggccacaccggcctggtggacgacctcctgcggaagggcgtcaccaactcgcaggtgatattcgagcggctgctcggccagggctacgccggcggcctcaccacggtgaagacctatatcgccgcgcaccgggacctcgtgcccgcgaagaggcggcagtggattggcaacacctatttggacgattccgggagggacagccccgcctccctgacgtagcgggtggtttaaagctggccgctgcgcggccagcggactaaagtcttgaatcaaaagggccccggccgagaattcgaccggggcccttggacagagctatatgttgttgcaagtcgtgtgtctacgagctactcctcgacaagctcaaactcatcggggccgacgccgcagaccgggcacacgtagtcctcgggcagctcgggcgtgtcgacctcaacctcgtaaccgcaaacggtgcacacaaacttatacgtcttcttctcctcagccatgatgttctcctctcgaacgtgactgctggtgtacttacttattagtatatattctcaatagtataatgcaagtatttttagaacatttctagccttgatacgacgaggctttgggcggcgtcttgccctttagcaccttgtgatagtagtcgtacgtcagcggcgtctcgtcgctcaggcgctcggcatcctcgacctcgccaataaacagcagatgcgtgcccacatccacagtgtcgatcaaacggcagctaaacagggccgccgcgtgctcgggcacatagggcatgcccagagccgtctcgcgggtctcgtatttggcaaacttgtcataatcgctgctggtgcggaacccaaagttaccgatgtagagcatgtcggccgtctgatcgatcacggtcagcgcgaacgctttggccgatgcgatgacgcccgaggtgacattgtccttgttcacggcaaccgaaatacgcggcggcatggacgtcacctgcaccgcagtgttgatgacgcagccggcgcgcagcccgtctgccgcagcgctcaccacgtacagaccgctcggcatggtaaagaacgcagttttgtccataacgatcactcccctagctcgggttggaacctcatgaatgtatgtacccacaaaaaaggcggcacccataacggacgccgcctttgagacatatgtgtcagaacagtaagaaagataagacgcccgcagttgcggtgaaatagggactgaatagcccctcaaacaggcaaaacagtccgtatctcaccgcaacttatatagagcgcctagcggttgcgttccttaagggcgcggtcgatctcgcgttggacatcacgcttggccatgtcctcgcgcttgtcgtagagcttcttgccgcgacccagacccagcagcagctttacgcggccgtccgtattaaagtagagctccaacggaaccagcgcataaccacggttgcgaagtttgccgtcaagaaagtcaatctccttgcggtgcagcagcagacgacgacgacgatcgggatcgcgattccacacgccaccatggctataaggatggatatgcaggccgacgagccagcactcgccgccacgaatcagcgcaaaagtgtcagtgatctgacaggcgcgctcgcgaatcgacttgacctcggtgccgctcagttcaatgccgcactcaaatgtctcatcgataaagtactcgtgatgtgccgagcgattcttggagatgagtttgcgctcgcgcttactgggcatcgtcggcctccttgacatcgtcagcgcccttgtcgacacccgcgtgctttgccttgcgctcggcattgagctcggcatcgctctcgcgcaccagtttaataatcgccgcacaggcctcctcgcccaccaagtcgcgagcacgcgccgtcaggcgcgtcgcctcctgcttgtcgccgtcgcttgcagcatcggtcgcgcacataatcaggcagatggcaatctcggccgaaggcgaggtcggaacgccctgcaacgccagctcgcccatcacgtgctcgtcgctctcctcggcggcatccggataggtagtatggatcttgttgagcaggcgcgtcgtatgcgtatcgttgggcgccaggcgcagcgccagacgcgcgcagcccacggcagccgaaacgttctcggtctcgggctccaagaagtactgacccagattggcgtaagcgcgggcggcgcacttgccatcgctcgcgcgctctagcaccgaaaacgaaagcgaagcccactcctgcttgtcctcgagagcgcggaacagctcggccaaatccaagcgatagttgcagttcatggggtcccaacgcacagcctgcatcaaggcattacgagcgctcacataatcctgctggcgaatgtaggcaaacgccatgtcagagtacaggcggtcaaacggcacctcgacctgcacgagctcgcgcggatccttctccacgcggcgataggccaagcgctcaaacttgctatcgaagctaaagtattggcgcttctcctccgtcttgcactcggcgtcgatatactcctcggcgagctccaccaggcgctccagcagcggcgtcgccgtagccaggtcgccctgcgccagatagttctcggcatacgtgatgtcttgcaagctgatgggcaggtccatgacaactcctcggtccgggcggcagactcaacgcgcgccttaaacatcggtcaatacacaaaacccgggtctcttacgaggcccgggcgttcattttgtggtagcccgtaccagattcgaactggtgatctccgccttgagagggcggcgtcctaaaccgctagacgaacgggccatatgtagcaaatgcaatggctgggatggagggagtcgaacccccattgacggaaccagaatccgctgtcctgccattagacgacatcccaatgactgcatcgctgcgctcggctgtgcctttgcgcaagaaagaaatatacgggaagtcccgccgtgacgcaagccccaattttgacttttttgaaattcagccaaattggcctaaattggcccaacccgtgaaggacctgtgaagccaaccgctgtacacgaagggcaaaacgccgtgagcggtagccgtcaaccgttggcagattctaccgtgaaaacgatagcaccaggcaacacaatcgaagtatcaatgatcgcgtagatatcgaggcgccatggacgaagagcttgattacctatgggagaccctgggcctcgagatcactgccgacctttggcccgaacgggacaaaattcaccccacgttacgccccgccattactgtggtgcaggcaaaataccgccgtgcatcctttttaatcatgcggatgtcatggcacgcgggactccccgaccttaagcgaatccaggcaagcctcgtcgagctgtccggcatgccgaccgtcatatccgaggcgcacctggagcagcgccagcgcgagcgactgcaacagcagcggattccctttatctgccccggcattcaggcatatctgccctttatggacgaggagtactggagcggcaagcccaacaagcacgtaaaggtctacgatccgcacgaatgggcacagcttgaggattagcgcatatgcccgccagccgggatagtgcgcatgcccgccaaccggaaagctcatcccggaatttacgtccagaacgggacgcgctttcccctagaggccccaaacggaaaccgtatcccagatttcgcgctcaaactgggatacggtttccgctagccccttcaaccggaaactgcgtcccggaatccgagctcaaaacgggacgcactttccgcagccgctacagcaacgcctcggcccaagccgcttccctaaagccgggaatcgcaaagtcgtcgcccaccagcagcggacgcttgaccagcatgccgtcggtcgccagcagctcgtagcactcccgattcgtcatgcccgcatccaaccgcgccttcaggcccagctctcgatatttcatgcccgacgaattaaagaagcgccgcaccggcagccccgaacgagcaatccaggtcgcaagctcatcagccgcgggattgtccaaaacgatatcgcggtcgatgtactctaccccatgttcgtccagccatgccttggccttcttacaggtcgagcacttgggatattcaacaaacagtacggtcatgggaatcctccgaatatagatcggccaacgcgggcacacgccacacgaggcgccttcgtatgatgggccaattgtagcccacgggtcacacgctaaacgaaccgtaccccgaatccgcgtttgatgaacggcagtagctccattgcctcgggcgtgatatggcccgcaacgttcatgcgctcgtcaccgggaagatcgacccgcgcaatctcaagctcgccttcgtagcgcccatatccgctattgctcacagcgatcgaccccgcctttcgcggcaggccggctccggcatccgtcggcacggaatccggcttaagcgtcgtacgtgactcctgagacctaaagatgaggacgctcgagtcgggccggtcgtgatgaatctgcccgcgcgcataggcataaccgggctcaagctcgcattgcaggtccacgtatccggcggaaacttgagcaaactgcgcccagcccgcatcggatagatcggggtcgccgaccaacacaatgtcgcaatcggcgccatgtgcaagctcaagcatattgagagcaacctttgacgcgcgaccgcgctgcgcctcgaccgtcggcagtccctcgaataccggcccgcgaacgttagcatcacccggcacaaaagccatgatttcgaatccaagcgccgcaagacgaagattcacccgagcaatgtcctccagagctaaaccggtataaggcttggggtaaaaattgtggcaggcggcaaaacgagtcacatcggcaccggcctcacgccacgatgcgatttcatcagaactcactgtcgatgcattgaccacaatgcgaaatacaccggacagctccgcgacccgctgggcgctaaagccatagtccaaacgaaggtattccaaccccagatcgcgcagggcctcgatgcgctcaagcccgagcaaatcgcacgtgcgaggccccacatcggcaatgagcgcaatgccgcgggcggaaagcagcgacagcacatgacggaccttatcggcatacgccgctcccccatcctcgggaatatgcagcgaggtgaacgcatagcgcgcacccgccgcggcaccacgctcaatcgtccgctcaatatcctgcaaagggctggaaagataaatcgaaatacccgttttcacgcttcaacgctcctttaaaaaaggccggcggagcagctagccccgccggcacaaccataacatcaagaaatctgccgcgcgccgcgagctctgagcaacacggctcgcgatatcaaactactcgccaaagaactcgttgatcttctgctcgtcgacgccaaagaaccacgtcaggacaaagccggcggcataggcaagcagcatagcggcaacgtagccgagctgctggccaggaacgacgatcagcaggccaaacagaccggaaacgccctgagaaaccgtgccgatgtgaagcagcgccgcgagcgcgccgccaaatccggcacccaggcaggccgtcacaaacggacgaacgagcggcagcgtaacagcatacatcagaggctcgcccacacccaggattccaacggggatggactcggcgacgtacttcttgagcttggcgttcttggtcttaaagtacagcgccaaaccggcaccgacctggccgccgccagccatcataaggatgggaagcaggtaattgatacccttggtagcgccgtcgggatcgttgagcatagcgtggatcggcgtgagcgcctgatgcaggccgacggacaccagcggcaagaagcctgccgacaggatatagccgcccaggacgcccaacttctcgaagataaaggtcaaaacgctaaagatggcagtcgtcagccatgcgccaaccggctggatgacgagcatcagagcaaaggcgccgatgatgagcaccagcagcggggacaggaacgtgtcgagtgcgttgggcataaccttgcgaatctgacgctccatccaggcaaaaaatgcaccagcgatgagagccgcgatcatgccgcccgctgcggggttgtactgcgcattggtgagcggcagcagaatggcagtggcaggatcagccgcgccaggcgcaagcaggggcatggcactgttggcgatacacatcatgccggcgatgccgcccagcgcagcggagccaccaaactcacgtgccgcgttatagcccaccaagatgggcagataggcaaacagggcccagcccatggaacgaatgccctggtaccaccactcgcctgcaagcgcgcctgccgtcgagacgttaatgacgttgcagataccgttgatgaggccagccgcaatgatgccgggaagcagggcgacgaagacattggaaatcttcttgaggaaggcctgaaccggcttggactcgtacttggccttctgcgcggccttgttcgtggccgcagcgtcaaccacgctctcgtcggcaacgcctttcgcaaggccggtgagcttggagaactcctcgagcaccttattcaccttgcccggacccagcacgatctgcatcgtgtcgtcctcgaccaggcccatcacgccgtcgagcgccttaataccctccgtgtcgacgttgcccgtgtctttgacggtcacgcgcaggcgcgtcatgcacgccgcgtttgcgagcacgttgtctttaccgcccaaaaggtccagcagcttttgagccagctctttgttcgtcataactcctccttgtattgggtatctcgtctagatgtcatatcagctcacgccgtgcacctattggacatcggcattgctcttctcatggccactcaccgcagtacggacatggccgtgcgcccgttcaagagctaccgcagcctgctcggcatcgcagtccaacagcaccgagacaatagcggtttttacgtggccgccggcatccgcaagcgcctgaacagcgcgctcgcgcgtgcagccggtcgcctccatcacgatgttctggccgcgcaccaccaacttctcgttcgtctgctgcacatcgaccatcaggttttggtataccttgccgatcttgaccatggcaccggtcgaaatcatgttgagaatgagcttttgaaccgttcccgccttgagcctcgttgagccggtcagcacctcgggaccgggcacgggctcaatggcaagatctgcgctctccccgatcttcgacccttggttgcaggcaattgcaatggtcttgcacccagttgccttggcgtacgcaaggccgcccaccacataaggagtacggccgcttgccgccaggccaacgacaagatccttgtccgagagtccacgctcccgcaggtcgctcgcgccaagctcctcgctgtcttcggcaccttcgacagccttgataaacgccgtctcgcctccggcaatgagcccgacaatcagatcgggtgacacgccaaacgtgggcggacactccgaagcgtcgagtacgcccagacgaccgctggtgcctgctcccatgtaaaagacgcgcccgccgcgctcgagtgtctcagcagcccagtcgattgccatggcaacctggggcaacactttcgtgaccgactggacggcacgaagatcctcatcgttcatcgtcgtgacgatttgcagcgatgtcatcgtatcgaggtccattgacctttgattacgctgttcggtcgtgaattttgttaaatcgagcatttcattcacctcatctttcctgtttctcgatgtagttttgctttatgacatgcgtcgcccgttcgtagtcgctggcaacgtaagcagcgtacagggcatcgacaaccataagctgggccatacgcgaagccatggcaccgctgcggaccaagggttcactcgcagcgacgccgagcacggcatcggccatggtggcaagattggatgatccatctactttggtaacggccacaacgggacagttgtgacgttgagcctcggcggtgcagtccagcacctcttgcgtcaagcccgagtagctaaaggcgattgccatatcgccctcatgcatgttcttggcacataagagctgatcatgccagtcgtcgtacagatggcactctttgtcgacacgcatgagcttttgcgccggtcgtgcgcgaccaaacgagaggcaccaataccgaacagattgaccgcgcgtgcccgcttaagacgggccgcgcatcgctccaagacggtgtaatcgagcgttcgcgccgtcgcctcgatcgtgcgcacgttgcttttcatcaccttccccacgatacgttcgacgctgtcatccatggagatgtcctcgagggctacgtctttcttgtcacctaagagcgccagctcggcaatcagttcgcgctggaactccttgtagcccgcaaaacccaaacgcttgcaaaagcgcaaaatgctcgagggcgaggagaacgtgacatcggcaagaccgcggacggacagcccgaccacctcgtgcggatgagcgcttacatatgcgatgacattgcgttccgccgggctcgcgctgagctcacgctcgcgaagccgcaaaagcaatccgtttgccatctcaaacacctccgttgagaagaattaaagaccaacgaacgattcgtaccggatacaaacagcttttgcggtacattgtgccgcatcgtggcgcacaaagggcgagcgttctaccgctcgcccctcaaatccgaccgctcggaaatacgcgcgacacaaaataattcaacaaggtcgcattatcagaaacgggtttgttaccggctagcgcctcgcatgggcgccgatcggccgagtcgcatggcgcaccagcgccgctgccagcaataccaacagcatggcggtgacatagcccgcagcatcgaatcctaaatcgataacgtcgaaatgcctgccgggaacaaagatcttatgcacctggtcgccaacggagcaggcagcgcaaaagagaaacacaggcacgcaacgggaacacacactccatggacgcctggaaaagcagaccacgatcaccgaggcgaccaatccgacgaagaaaaactctacggtatgggcgacgcgacggacgtttgcgcctacccacatgcgaatggaagcaagtcgaccaggctggaccgtcgaggcagccggattggtactctcagtcatgccgtcccccgcctgaatttcacccgtgatgccggtagcctgaacgcccgtagcctggccctccaccacacgcgcggtggactcgctcagcaacgacgtctccaccgcattttgctccgtcagcacccagatgcccgccagcgttgcagcgaacagaacgatcgcggtccatccgattatttgttttacgcgcgccaagggccaacctccttttttgaatatcagcgagtgtagccccaaatggcatcgtcaccgtatcaaaatttgaatcgcaacaggaagcgacaaagcgacgcaaacccctaccccgcctcgcgcatccagcgatcgaacgtccccacgcacacgcccaggcactttgccgcctggctgcgggtaatatcgcccgcctcatagctatcgcgcaccagctcaaactgaggagggcacggcttgcgaggtcgaccgaaacggacccctcgcgcccgcgccgctgcaattccctccgcttggcgccgatggatattctcgcgctctacctgcgccacgtagctcagcagttgcagcacaatatcggcaatcaggacgttggtcacatccggcgcgccgctggccctagcgcgcgtgtcaagcaatggcatgtccaacaccacaatggcaaccccgagctccttggtaatgcgtcgccattcctcaagaatctcggagtaattacggccaagtcggtcgatagaaagcaccaccagtacgtccccgtctcccaggacgtgcagcagctcgcgataacgcggtcgatcgaagtccttgccgctcgcatggtcggcataaatattcgccgagcccacgccataggcgcccagcgcatccagctgccgattaaggttctgatcgcgcgaactcacccgcgcataaccgtacaccgtcgccatctcatccccgctttcttgtaaacctgccaaaaagggacaggtttattttggtaggttttacctctcaaatagcaggtaagcgggcggccgagcagacggcaaggtagccacgattcaaatgcgaagggcggtcccgaaaggccgccctccgctctctcgccacgagtcgggatttagctaatggataagcttaaagtccaagtgcccacgcgtggtattgacgcgcgagacctcgataatcacgcgctgccccagctcgtaacgggtgcccgtgtcggcacctgtgagcgttagcgcgtcctcgtcgaactcgaaccactcgttgcccaggctcttaattgaaaccaggccctcgacctgtgttaggtccaagcgcacaaagaggcccatgctgctaacccacgagacggttccggcatagcgctcacccagacggtcctcatagtactgggcaatcttgatcttttgcgtcgcatggctggcggcatctgccgcgcgctcggcatcgctacatgcgcggcagatctgcggcagaatgcgcggcagcgactcgcgccccttaccgatcagccgcggcgtacggaccaaggcgtccttgccgccgagctgctcataggccaactgcagtttgagcacgcggtgcaccaccagatcggggtagcgacggatgggactcgtaaagtgacagtagcacggcgcggcgagcgcaaagtggccctcgttgcgcggcttgtacagcgcgcgctgcatgctgcgcagaagcagcgtgttgacgagcggtgcgttggccgtaccggcggcagcatcaactgcagcctgcagctcatcggggctccccagggcaataccggcagcacggcgatcgtcgatgatgcctagctgcgccagcgcaacggcagcaccgtgcaggctatcggggctcggatcctcatgcacacgatagcaggcctcgatatcacggtctgccagccactctgcaacgcactcgttggcgagcagcatggcttcctcgataagcgacgtggcacacgaacgctcacgcgccacaatctgcacgggcactccgtcctcatccaatagagcgcgaatctcggctgtgtcaaaatcgactgagccgcgggcgcgacgaatacgacggcgaagttcggcgagttcgttagcggcgacaaggaaatcgccgaggtcgatgttgtagccgcgggcggcctcctcgcacgcaagaccgcgctcaagcgcttcctcgcgcgaggtctcggcagccgcaacatcctcggctgcaccctccagcaccgaatactcaaccgcgccggcacgcaccagcagcgcctcggcgccgtcatagtccatacgcacacgcgagcgaatcacgctgggatacggatcgtaatgccgcacgcgaccctgcgcatcgagctcgatatcgacggtaaacgcaagacggtcctcgtcagggcgaagcgagcacaggtcacaggacaggcgttcgggcagcatgggaagcacgcgatcggccagatacaccgatgtcgtacgatggcgagcctcaagatcgatatgcccgtcccaagccacatagtgtgaaacgtcggcgatatgcacacccagcttgtagccaccctcgggcgtacgctccagcgaaatggcatcgtcaaagtcgcgcgcgtcgaccgggtcgatcgtgatgacaaagcggtcgcgcagatcgcggcggagcgggtccttaagcgccgcggacacatcgagcgaaagcccctcggcctcgtccagcgcggcctcgggatagctatcggtatagccgtaacgcgccatcacatattgaacgcccaaatcgggcgcgtcatctccgccaatgcggcgttcaatcgtcacggtgcccgattccaggcgcgtcgggtaggtcaaaatgtgcgcgacaacagcatcacccgggtggacgcccagacgatccgccgaggtatcctcgggcagaatgaagaagtcggccttcagacgcgaatcgagcggctcaatcacaccgagcggaccggcggtctggtacgtgcccaccacgcttatggctgcacgctcaaccacgccctcgatcacggcgcgccgctcaccgtgcgggctgttcttaatgctcacggcaacggtatcgccatccatgatctcgcgcttaccgcggcccatgaccttgtagtcgccattctcggttatgacataggcactgtgctcatggagctgcacgcgcccggtcaggctcggacggcgttcgctgcgcaccggcccgcgcttattgcgagctccacgcttatgcttgttattgcgccccatggcgcctcctaactatcgattgcgaactccaaagagtctacccaaatgattcgctttcctgccgtcccctagggatcaaaaaacgggccgccccataagagacgacccgttggaagggatgaattccaggcatgcctacacgcgcaggtagcggcgcatggcgatggcagaaccaaagaaaccgataatcacgccgaccagaatcagcgcagcataggtcaccaagtagtactgcatcggcagggcaaacgacatccagccgatgctctcctgcagacgcggaatcatcaggttgcgcagcagctccagaacgccgatggaaagcaacgagcccaaaatggcctgtagtacgccctcggtgataaacgggccgcgaatgaagccgttgctggcgccgaccagacgcataatcgcaatctcacgacgacgtgccgtgatggataggcgaatcgtgttgttgatgaagatgaaagcgataaaggtcagaaggccaacgagcaccacggcggcgatgcggatgtagttggtcacctggaacaggcggctcactgcctcctggccgtacagcacgctcgcgttgacgtcgccgtcatccacgatcttctggaaatcggcatccttcttgagcttctctgccgtgctctcgaccttggacggatcgtccatctcaatagcgaaggaagccggcagcgggttctggccatcgagcgcgctcatggtggcgtcggcgttgcccgacatcttgctcgaatactcggccttcgcgtcgtccttgtccttataggtcacggacttgacgttgctccacgtcttaagctcggcctcaaaagcctgaacatcagcctgatcggcgtcatcactaatgaaggcgttgatgacaacctgatcctcgacggtgccgatcacggagttcagcaccgcggagcccataatgaacaggccgatgataaacagcgaaaggaagatcgtgatgacggcgccgagcgaggtagtccagttacggaagaagtggctgattgcctctttgaaggagtagcccacgttagttggtgccatagttgccgtaacctcccctctcctggtcgcggatgacgtggccgccctcgagggcgatcacgcgacggtgcatgctatcgaccatctcgcggtcgtgcgtggcgacgatcacggtggtgccggtgcggttaatacgctcaagcagcttcatgatgcccagcgagatcgccgggtcgaggttgcccgtgggctcgtcgcagatcagcagcggcggacggttgaccatagcacgggcgacggcaacgcgctgctgctcgccaccggaaagctggtcgggcagcgagtccatctgatcggccagaccgaccagacgcagcacctcgggcacctggctgcgaatgacgcccttgggcttgccgatgcactgcagggcaaacgccacgttttcgtaggcggtcttttgcggcagaagcttaaagtcctggaacacggcgccaatctggcggcgcaggaacggaaccttgcggttcttgatcttcatgaggtcctgaccggcaaccaggatgcggccgctcgtcggcttgacgtcgcggttgagcgtcgacagcagcgtggtcttacccgagccggagtgaccgaccaggaagacaaactcgcccggatagatctcgatgttgatgtcgtcgagtgcaggcttgttgggctgtgccggatagatcttggtgacatgctccataaggatgacgggctcgacaccggcctgcttggccatcttcttgcggctggcctgcggatcgatgggcgcaaacaccgacgtaaaatcggggttgttgagcgcgttatcgaggcttgcgacctcggctgcctgatcgctctcgaccaccggggcagcaggctgcgtggggtcgggaatagcggcaaagagaccggactgcgcaggctgaggagccggcgtcgcaggggccaaggggtcgggaatgccggccatggtaggctgcggcgtggcggcaccagcctgaggctgctccacgcgagcggtcacggcctgaacgggctcaaaacccgccgtgccggaaagcgcgacatcgctggttggattgtaggcaaagggatcggatgccggctgtgcctgatctgccggctgagcgggggcctgagcaacaggctggccctctgaatccggagtggcgaaacgactgccctggacgcctgcctgcgtcttgggggcatcatcgcccgcaccggaggtacggaagtggttacccactggtgctccttatcgtcgtgcgtttaaactacatgagcgctttgtattttagcagtattagctttactgcacataagaagcatggcggggcctggtccctccggccgcgtacagggttacctcccaaatcgtcctcggacatgtcggagcccccgctgcgcgcttcgcgctgcgggggctcctccgtcctgcggaaagattcgggaggtaaccctgtacgcggcctgcggctactaaggggccgccgcgtttatcttggggtgctgcatatacaaagttggaagggtctgaattgcactttgccgatatatgcccttttccctgatgggaccgtgcttgaggggcgtcttcatgagttgcggtgaaatagggactgttgagcctttaagctggcaaaacagtccttatttcaccgcaactgaaacaggggcgctctccaagagagcgcccctgccgggtttccatagtactggcgaaacagtccttgagatccgccttgccttatgccaagaactccttggtggtcgccacgatgttggcggcgtccaggccatacttgtgcaagagctcggcacccgggccggactcgccaaaggtgtcgttgacgccgatcttcttgaggggcgtcgggcactgctcgcacaggacgtcggcaacggcgctgcccaggccaccgattacagaatgctcctcgacggtcacgacgtggccggtcttggtggcgctcttgacgatcaggtcggcatcgatgggcttgatggtgtgcatgttgatgacctcggcatcgatgccctcggcagcaagctgctcagcggcctcgagggcctcgccgaccatcaggccgcaggcgatgatggtaacgtcggtgccctcgcgcatgacgatgcccttgcctacctcgaacttgtaggtctcggggtcgttgatgaccggcgaggccaggcgggcaaagcgcatgtacacgggaccgtcgcactcgtaggcggcgcgcgtcacggcgcgggcctcgacgtcatcggcgggaacgatgacggtcatgccgggaatgacgcgcatcagggcgatatcctcgcagcactggtgcgtggcgccgtcctcgcccaccgagataccggcgtgcgtggcgccgatcttgacgttgagatgcgggtagccgatggagttgcggacctgctcaaaggcgcgaccggcggcgaacatggcaaaggtgctcgcaaaggcaacgcgaccggtggttgcgataccggcggcaacacccatcaggttgctctcggcaatgcccacatcgaagaagcggtcggggcaggcggccttaaacttgccggtctgcgtggcggcggccaggtcggcgtcgaggaccacaaagtcatcgtgctcgttggcgagctcgacgagggcctcgccgtagcttacgcgcgtggcgattttcttgacgtctgccatcctagagctcctctccggcggccgtgagctctgccatggcctgctcaaactgttcatcgttgggggccttaccgtgccaacccacctggttctccataaaggagacgcccttgcccttcatggtctcggcgataatggcggtcggctgacccttggtagcgcgagcctcggcaaaggcggcgcggatctggtcgaaatcgttgccgtcggcaagctccaccacgtggaacttaaaggcacggaacttgtcggcgagcggcatggggtcgttgacctcctcgacggggccgtcgatctgcaggccgttgtggtcgacgatcacgcagaggttatcgagctgctggttgccggcaaacatggcggcctcccagacctggccctcctcgctctcgccatcgcccagcagggcgtacgtgcggtaagtatcgccccagtgcttagcggcaaccgccatgcccacggcggcggagatgccctggccgagcgaaccggtggacatgtcgacgcccggggtgtcgttcatgttggggtgaccctgcaggtgactgccgatgtggcgcagcgtctcgagatcctccttggggaagaatccgcgctcggcaagcacggcgtacagaccaggcgcgcagtgacccttggaaagcacgaagcgatcgcgatcggccttgcggggatcggccgggtcgacgttcatttcctcaaagtacagataggtcatgatgtcggcagcgccgagcgaaccgcccggatggccggacttggcagcgtgcacgccggtgacgatgcccttccttacctcgttggcaacctttttgagctcttcgtcgctcattgtgccttcctttcatcctcattagacaaaatgcgcacggcaccgaaggtaatcccaacacagccgcaatgcacgtacgtcattcattatgctggaaactgatggctttaccagagtttttatcattatttgaacaatttagcaggcagaaccgctgatgaaacggtttatcaatgtgaacgtcttttggatgcggtggctgcctctcgccccggcacaaaaatgatccgcaaaccgaaattcagcctacgcgttaatgtccttgaatccttcaccgaaggcttccgtaacgtcggcgaccgtcacaatggcgtgaggatcgcgttcgcgcacgatcgttttaagggtgttgagctctcgacggctaacgatcaccatgatcaccggcttctcgacgcccgaatacataccggtcgcctttaatttggtgcagccgcggcccagaccatacatgatgtcggccgcgatatcggggaagttatccgagatgatgagcaccatacgacgcttattgccgccatcgaccacggcatcaatcacatagccgctgatcaccatcgaaagtcctgcatacagagcattttcgagcgagaagaccggagccgatgccgcacatacggcaacgtcgattgccatgacggtcgagcctaccggcagcgaggtgttacgcgagatgatttggccaatcgtgtccgagccgccggtgttggcgccggcgcgcaataccatgccgtaaccgatgcccgtgataatgccgccccacatagcgggaagcatcaggtcagcatgtgccagaggcgcaacaaacggggcaaacagatcggtaaagaagcccagcagcacaaagcccgtcgccgtctgcaccacgtagaacatgccgccctcgcgcataacgaccagtagcagcaaggcattcatcacgatggtctggataccgacgggaagcgacacgcctcgcgctgcgccgactgcctggataatagtcgcaaggcccgtaacgccaccggctgcaaggccgttgggaatcaaaaacaggtcggtcgcgatggcggccaaggcacaccccaacatgatctggggcagatcgtgaaagaagttcatcgaaagaatgcgcttgatgtccagacgatatgccatgctgcctcctttaaaaaagcgcaccccatcggatgcgctttgaacttcttcttgtattcgattctaccgattcgccggacaaaaaccacccctgcgcagggtttattctggatacaaacccgtccaaccgttgggcttaacatcggcttgaagctgcccgatgttttagacctccgagccttctgcatcggcgttgccggtggcccagcgatggtagccaataacaaacgggtccaggtcgccatcgtcaagaacggcctcgacattgctggtctccacgcccgtgcgtaggtccttgaccatctggtacgggtagagcacgtagctgcgaatctggttgccaaaaccgatcgtggtcttgggtccgcgaatctcatccagggcctcggcgcgcttctcgagctcaatctcgtacagacgcgccttgaggatctgcatgcacgcggccttgttttgaatctggctgcgctcgttttgacacgtgaccacgataccgctggggaaatgcgtcacgcgcacggcggagtcggtggtgttgacgccctgaccgcccgggccgcttgcgtggtatacgtcgacgcgaatgtcatcgggattaatctcgatatcgatatcgtcgggtagcaccggaatgacctcgacgccggcaaacgtggtctggcggcgcttcttgtcgtcggtggggctaatgcgcaccaggcggtgaactccggcctcggcgcgaagcatgccaaaggcatccttgccttcgacggtaaaggtcgcgcgatcgatgccgatgacctcggccgcggggcaatcgttgatggtgaccttccaaccgcggcgctggcagtacttcatgtacatcttaaagagcatgaaggtccagtcctgggcctccagaccaccctgtccgggcttgatggtcacgatggcatcgccgtgatcgaactcaccggtaaaccagctcgaaagctcaagctcatcgatggcacgggccaggcgctcagccgtggctgcagcctcctcgcgaagggcggcggcgtcggggtcatcccccatctcctcggcaagctccagcgcggcgcgggcatcggaaagctcgccgcgcgcggtgtccacggcagcgatatcttccttggtgcgcgcgatctcctccatggtggcacgggcggcgtcggcgtcatcccaaaagccaggggcaacacttttggcctcgagctcgaacacgcgggtacgcttctcgtccaggtggagatacgactcgacctcaccgagccggtccgcgaacgcgtccagctcggcgggcgttacctctaaagcctcagccattaacgattcctgccgtggcagtacttaaacttcttgccgctaccgcaggggcacgggtcgttgcggcccacgttgacgtacggatcgtcgctctcggacttgcgataggtggtcaccttgccaccgttgttgacggcagccggaccaccctggacagccgtgcgggcctgcacctgcgcctgcttgcgcagcaccgagtcgccgttgtcaccatcgacctcggcaggaccggagaagcgcgcaccctcgagcgcgggctcctccttgtgctccacggcacgcggggcagccttgatctcgatgcgcagaaccgtgcgcaggtaatcctcatacatggtatcgacgagtatctggaacgcgccgtaggcctcggtcttgtactcaaccagcgggtcgcgctggccaaagccgcgcaggccgatgccggtcttgaggtagtccatctcctgcaggtagttcatccagcgggtatcgatgacgcgcagcatgacctgggtgttgagctcgcgcatcaggtcctcacccaagcgctcggccttcatgttgtagcacttctccacgtaagccaggacatcggcagccagggcctcataatcctcgtcagggaacttcggcgtatcgatgtggccggtgagctccacaacccacttgcgcaggccctccaggtcgcgctcgccatcgtgactgtccttggtgcagaactcctgcacgcagcggtacacggtgtcgtgcatgacctcggtgatgtggtcggtcaggtccttgccgtccagaatcttattgcgctcggcgtagatgacctggcgctgcttgttcatgacgtcgtcgtactcaaggacgctcttacgcatggagaagttgatgctctcgaccttgtgctgggcgctctcgacggccttggagatgatcttgtgctggatgggcatgtcgtcgcccatgtcggccgtgaccatcatcttggagacgcggtccatcttgtcgccgccgaacaggcgcatgaggtcgtcctcgagcgacaggtagaactgggtctcgcccggatcgccctgacggccggagcggccgcgcagctggttgtcgatacgacgggactcgtggcgctcggtgccaataacggtcaggccgccggcggcaagcacgcgctcgcgctcggccttgcaagtctccttggcctcggcgttaaactgctcgagttgctcgggcgtcacgtcctctatggtcaggccctcgtactcaaggcgctcgcgcaccagctcgtcggggttgccgcccagcaggatgtcggtaccacgaccggccatgttagtagcgatggtcacggcgccgtagcgtccggcctgggcaacgatatgagcctcgcgctcgtgatgcttggcgttgaggacctcgtgcgcgatgccgcgcttggtaagggcggcggacagcttctcggagctttcgatggagacggtgcccaccaggaccggctgtcccttggcgtgacgacgctcgacgtcgtcggcaacggcgttgtacttggcctgaatggtgcggtacaccaggtcctcgtggtccacgcgctgcacgggcttgttggaggggatgacctcgacgggcagcttgtagatctcgcggaactcggcatcctcggtaagtgccgtgccggtcatgccggagagcttgtcatacagacggaagtagttctgcagggtgatggtggccagggtctggttctcctcgcgtacgagcacgccctctttggcctcgatggcctggtgcaggccctcggagtaacggcggccttccataatgcggccggtgaactcgtcgacgatcttgacctcgccgttggtgaccacgtactgcttatcgcggtggaacatgtactgggccttcagcgcctgctgcaggtggttgaccagctggccggagagatcggcatagatgtcatcgatacccaggcggcgctcgatcttcttaagaccgcgctcggtggcggcgatggtgtgcttggcctcgtccatgacgtagtcgcccgtgggctcgacgtcctcggtggcggtgagcatgtcgtgcgacacgtcctcaccgcgctccaggccgcgcacggcgcgcgcgaagtccttgtaggtgctggcggacttggtgccggcgcccgagataatgagcggcgtcctggcctcatcgatcaggatggagtcgacctcgtcgacgatggcgtagttgtgaccgcgctgcacgcgctgctcgggacgggtgaccatgttgtcgcgcaggtagtcgaaaccgaactcggagttggtgccataggtgacgtctgcctggtaggccggacgcttgagctcgagcggcatgttgttctggagcagaccgacggtcatgcccaggtacttgtagatgcggcccatccactcggagtcgcgctttgccaggtaatcgttgacggtaacgacatgcacgcccttgccggcgatagcgttgaggtagccggccaaggtggagacgagcgtcttgccctcgccggtcttcatctcggcaatatgaccctcatgaagcgccatggcgccgatgagctgtacgtcaaagtgacgcatgcccgtgatgcgcttggaagcctcgcgcacagtggcaaaagcctcgggaagcatgtcgtcgagcgactcgccgttggcgtaacgctcgcggaacttatcggtctgggcgcggagttcctcctcggtcatcttctcaaactggggctcaagaccgttgatctggtcgacgatcttgtagtagcgcttaaggtccttatcggatccaaaggacagcagctttgacatgaatcccatgtggttttcctttttggccatcgcccacgccgtgcagctgcgggcgagttaaacacagatgattgtactttagccaaacaaggcgcggcctatacggtcgacctcgaccgccacgtaataactacgaccaacctgccaaaaggggactggtttattttggcagtttttatctgggaaaacgctgtatctctgccatttggtgcaaacgaacccgtccccttcgcaccaatctggtgcaatggggacgggttagcttgcaccaataaaggaaaagggccgcgcacccaaatggatacgcggccctttagccacgaatgcgagcgattcctcggcgagctatttactcagcagcctcggtggtctcggcctcggcagcggcctcctcgacgggagcctctgcgggagcctcggcggcctgcttggcagcctcctcggcaaacttagcggcacgcttagccttctcggcagccttagcctcagcggcggccttgcgagcagcctcggcctcagcagccttggcggccttggcagccttggcctcctcggccttcttgagctgagcggcagcggcgccaccgaacttgtcggcgaagcgctggacgcgtccaccggtgtcgacgaacttctgctggccggtgtagaacgggtggcactcgttgcaaagctcgaccttcatctcggacacggtagcgtgcgtcttgaaggtgttgccgcaggagcacgtcaccgtgcactcgacatactggggatggataccctgcttcatggtaggactccttattggtcaggcgctggttaccgatcagcgcataaggcgtcttggtttccgaccaagacaacaaactcggctatggtaccacggcaccgcgcgtcccacaaaaggttcacggtcttttcggaacgacacgaatctgacccatcgaaacacatctccaccgttccttcaactgggaaaatgccgtccccggggcctgagaagggccccggggacgttcgactgactgcgggaacggcctttccgctcaatgtgttcggctgagatcggaaatcaaccaaactgaactaggttcagttgacatggttaaaaacgaggggcgacgcttttgcgtcacccctcgtcccggccggttgctttagttgtacacacggtagttacacttgaactgggttatgtgtccatagttggagcggtaccaacccgacgtatagctgattgcctctgcgcctagatagtcgtagcccttgttgtagcgaagctgacggtaggtcgtgtcgtaccctgctacgtaaaacgtgtctccagagaaggctttgtaccggtccttaaccgtcgaagccatgtacgcgggttcgacatcgcctttctccccgttgagcgcatagacgggtgccgcgattccgcataaagccgttgccacgaggatggcgtagacagccatgcgcgacgcattggacttcagctgttcaaatagtttcatgtcattcacctcgctcgtatgtatcgaggtattcctgcttgagcgtctgcgaggacgactcgatcttttccacgagcgtgccggcctcgatgaagtagaacgagtcggtgaggtctgccaggtcgtcgagcagatggcttgaaatgagcacgcttcgtccccgcgccacctcgctgcgcatcgcgtcgcaggaggttttccgctttcccggatcgaggccgttcagcggctcatcgaggatgaggtacgggcaatcggtcgatatcgccatggcaagctttacctgctgcttcattcctgtcgagagtttacgggtcggcttgtcgagatatggggagattccgagggagctgcagagcgagtcgatgtcggcggccgatttccacgcctccctaacgaaagcaaggtgctcgatggccgatagcgtggggtagagatccgtgccgcctgaagagctcaggtagacgagttctgcaaattcggctgatcgacgttggctgattccgtctgccgccaggcttcccgagcggatgcgggtgggaaattggcccgacagcgcttcaagaagggtggttttccccgagccgttgggagcaacgaggcccgccgccgttcccgggctcaggaaaagcgacccgattgaaagtatcgtcgtgcttccgtatcccacgctcacgtccaggagctcgagcccatggtgctttttcgcgggtccatactgtttgggcgaacgtgtcgcaacggcgccgaccgcaaagaagaccgcgacgtatgccagggccacggcaagcatcgatgcgctgcccgaaccggagccaatgaattctgtcgggaagcatcctacgtaacccgtcgcctcgataggcgagaacacggccagcggcaggagcccgagcgcggcattatgccccagtgccgaatcggacagtaacgggaatgccggggccgcgacaagcaacgcggaggcaagggggcccgcgaggacgcgcctcgttgcggtcgataggacgacggaacaaacggatatcaaggttccgcccgcgagcagcgcgagaagtatggtcgtgaagacgtttcccgcggtcgtggtggtgagcgcgccgtcatggaagaaggagatcgggtacccgatttgcccgaagccgtttagggccaaggcgtaaatgcccccgggtgcgaggccggcgaggagcatcgcggtccccgcggcgattatcgaaaacacgatctggataaggcgccggaatttgggcacgggcgcctttgccgccagggtcccgggccttgtggcgccgagcacgagtatcgacgagagaaggaaggggatgaagggaaggaaagacggcgccgtggcaatggcgtagggcaggaaggagaggaatggcaggtcgtttgcggaggccgggatatccgcgatgccggagctgctcagggcgcggcaatatgcgagcgctgcgtcattggtctcttggtcccccacgatggacccggattggaagccttcgcccatgagcgcgtagtagctctcggcagaatcgagaaaggcggcgtcggtttgagcggcgagggcggcgttcgcgtatcttgcaagctccgcgtcattttgctgctctggagataggtctgtgccgctggcctggggcgcgcgcgtattgaatgcgtcgacaaagccctgcatgccctgtttcataaagaagggcccgtagatgggtgaattgaacgcaatggggacggaaaaggctgcagcgagaacgagcgtggaaatccatacggccttgtctcttaggattagtttgagaagaagtcgacagtacattcagaagcacctacgttcctcaaagaattgttagattaaaagtaacagaccggatgaagatgcgtgcgacgggggcgaggcgaatggctgagcggtatcgatgcgcgggttcaacggtatcacattggccacatagatttttaacttgcatttctacccgcccttttcgtagagtcgccgatacgtgcttagcgcaccctcggcgcgtccggcaggctttgcgaaatgggatccaggagacttcggcgcagcatcatcttgcggaatgcttctaatgagcctcccatccttcaaaaacagaatctcatcgcacagcctatcgaccgaatccaagatgtgggatgacatgatgatgcacgtaccagaatcggccagcttcctgagaatctcggaatgcaagtccaccctgctggggtcgagcgcgttcatgggctcatctaatagaaggtaccgcgcgcccgtcgcatacgcaatcgccagggtaagctgctgcttcatgccctggctcagagtgcggatcctcatcttcgcgaactcgcctatctgcgtttgttccactatctcttcgatatcgcgagcatgcggccacatatcgcaaaccatcttgaggtgatcttccgcacgcaatccgggatacagcagcgtcccctcaccaggtgcatagaagatcatagaacggacctctctcgcacccgtaccctgcacctcatccagaacgatgctcccgtccacgcgaggacccggcaaacctgccatcgcacgcagcaacgtcgtctttccatgcccgttcggagcgacgagaccgtagaccgtacccggggcaaactcagcgttcaccgaatctacgagcaccttctttccataagagatcgtcagcgtttgaaggtcaatcatcgagatcatcccctttcgatctttggaacactcaggcgcaccatcaacggagatacggcgcccaagaccaccagcagagcgcccgatgcgccgacgacctctccaaaaggcatcgcgttcgtccctcgcccaaggaacccaatcgtccccacctgggaagcggaatcaaacgaggcgaatggagccagcagcgcgacgcccatgcccacgctttcaacatgagcgctcaacgaacccaacaccaagagaaccgcgcaaaccattccggtgacaacggggttgcggctaatcgctgctgtcaacgcagcgacgacggaaatcacgccgtatgccatgaccagcaacggaatactgcacaacaccgcctcccccaccatggacgttgtcgaagctcccgcccgaatgagagcgacgggatactccgatccacccgcaccgttcttaatcacggacacaacgacagcgggaaccatcgacaccaaaagcagcaccaagccaagcaggggagccagcgcaacagccgtcagaaaacgcacatgcgctgttgcggggatctggagaaccagaagggaacgacactgcaggtgggtgcacgcgagcgatgtgacaaccacgggcaacagcaaaaataaggagggaagcgctgcctggagatacgaaaggaggattaatgggggcatcttcgtacttaactcgtaaaccttggggtccggcaagctcgcgatcgactcaagcagaagggcgcgcgcctccgcacgagaaggagtctccggctcgattccgatcgattgcaggagagtcgcatctgccgcgcccagctcacctcgagcgcgctcgtacgtcgcaaggcttcgaaacccctccgcaggcataggcgcgtacacgaaacccgaaagagcatcccgcatgtcttccagggccgctttgccctcgacgtccatattcgcagcgttctgctctagataccgatctattgaacggagctccccatccctataccgaacagcggaaacgttatcagcgtcaggaaacatctcgaccagagccggggccagcatcgtcgtcgacattgcaatcgcgcatacggcgagggtaggagaacgcaggagcagtttccccatcgttcttacgtatgcaacggcggaggcacaagcgctcgaacgagttgccgttctcgatgcagtgaaggaacctctctcaagacaaatcggggatatcgggcacgcgcagccgctctttccagcaacgcaaagcaggctaattgccagcacctcgatcccgattgcgcatacgagggcaatcgcgccacgctcgaagcaaagtccaggcagattcactatctgcgttgtcgggtacgggctataggcgccgacggtcaactcagtgttcgcatacgtaaggggattcaacagggcgaactcacgtaaagcgatggatcttccgcaatacccgggaaccatcgtcacccccatcagggcacatacgaacacgattccaagcgtagggttattggcaatcttcacggcaaggtgaacgacaagcgagatgaacgctgccaccaagaattgcaagatggccgtctgcgcgaacaccagccaagccggtttgataaccggagtcgcatattgaatgtagcctatcggatagaacggcgagcccgggccattcttcacaagcgcggcgattatccctggaagattgatggcgaggacggcaagcattgcaaaaacactcgcccatacgctcgatgcaacaagtctacccagctcgcccatcggtgcctggatgatgagcttttcacgtttgttaagacgcgcggcaaggaacgagacggcaacggccgttgcgacccatagcaagtactccttcgatccgtcataataggtgtactctccatccgatatctgcagaaacggaagtaggggagagagcggtgccaagataagacgtcccgcggcaagagggtacagaagcgcgggcatgcttgatgaagaggtatagacaccgtcctcccccgcattcacaagcgcatccgcataggatgctgacaattcctgctcaacacgggttattcccgactcgaggtattcgacccgtccgtcgatgccagccgcgctcctgaagacgggcagagcacaaagaaccatcaacgcaacaacgacaacacagagcgacctggaggagagaagcgacctaaagatcgccttcgagattttgagcatattcatcgccaaccttaacctcatccagtcggaacagaggggccgaacaaaatgctcggcccttattacttgccggcaaagtcaatttaacataaactgttaaaaagtaacctgagttttttaaattcttcggaggttattatgagttccgacaatcgcactccccggcttcattccttccgcatcgcatgtgcgatagcctctgcgaccctttgcgccaccgccatcgcacaagtggcgttctccttaaagccagcaatcgaagtgctcgacaaccctgtaattgcagactcccccgcgtatccagcccttgcgatctcgacattggtccctgccgtcatcggtatcgctacgaccatcctcagcgccgttctcgtgtggacgatcaagagcggagaccccttcaagaaagggtctgcgacatgcttgaaggtgctcggcattctcttcgttgttcaagctgccaccagcctctacgccggctcactcaaaacctccgtttcgatgtttggcggcgagggggccgtcggcgcccaagagatcgcttcatcattcgattggacctctctggttctcggcatcgtcctgttcatgctttcccagctcttcttgtacgcccgagagctgtacctcgactccgacgagattgcgtaaggaaacgccatgcccgtaattgttcgcctcgacaagatcatggccgagcgaaagatttcctcgaacgaacttgccgaaaggattggaaccacgcccgtgaacctgtcccgtattaaaaaagggcatattcgcggcattcgcttcaacacgctcgagcagctatgcctcgcccttcgttgccaacccggagaccttctcgaagtcatgagcgaagaggatgcccgaaaggagttcggactcgattggtccgccgaggattagagggcggtcgtactcgccctgcacacggggatgcgaatcggcgaggtctgcggccttcggtggtgcgatgtggatttcgagacgggcctgatctcgatcagacactcggtggcgtacgcgaagggaatgggttcgttcatcaaggacaccaagacccatgacgccaggggtatccccatcgacccggtcggcctactccccttcctgaaggagacccacgagatcgactgcggaaagctgcgcttgcgcggccttaccggggcggtcgagatcggggactgctacatcctgtcggagccgggcgcgaccttcgcgacgacaagctatatccgcagggcgttcaagacgttctcggagaccaacggcctgggcccgtgggttataccctaagagcaaaccaccctttttaagggtggttctgatttacccgaggggattgtacccgatgggaacgtattaagcgaagtaggctacgccgctctcaaagatcggcatgaatttgtcgccggggacatgctcgggcacgttgcagtacaggttgtcgccgcgacgctcggcatggcccatcttgcccaggacacggccgtcggggctcgtgatgccctcgatggcgagtgcggagccgttggggttgacggaaaggtccatgctgggtttgccgttctcgcccacgtactgcgtggcgacctggccgttggcgatcagctgggcgagcacttcgtcattggcgacaaagcggccctcgccgtggctgatggcgacggtataggggtcgtccaggctgcactgcgacagccacggggacaagttggacgagatgcgggtgcgcaccagacggctctggtggcgaccgatggtgttgaacgtcaacgtgggcgcatcgggcgtggcgtcgacgatgtcgccgtagggcaccaggccgagcttgatcagggcctggaagccgttgcagatgcccagcatcaggccatcgcgggccttgagcaggtcgcggactgcctcggtgacctcgggagcgcggaagaacgccgtgatgaacttggcagagccgtcgggctcgtcgccgcccgagaagccgccggggatcataacgatctggcttgcacggatgcggcgggcaagctcgtgggtgctctcggcgacggcctcgggcgtgaggttgttgatcacgaaggtgtcggcctcggcaccggcggcacggaaggcgcgggcgctgtcgtactcgcagttgttgccggggaacacggggatgatcacgcgcgggcgggcgatcttggcgccgccgtacacgtggatatccttggcgcggaagtcgatggtctcgacctcgggggtctcgccggcgctgcggtaggcgaagacgccctcgatgccgctctcccaggcctcctggagctcggcgagctcgatgacctcggagccggtgtcgatgacatagccctcgacggtggtgcccaggggctcgacgacaacgccgtcggcgacctcgggcagctcggcgtcctcggcgagctcgacgataaaactgccgtagagcggggtgaagaggctctccacgtctacatcctcggcaagctcgataccgatctggttaccgacgcacatcttaaagaggctctcggcgccgcagccgtagccgggcgtggatatggccagggcgttgccggtagcagtgagcgcctcgacggcgtcaaacgcggcgagcaactgctgggcgtcgggacggtagtcctcgccataggtggcgggggcgatgcggacgacgcggtgcgtgaggcccttgaactcgggcgagacggcgcgggcggccttgcccacggcgacggcgaagctgatcagggtcggcggaacgttgagctcgccggtctcgtcctcaaacgaaccgctcatggagtccttgccgccgatggcgccggcacccaggtcgacttgggccatgagggcgcccaggacggctgccgtgggcttgccccagcgctcggcctcggtgcgcagacgctcgaagtactcctggaaggagagataggcgcgcttgtgctcaaagccggcagccacgagcttggcgatggactcgaccacggacaggtaggcgcccgcaaactggtcggcctccatcagataggggttgaagccccatgccatggcactcgccgtggtggtctcgccgcccacggggaacttggcgaccatggccgagctgggggtgagctgcgtcttgccgccaaagggcatgagcacggtcgcggcgccgatggtggagtcgaagcgctcggaaaggcccttgttggaagcgacgttgaggtcggtgacgagcgaggtcatgcgctcggcgagcgtggtgccggcccagctgggctgccacacgctacgggcgcacacgtgggcgacctggtgcttgggtgcgccgttggagttgaggaactcgcgggacaggtcgacgatagcgacgccgttccaggccatgcgcatgcgcggctcagcggtaacctcggcgataacggtcgcctccaggttctcctcggcggcgtagcccatgaactcctcgacgtcaccgtcggcgacggcgcaggccatgcgctcctgggactcagagatagcgagctcggtgccgtccaggccgtcgtacttcttggtcacggtgtccaggtcgacatacaggccgtcggcaagctcgcccacggcgaccgagacgccgccggcgccaaagtcgttgcagcgcttgatcagacggcaggcgtcgccgcggcggaacagacgctgcagcttgcgctcgacaggggcgttgcccttctggacctcggcacccgaggtctcgatggactcggtgttctgggtcttggaggagccggtggcgccaccgatgccatcgcggccggtgcggccgcccagcaggatgatcttgtcggtgggggcggggcactcgcgacgaacgtggtttgccggggtagcgcccacgacggcgccaacctccatgcgcttggccacgtaaccggggtgatagagttcgttgacctgaccggtggcaaggccgatctggttgccgtagctggagtagccggcggcggcagtggtcacgagcttgcgctgcggcagcttgccctcgagcgtctcggaaaccgggacggtggggtcaccggcgccggtgacacgcatggcctggtacacgtagctgcggcccgagagcgggtcgcggatggcgccgcccacgcaggtggcggcaccgccgaagggctcgatctcggtcgggtggttgtgggtctcgttcttaaacaggaacagccagtcctggtcctcgccgtcgacatcgaccttcaccttgacggtgcaggcgttgatctcctcggactcgtcgacatcggtcatgacgccggtcttcttaaggtacttggcgccgatggtgcccatgtccatgaggcagacgggcttggcgtcgcggccgagttcgtggcgcatctccatgtagcggtcgaaggcttgctgcaccacggcgtcgtcgatcgtcacgtcgtccaggacggtgccgaaggtggtgtggcggcagtggtcggaccagtaggtgtcgatcacgcggatctcggtgatggtggggtcgcggtcctcatcgcggaagtactgctggcagaaggcgatgtctgcctcgtccatggcaaggccgcgatcggcgataaaggcggcaaggccggcctcgtcgagcttgcggaagccgtcgagcacctcgacgggctggggctcgggagtctccatgtacagcgtctcgggcaggtcgagcgaggcgatgcgcgcctcgacggggttcaccacgtagtgcttgatggcatcgctggcggcctcgtccagagcgcccgagatcatatagaccttggcggagcgcacggcggggcgctcgccctggctgatgagctgcacgcactcgctggcggagtcggcgcgctggtcaaactggccaggcaggaattcgacggcaaagacggcgccatcgcttgcggggagttcgtcgtaggtcacatcgacctggggctcgctaaagacggtcggcacgcaggagcggaaaagctcctcgtcgatgccctcgacgtcgtagcggttgatgatcctcagggcctcgatgcccttgatgccgagaatttcggtcagctcgcccttgagctgctgagcctcgacgtcgaacccgggtttcttctccacgtagatacgagagaccattggttcctgccttcctgatcggttgggcgtacggtacggtatgcggcagcggtcggtttacgggacaagcctcgcggtcgccttgagccacatgtttgtaaacctcactatgatacgacagctcgcggcgcgttgaggacggcgagggtgctacagtgaagcgcaaacaagagaaaggcatcacatggcattcgtttcgctcgccatcatcgcactcgtggcctttgcgagtccttttatcgcctcggcgattcccggaaaacccgttcccgagacggtctttttgctcgtgctcggcgcggtgctgggaccccatatgctcggcgtcatccatgtagatgccgaggtctcgcttgtgtccgagctgggcctggccttcttgttcctgcttgccggctttgagatcgaccccaagagcatcacgggcgtcgaggggcgctacggcttggcgacgtgggtcgtcacgtttggtatcgcctggcttgccgtacgctttaccccgtggttctcggtcagtcatttcgacggtatcgccgtgacgcttgccctcacttcgacggcgctcggtacgctcgtgcccatcatgcgtgagcgctcgctcaccggcacgcgcgtgggcgactcgattctcgcgtatggcacttggggtgagctcggccctgtgcttgccatgtcggtgctgctgtctgcccgcaccggcatccaaacgcttgtgatccttggcttgtttgcggtggtctgcgtgttgctggccgtggtcccgagccgctccaagcgcgtcggcagccgcttctttgcgtttgtcgaggaacgtgccgataccacgtcgcagaccttcgtgcgcctgacggtgctcatcctggtcacactcgtggcgttctcggctgtctttgatctcgacatcgtgttgggttcttttgccgccggctttgtcctgcgctacatcatccccgagggcaaccatacgctcgagaccaagctcgacggcctggcctacggctttttgattccggtattctttaccgtatcgggcgcaaagatcaatctgacggccgtggcgtcgcgcccgggtctgctcgtgggctttatcgtggcgttgttgattattcgtgccgttcccattctcatctctatgagcatttgtcctgcgacgcgcgatgtgtcggcgtatggtcgcattaccgtggccctgtactgcaccacggccctgccgatcatcgttgccgtgacaagcgttgccgtcaacgcgggcgcgctgtcgcaagatattgcgtcggtcatggttgccgccggtgccatcacggtgttcttgatgccgttgctcgcgcagctcttctaccgcgtggtcgacgccgcgccggtcgccgccgtggcagaagttgccgagcatccatccgatgcgctcgacatcctgcgcgcccatcacgatttggcgagcctgctcgcacgtgagcacgagctgctgacttcgcatggccatggtcgcgtattcgagggcttgcctacgctcgatacgattgccgagcgtctttccgccgaggcggcgagcggccatatcgatgcccgtattgtggacgcggcacatcttcttgccgataagacctatggagacgaggtcgacccgtccgagctgactccgcgcgagcgtcgccgcctggagcgcgccaagctcgccgtgcgcgaataccgccgccgcatgctggagctctatgcaagagaagaagccgaggacgacgacggcaagtagtcgatactctctcggggaagccgcgtcctgctttgaaggctcggaacgggatgtggtttccgaaacgggggccgttgggaaactgtgtcccggaatgggcgctcagagtgggatgcagtttccgcgagagacccgttgcggaaacggtatcccagaatcggcgttcaaaacggggcgctctttccgaaacatggccctgagggaagctgcgtcccggtctgagtcggaattccgggacacagcttccctttcaaacagaagaaggcgcgctgcctgcagttgatgcagacggcgcgccttctttgttggactatgttgaggctgggagctgaggcttgtggtcccttaagagcgggcggctccgtcgacggggagcacggcgcccgtgacataggaggacatgtcgctcgctaggaaaacgaaggcgttggcgacgtcctcgggctcgcccatgcggccgagcggaatggtggcgatgatgggcttgatgacctcttcgggaaggttggcgaccatatcggtcttggtcacgccgggagcgacagcgttgacgcgaatgcccatgggggcgagctcgcgcgagagcgactggaccataccgttgacggcgaacttggacgtgggatagccaacgccggagggctgaccgtacttggcgaccatcgagctcgtggtggtgatggtgccgccgtggcctgcctcggccataatcttggcagcggcttggtggccgttaaagacggcgacgacgttgaggtccatgaccttggcgaactcttcggccgtgtactccagaagcggcgagcgctgggagatgccggcgttgttaacgaccgtgtccaggccacccatgtcggcggctgcctcggtaaaggcctcggttacggcctcgagcgaggtgaggtcgcaggtgcggccccagaccttggcctcgggataggctgcggccagcttttcaacggcggcgtcggcagtctcctgacgcgagccaaagaccgtgacggcggcgccctcctcgataaagcgacaggcgatggcatagccgataccgcgcgtgcctccggtgatgattgctttcttgccctcgagcaacatggtgcttcctctcatcgcgggcggacattcgcagcacagcgtagcggtagccggaatcggtcgcgtctgcatatcggtgaacggtagcccgcgttaccgatgagcggttcgcgcaaatgtactctgccgttgtgcttggggcaggagacaaaagggctcccgtcccacatcggacgggagccctcaaagcgtgtattgctaggcaagcgttggattagttggccataacaccttcggtccaggcctcgacgtcctcgatacgcaggacgttggcgacctcggccacgcagtcgacactggcaagctcggcggcggcagcctggacgtccttctcgagtgcgcggtgcgtcaggaagatgaccgagcaggcatcgctgacgcccgacttgccgtcctcgacctggttgatgagcgagatcgagatgttgtgcttggcaaagatgtcgaccgtctcggacagggcgcccacgcggtcggcgaccttcagacgcacatagtacttggtctggagttcgtccatgggcttaaaggcgaggttgtgaccatagggctcaatctcgggaagcggagccacgccgcggctgatctgctcggagagcgacaggatatcgcccacgacggcgcttgcggtggggaaggagcctgcgccggcaccgtagaacatggtttcgcccacggcgtcacccaccacgtagacggcgttcatggcgccgttgaccttggcgagcatgtggtcggcggggatcagcgtgggatgcacgcggacgtcgacgccggcgtcggtgttgcgggcgatgccgagcagcttaatggtgtagccgagttcgcgtgcctgggcgatgtcctcggcgccgatggtacggatgccctgctggtatacgtcgtcggtggtcacacgggtgccaaagccgatggaggcgaggatcgccgttttgctggcggcgtcgaagccgtcgacgtcggcggacgggtcggcctcggcatagcccttggcctgcgcgtcggcgagcacgtcggcgtaatcggcaccctcggcgtccatgcgcgacaggatgtagttggtggtaccgttgagaataccggcgatggtcaggatcttgttgcccaccaggtcgtgctcaagcgtgctcacgatggggatgccgccgccgcagctggcctcgcacttaatctgcacgccgcacgcgcgtgccttctcggcaagcgtctcgacgtgacggcccagtagggctttgttggcagagacgacgtgcttgccgtgctcaaaggcagtggtgaagatctcggttgcgggatgctcaccgccgatcagctcgacgacgatgtcgacggcggggtcgctgacgacgtcgtgccagtcactcgtaaaggcctcgcgctcaatgcctgccgcctcggcctgctcccaagcaagcgcgcaggcgcgggtcagcttaaggtcgatgccgtaggctgccaggtactcatcgtggtggctcttgatcagacgggccacgccgccgccgacggttcccagaccgatcagaccgacgttcacggtgcgcaggggttcgctcatagatagctccttcgtgcatcttatggatggattaaccgcttaaaggttgagtgcattctagcgtgaaccgagggcgcgtgctcgccaggcaacaggagtcgcacaaaacggcacccccgaaacgctgcggaaacattggaaacatgctcgctacaaacggaactccgtaacaaactgtcaacgtttgcaccatgaggtttgccccgtaccgcaagacggccgcactgcggccagcgaagaggggggcaccatgcttagcatcaacaacgtacttaaccgcaggagtttccttgtcggagccacgcttatttttgccccgatctatttcaccccagcgtccgttttgctcaagaacgccaaggacatgagctacgacatgacactaatgggtgccgacggcatggacagcctatgtaatccaggacggcaagtacatctccgcctaagtgcatataacgagaccggtgaggccgttttattcagggcaagggcgcttgtaacagaacagaaacattactttcacataataaagtggctaaactgcataaactgatagaaatacgcataaaaatggataaatggacaaagcaaaagaaaagttgaaataatcgccacttttctcaactaaagcgtctactattttgcgaacgccgaacacggcgaaggatggcctgtcgggtaaccgaaacccgacgagatttgagaggagagccgcatgtcgagcctcaccggtaagtcattgaaccctgttatgaatcgcaggagcgttatcgcgagcgcagcaggtctgggggcgatgtccattctagctggctgctcctccaacggcggcgacagcggttccgcttcgagcgacgcttcgtttaagatcggcaccatcggcccgctgaccggcgccaacgcgtcctacggcaagtccgttacccagggtgtcgagcttggctgcaaggatttttcgaccaaggagctgccgcttgccagcaaggccgaggatgaccaggccgatggcgagaaggccgtcaacgccttcaacaccctgctcgactggggcatgcaggccctcgtcggcccgactaccacgggtgcgtcggttgccgttgccgcagagtgtggtaacgaccccaagacgttcatgatcaccccgtccgcgtcctccgaggacgtcaccgacggcaaggattgcgtcttccaggtttgcttcaccgaccccaaccagggtgtcaacgctgccaagttcctggcgcagaagtatgcggacgagaagttcgtgctgttctataactccggcgacgcctattcttcgggcatcgcagattcctttaaggcccaggccgctgagtccaagctcgagattgttgacgaggagacctttaaggacgactccgccacgagctttacgaaccagctgaccaaggccaagcaggccggcgccaccatgatctttgcgccgatctactacacgccggcgtccgtcctgctcaagaacgccaaggacatgggctacgacgtcaagatgatgggctgcgacggcatggacggcatcctgggcgttgagggcttcgatacctctcttgccgagggtctgctgctcatgaccccgttctccgccgacgacgagaagaacgccgacttcgtcaacgcttacaaggataagtacggcgatacccccgaccagtttgccgccgacgcctacgacggcgtgcacgcggtggccgaggccctcaaggaggccggtcttggtgtcgacgccgacccgaccgaggccgccgagaagctgtccaaggctatgctcaagattaccgttgacggtctgaccggcaagctcacctggaacgataagggccaggtccagaaggagcccacggcgtacgtcatcaccgacggcaagtacgtacaggcctaattggccgccttacatagagcggttttgatcccaagcaggggaggttttggccttccctgcttgcttggtatctagggacgatgtaacgtccctgtttcatacatcaactggaaacctattcgaaagggggatgtggaacatgacggtctttatccaatacctggtcaacggcctgtccatgggcagcgtctacgccatcatcgcgttgggctacaccatggtctacggtatcgccaagatgctgaacttcgctcacggcgacgttatcatggtcggtgcctatgtctcgttctgcgccacgtcgtatctcggcctcccgggctgggcatctgtagttctctcttgtgtggtctgtaccgttctcggtgttctcatcgagggtctggcatacaagccgctgcgtcaggcgggcccgctggccgttctgatcacggctatcggcgtgtcttacttcctgcagaacgccgcgcagcttctgtggggcgccacgcccaagaacttcacttcgctcgtcaccttccaggtgccggagttcttggccaagttcaacgtaagcgccgtctcgctcgtcaccatcgtcgcctgcctggttatcatggccggcctgatgttctttacaggtaagaccaagatgggtaaggccatgcgtgccgtgtccgaggacaaggccgccgctcagctcatgggcatcaacgtcaaccgcaccatctcgatgacgtttgccatcggctctgcccttgccgccatcgccggcgtgctgctgtgctcctactcgccggtgctgcagcctacgacgggcgccatgcctggcatcaaggccttcgacgccgccgtcttcggtggcatcggttccatccccggcgcctttgtcggtggcattctcatcggcatcatcgaggcgatggcgcaggcctacatttccacgagccttgccaactccatcgtctttggtgttttgatcatcgtcctgctcgtcaagcctgccggcctcttgggcaagtacgtccccgagaaggtgtaggtgagcgttatgaagtttcttaaagataagcagacgcgtcacgactttgttacgtatgccatgtgcatcgtggccttcgccatcgtgttctttatgcagtcgaaccacatgattccgcgcatgatcgccggtcagttggttcccattacggcctacatcgtcatggccatttccctcaaccttgtcgtcggcatcgcgggcgacctgtcgctgggccatgcgggctttatgagcgtcggcgcctatacgggaatcgtcaccgcggtcgccctcgagagcgccgttccctccgatccggtgcgccttgtcatcagcatcgtggtcggcgctatcgccgctgccgtcttgggcttcttgatcggtatcccggtcctgcgcctgagcggcgactatctggccatcgtgaccctggcttttggcgagatcatcaaagagatcgtcacttgccttatcgtgggtgtcgactcgcgcggcctgcacgtgatctttaacatcacgggcaactctacgatcgacgacctgcacctgctcgaggacggcaccgccatcatcaagggcgcccagggcgcctcgggcgtgtcgacgtactcgaccttcctcgccggtgccatcctggtcatggtcgcactcgtgatcgtgctcaacctggttcgcagccgtaccggccgtgccattatggccgtgcgcgataacaagattgcagccgagtccgtaggcatctccgtcaccgagtaccgcatgatcgccttcgtggtttccgctgccctcgccggtgctgccggagccctcttcggcggtaacttctcgcagctctccgccaccaagttcgacttcaacacgtccatcctcattctggtgttcgtggtcctgggcggtctgggcaatatgcgcggctccgtcatcgcggcggcgctgctcacggtgcttcccgagctgctccgtcagttctcggactaccgtatgctcatttacgctatcgtgctgatcctggtcatgatctttaccaacaacccgcagctcaaggcgttcttcgcacgcattaaggatcgctttgcttccaagaaggaggtggcagccgatgcccagtaaatttgagttcaagaagggcaagatggtcccgtatccttctggcgccatcgttcccgatcgtgacctgggcgagcgccctgcactcgagtgcatccacctgggcattgagttcggtggccttaaggcagtcgacgactttagcctgactatcggcaagaccgagatcgccggtctgatcggccccaacggtgccggtaagaccacggtcttcaacctgctcaccaaggtgtatcagcccacgcacggcaccatcctgctcgacggagaggatacctcgggcaagtcggtctatcaggtcaaccgcatgggtattgcccgtaccttccagaacattcgcctgttcaacaccatgacggtggaggataacgttaaggtcggtctgcataaccaggagcgttactccggctttgagggcgtgctgcgcctgccgacgtattggaagcacgagaaggccgcccacgagcgcgccatggagctgctgtccatctttgatatggagcatctggcaaacgagcaggccggatcgctgccttacggcgctcagcgtcgtctggagatcgtccgcgcgcttgccaccaaccccaaactgctgctgctcgacgagcctgccgccggcatgaacccgtccgagaccgcggaactcatggagaacatcgttaagattcgcgacacctttggtatcgccatcatgcttatcgagcacgacatgtcgctcgtcatgaatatttgcgagggtatctgcgtgctcaactttggtaaggtcatcgccaagggcacggcagaggaaatccagaacaacgacgccgttatcgaggcatatctgggcaagcaggataagggggagaactaaatggcagagccgatgctttccgtctacaacatcaacgtctggtacggcgccatccacgccatcaaggacatctcctttaacgtcaacgagggcgagatcgtggctctgatcggtgcgaacggtgccggcaagtccacaacgctcaagaccgtctcgggcctgctgcgctccaagaccggctccatcaagtttatgggcgaggacattactcatacgcccgccgataagctggttggtaagggcctggcccaggtgcccgagggccgtcgcgcctttttgcagatgacggtcgaggagaacctggagatgggcgcctacacgcagcccaagtccacggttgctccgggccttgagcgcgtctacgagcagttcccgcgcctgaaggagcgccgtcgccaggtcgccggcaccctttcgggcggcgagcagcagatgctcgttatgggccgcgcccttatgagtaatcccaagctgctcatgctcgacgaaccttccatgggtctggcaccgattctgatcgaacagatcttccagattgtcgaggacctgcacaaggccggcaccacggtgcttctggtcgagcaaaacgcgcagatggcgctttccatcgccacacgcggttacgtgctcgagaccggcaagatcaccatgaccggcaccggccaagagctcctgcatgacgacaacgtccgcaaagcctacctcggaggctaacccacctaacaaaaggggcgctgactatctcagtcagcgcccctttttaagttgcggtgaaatagggactgaatacgggctccagaggccaaaagagtccctattccaccgcaacttcatggggatgtgtgacaatgcccgtcggaaaacatctgctgtctttgggggtctatctatgctgtacgagttttgtgccgagaactttgagcgtgtgccggcggctatcgatgccggtgctaagcgcatcgagttgtgcgacaaccttgccgtcggtggtaccacgccctcggccggcgttatcagcactacggtcagctatgctcacgagcatgacgcgcgagtgatgtgcatgattcgcccgcgtggcggtgactttcactacaaccaggacgagctgcgcatgatggagatggacttgggtcttgccgtgagcgccggcgttgaaggcctggtctttggctgctgcaagccctgtgccggcggctgggcgctcgacgagctcaccctcggcgccctcgtgatggctacgggctgcgcgaccgaggagtgcaagcgcggggccatcgatatcaccttccacatggcctttgaccagctctcgcccgaggctcagctggacgccattgacacactcgccgactgcggcatcacgcgcatcctgacgcatggtggtgctgccggaacgccgatcgaggacaacctggagcacctgtcgcgtcttgtcgagtatgcgggcgaccgcctgaccatccttcccggcggcggcatttctacggccaaccgcgataccgtggcggcggcattgagcgtctccgagctccatggcaccaagatcgtgccgctggaggcgtaacccgtggcgctggtatttgacgttcagcaggcgaacggtaagcccgacgacaaccggcgccctggcaccgcgtgtcccttttgcgataccgaggaacttgccgatatcatccggcgcgatggtgactgcatctggctcgagaataagttcaagaccctgcgcgccacccgtcaaaccgtgctgatcgagtcggccgatcacgatgccgacctggtgatctatgagccggatgaactccaccatgtgatgcggtttgccctgggttgctggcagcagatgatcgattcacagcagtatcgcagcgttctcatgtacaagaacaagggtccgctctcgggcggtagtctcgttcatccgcacatgcagattgtgggtttggagcaggaagacggctacacttcgctgacttctgccaatttcgaaggcatcaatgtctggcaacaggggagaatctcggtcaatatctcaaccgaaccgatcatggggttctttgagatcaacgtttcagccccgcagggaatcgccgccagcgatgacgcacgagaccaagccgaggcggatctctttgccgatgcgatccaggtagctctgcgctatatcctaaacgagcaccacggtggtcgcgcagagtcgtacaacttgttcttctatcacctgggcggtcggaccattgccaaggcgctgccgcgttgggtggtttcgccctactttgtcggctatcgtttggcccaagtcaatgccgagacgacgctcgatatcgatgctgagcgtctgcgtgcgcatctggaaacgctcgtatagcaagactaacacccgcgtaatgcggacagcctagcgcgccatggcgtcgcggccggcttcgacccgcttgcgctgtttggtgcgctcctcgcaggttaggcactcaaagagatgcccgataatcgaggccagcacctgctgaaacagcgtgccgcacatggcggggaacacgacctcgcccggaaagtactgcgtggcgatgacggcacccgaagagatgttgcgcatgccgcaggtaaagcacatggtagtcgtctcgctatatggcagatgcagcgcacgtgcgaccagaaaaccgacgacaaagccgctgatggcgaagaccaaaataaagagggcgacttccaggcgcaccgcgtttatgtgcagcacgtactcgctcatagcggtggagttggacgcgatgacgcccatcatcatgaacttgcaggcgggcgagagcacgggagagagtttctcgtggccccagccgcgcgtgagttcattgatggcaataccgagcacagcggggatggcgatcataaaggccatgttctgcatcatgctcggcacgtcgatcgagacggtggcgcccagcaggagcttgagcgtaagcggaatcgtcacaggtgagatgaccgaggacgtcaggatgatggtgagcgcgagcgggccgttgccgccgaacatgctgatccacataaaagcggtgacggccacgggcacgctgtattcgagcacaatgccgcagacaaggttggggttggagccaaagaagagtgaccccatggcatacgccgcgatgggaataagcaccgccgagacgagcagcgccaagactaggtgcaacggacggcggaacacctcggttacctggtgaaaggtgttgctgagcgcaccctgaaacgtcataaaggcaaacaaggtgggaacgatgggcttgagtacgccaatctgttggggaaagagcacgccgagtgccacgcaaatcggaacgatgacctgcatgtgccccgcgagaaacttgcccagtccaacccattgcttcatatgcgcttgtgactccctttgcccgtgaacccgttttgaatggatatgctagacgctcgcatgcgtccgtgcgtcagaaacgctcgaatatttcgaggctattaccggcatcgtttaccgaaaccgcggcgtgctgcggcgatttgcgtctgctctgcacggtataataaatccgttcaacagatctgcctgccgaagcgggcatacacagaggactcatcgctatgaaccgtgagaggtatcgcggcgacctgcccctatcgggggtgggcgcctatgtcatcgcttaagacgacgcatcgctgggcggtcgctcagcaaaaccccgagctcgaaaaggagctttcggctggcctgggcattcccgggctggtggcgcgtattatggtcgcgcacggcattacatccatcgaagaaggtcagctgtttttgacgccttcgctcgatcgcgactgggccgacccactcattatcccgggcatgtcggtcgttgccgaccgcgtcgagcgtgctatttgcagccacgagcacattgcggtctttggcgattttgacgttgacggtattacgtcgacctgcctgttgaccgaggcactgcgcacgtttggcgccgatgtcacgccgtttattccgcatcgctttgacgagggctacggcctgtcgcgcgcggcgctcgaccgcgtcaacgagctcgctcgccctcagctgatcgtgaccgtcgataacggtattgccgccaaggaagaagtctcctatctggagagcctggggatcgatttggtggtcacggaccatcacgagccctccgaccaggtgccgcagggcgtgcccctgaccgaccccaagctcgaggacgagggcccctcgcgcgagcttgccggtgccggcgtggcgctcaagctggtgcaggtcctgggcgagcgtttgggcaagccgtcgtattggcgttcgctgatcgaggtcgcggcgctgggcaccgtgtccgacatgatgccgctcacgcccgagaatcgcgcactggtcgccgagggcatccagcagatgcgcgtgacggcccgtcccggctatatcgcgcttgccgcacttgccaaggccgacctttctaccattacggccgacggcctgtcgttttcgctcatccctcgtctgaatgctgccggccgcatggctgatcccaagctggcgctcgacctgctgcttgcccgtgatcctatcgaagcaagtgcactggcagccgagctcgaggaaatcaatcgccaacgccgtgagatcgaggcggagctcacgcgcgatgccatggcgaaggtcgaggagacttatgacggcgggcgcgcaatcgtcgtgggcggcgagggctggcacgagggcgtcaaaggcatcgtggcgagccgcttgaccaatcgctatcacgtgccggcgctgctgttctcgatcgaggacggtatcgcgcgcggctctggtcgctcggtgggcaaagttaacctgtttgacgccgtcgagcgttgttccgacctgctgattcgtcgcggcggacatgccggtgcggtgggtgtgaccatcgaggcatccaagctcgatgagttccgccgccgcctttccgccgtgctatcggagctttccgccgaggactttgaagacaccgacgaggtcgccgccaccgtcgacctttccgagctgaatatcgagaccatcgagcagatctcccgtcttgagccgtttggccagggcaacaaggtgccgctgctggctgccgagggcgtgacgatgtgcgaccgcgccgtggtgggcaaaaccggcgagcacatgcgctttgtggcgaccgatggcgccgcgagtgtgccggccattatgttccgcgtgccgcaaatcgataagctcatcaactgcgatagcgctgtcgacttggtgttcgaggccgttgccgagcattggcaggggcgtgtgaagcccaagctcatgatcaaggatgttctggttcgcgataccacgctgcccagcgtcgatgatccggcatgcgagcttcgtcgtggcgtgcagccggcggattccggcctgcgcctggagtcgcgtaagcgcgagacgctcgcccagctttcctataccgagctcacgcgctcgcttatccatagctttatcggatcgaaccagccgcaccgcgcgcaggttgaggcgctcgatgccttggccgaccaccagagcgtcttggccgttatgggaacgggccgcggcaagtctctcatcttccatgtacatgctgcgcgcgaggctgtccttcgcggacgtgcgagcatctttgtctatccgctgcgcgcgcttgttgccgaccaggcctatcacctctcgtcgacgatggcagcgcttggcattggcgttggcgtgctgaccggcgagaccgtggaggccgcacgcgatgatgtgttcgccggcctagcttcgggccgcaccggtatcgtgctcacgacgcccgagttcctatctatccaccgtgaccgcttcgcgcgttcgggccgcatcggctttgtcgttatcgatgaggcgcaccacgccggccttgccaagggcggcgaccgcagcgcctatctcgacatgcccgatatcctcaaagccctgggcgacccggttgttatggctgcgacggccaccgcgacggctccggtcgtggccgagcttgcccgcatgctgccgattactcgcacggtggtcgacgagacggtgcgcgagaacctgcagctcgaggacgaccgcgaccttgcgagccgcgagaaccgtttggtgtcgatcgtggcgacgggggagaagaccgtcatttacgtcaattcgcgcgaccagtccgtggcgctcgccaagacgttgcgcaagcgtgtgcccgattgcgcaacccatatcgcgttctataacgcggggcttgcgcgctccgatcgccgccgcgtggaggaagcattccgagacggaagcctcagctgcatcgtctcgacctctgcctttggcgagggtgtcaatctgcccgatatccgccatgtcgtgctgtaccacatgccgtttggcgccattgagttcaaccagatgagcgggcgtgccggtcgtgacggacagcccgccgtgatccacctgctctattcgtcgcgcgacgcccgcatcaacgagcgcctgctcgactgctacgcacccgagcgcgacgaactcgtcacactctatcgtgcgttgcagaccatgtggcgctccaaccgcggtaagaccggggatgattcattctgcgcaagcgatatcgacatcgcgcagatgtgccttgccatcgatgctcgcacgccggtcgacgagcgctcggtggaaagtggcctgggaatcttcgaagagcttggtttctgtcgcgtttcggggtttgacgacacccgtcgcatcgcgatggccgaaaaccccggccgtgtgcaattgagcaggtcaattcgctatttggagggcttgcgctcgcgcatggagttctcggctttccggagttgggcgctcgattcgtgcgcttctgatatgctagccaaagttaaccgcccgatcgtaccgcgggcctaggggaaggggacctcgatggatgccgcagcccgtaccgcccatgattccaccctccagccgttctcggagatggagcactataagcatgccgatgagctgccgcccgagattatggcggacagctacgacaaactggagcgcctgtgcctcaaatatatgaatgaggacgacttttctaaggtggagcaggcctattgctttgctgccgagaagcactgcaaccaaaagcgccgctcgggtgagatgtacatcaaccatcccgtcgaggtggccatcattttggccgatctcaagatggactgcgatgtagtgtgcgccgcgctgctgcacgataccgtcgaggataccgagacctcgcttgccgatgtttccggcctgtttggcgatacggtggccgagctcgtcgatggcgtgaccaagctcaccaacatcgaagtcgacagtatggacgagaaacaggcgctcacgctgcgaaagatgttcctcgccatgtccaaggacatccgcgtcatcatcgttaagcttgccgaccgtctgcacaacatgcgcacccttgcagccctgcgtgaggaccgtcgcctgtttaaggctcgcgagaccatggacgtgtatgcgcccctggccgaccgtctgggcatgagctccattaaatgggagctcgaggacctgtccttcttctacctggagcccgatgcctaccagcgcatcgcacgcatggtggcggagtcgcgcgaggtccgtgagcgctatctggccgagaccatcaagacgctcaccgacgagctcaaccgcattggcctggaagacttccagatcaacggccgttccaagcactattggtccatctaccaaaagatgaagcgcaagggcaaggaattctccgagatctacgacctggtggcactgcgcgtcatcacgcattcggtgcgcgattgctactccacgctcggcgcggtgcacacgctgtggcaccccatgcccggccgctttaaagactatatcgccatgcccaaggtcaataactaccagtcgctccacacgacggtcatcggccccacggctcgcccgctcgagattcagattcgaacctatgagatgcatgagcaggccgagtacggcattgccgcccactggctctataagaagtcgggcggatcgtctgcttccaagaccaatgacgctcaacgtttggacgaccagatcaactggctcaagcattcgctcgattgggcggcttccgacgagatcaccgatgccaaggaatacctgcattcgctgaaggtcgacctcttcgatcaggagatctttgtctttacgcccaagggcgaggtcatggcgcttcgtgccggctccacgccgctcgactttgcctacgccgttcacaccgaggtgggaaaccattgcgtcggcgccaaaatcaacggtgcggtggctccgctcacgcacgagattaagacgggtgaccgtgtcgagattctgactaacaagagttccaagccgtcgcgtgattggctcaagatcgttaagacaccttccgccaagtcaaagatccgccgctattttgccgctgcgaccaaggacgacgacgctgctgctggtcgcgatatgctggctaaggacctgcgtaagcgtggctatggcatttctacgccgcgttcgacgcgtgcgctcaacgccgtggcggagcagtttaacttcaagcagctcgaggacttgtttgccgccgtcggcgccggcaaggttgccccgcgcgctgtgggcaataaggtcgagcaaatcttggaccccaagcccgaggaacagctcaccaaggccgaggctatcgccgaggtcgtgaagcagcctgctcgcggctccaaccgcaagccgcaaaagcgcggcaagagcgccagtaacggcattatcgtcaagggcgagagcaacagcggcctactggtccgtctggctcattgctgcaaccccgtgacgggcgacgacatcgtcggcttcatcacgcgcggtcgtggcgtttcggtgcatcgcgccaactgtcccaacgtcaagggtcttatggagcatcccgagcgcatgatcgaagtggagtgggacggcgctgccgacaccctcttccaggtcgagatcgtggtcgagtgcctggaccgcatgggcctgctcaaggatgtcaccattgccattggcgatgcgggcggcaatatcctttctgccgccacgtcgaccaaccgcgagggtattgcaaccctgcgctttatggtcgagatctcggacgcgagtggtctggatccgctgctggcctccatcagcagcgttgactcggtctacgacgcacgccgcctgatgcccggtgagggtggagcccagcttaagcgccgcgtttagtcgcgacgaacgtgtcacattatcgatattcgctacactcgaggcatcgtttgatgcctcgagttctatagagaggagagggacatgagtgctgtgtccttggatgtaactcccaagggatcggtcgagatcgagacgctcgtaaacggtcccattcagaccaatagctatgctgttatttcggacaatgagtgcgtgattatcgatcccgcatgggaaggcgaacgcctggtggagcatattcgagccgagcatcccggcgtacgcgtgtttggcgccgtatgcactcatggccatgccgatcatgttggtggtgttgcaggcgtgcgaaccaccgttggcgagggctgccagtatgagctgtgtgctaaggatgtggcggtgccgcatgcgaacatcgaggaacagcgagctatgtggggcattgagacgcctgaccccggggagccgacgcacctgctcgccgagggagatgctatcaaggtgggcgatatctacctgcaggtgatcgagacgccagggcatacgccgggcgggatcgtcttgtttgctgccaccgagcaggggaacattgcctttgtgggcgacaccctgtttccgggtgggcacggccgcaccgatctttctggaggagacgaggcggcgattctgcgctcgctctccaagctcgcccggcttctcccgcccgataccgtttgcctaaccggtcatggcgattcgaccaccatggcacgcgagctcatgcagaaccctttcatgcagatttagcttaatagtcggcttttgaagcacgagaagcgtccaaacgtcaagctatttttccccaacgggtcgatttcgtagggcaaacggtcaaaaaagtctgtttggacgatattcgtgaacaaacgaacgtttatgctcgggtgcgccgtggtaaaatctcaggcgttatcggagcaaccttacaggaggtttcttttatgctcgtcaacgcagcagacatgctcaagaaggccgaggccggcaagtacggtcttggtgccttcaacaccaacaacctcgagtggaccctggctattctccaggccgccgaggaggccaagtctccgctgatccttcagtgcaccgctggtgccgctaagtggatgggcggtttcaaggtctgcgccgacatggtcaaggctgccgtcgaggccacgggcgttaccgttcccgtcgcccttcacctcgatcacggttcttacgaggactgcttcaagtgcatcgaggccggcttcacgtccatcatgtatgacggctctcacgaggagaccttccagcttaacctcgaccgcaccaaggagctcgttgagcttgcccactccaagggcatgtccatcgaggccgaggtcggcggcatcggcggcaccgaggacggcgtgacctccagcggcgagctcgctgatcctgctgagtgcaagcagatcgctgacctgggtgtcgacttcctcgcctgcggcatcggcaacatccacggcgtgtaccccgccgactgggctggtctttccttcgagcgtctgggcgagattaaggcccagaccggtgacctgcccctcgttctgcacggtggcaccggcatccccgaggatcagatcaagaaggccatctccctgggcatctccaagatcaacgtcaacaccgacctgcagctcgtcttcgccaagggcgtccgcgagtacatcgaggctggcaaggatcagcagggcaagggctttgacccccgcaagctcctcaagcctggtcgcgacaacatcgttgcccgcaccaaggagctcatggaggagtttggctccgtcaacaaggcgtaagcgtcgctaaacttcccgccggaagccccgtccccctacactgtttcctttgcgctcacctggctttgccagaagtcgcgccaagaaaacagctccgggggacggggcttccttcgtttaacgccgcagggttacgaggctgaattatttatttgactaccgttcagcggtgttgatggctcccttgttggggctttctttttatctcgctacaatgggcttcaagcgttctagtgacttggagttttggtatggctgttattaatgtgctgccttcggatgggaaggttattgacgagggtccagttggttgctctgctgatgtttgctgtgatgactttcgtcatctcgatgttggactgccgcccgagattcttcgtcttatggatgccgggtatttgacgcaggctgttgctgcctgcgatcgccttttggagcagaaccccgagccttcgctggctgcttgtgttcgtgccgagcggtatcgcatgctcgagacgccgcttcatttttcggtgtcgcgcgaccaggctattgcgatgattcgcgaggagtggccagagtttaccgaagagcagtttgatgaccttattaatcgtaagcgtattgactggcgctttatcgatggcgaactgttcgttctcgacaacttcctcgattcgcttcgcgtatatcccaaagaggttcccggcatgcggcccgattctacggacggaatagcactgcgcaacgagatgctcaaggagatggagtcgcaaaacgggttggctcgcgtcattacgcttaaagcgtccgtgtctgtccccggcgctctggaaggggagaccgtttgcgcttggcttcccgttgcggctgcctgccgtcagcagtctcgggtcgagattctcgatatgacgtcggggggtaccgttgcccctgaaaacgtttcggctcgcgctgcctcttggacatcttcgactgaacattcattctcggtgacctatcgctatcacgtcgatgccgcctattgcgatatctatggtggcgcgctcccatcgcatccctgtatggacgcgccactgcccgaggacacctccgaggaccgtccgcacattgcgttcacgccgtacatgcgacagttgacggagcgtgttattgacggtctcgagaatccgctcgatcgcgctcgtgctatctatgattacctgacacagcatattgactatcgctatcagccaccgtacctgcttttgggctccatcgccgatgactgtgcacactcgctccgcggcgattgcggcgttatggcgctcacgtttatcaccatgtgccgcatcgcgggcgtgcccgcccgctggcagagtggcctgtatgttgcgcctgattcggtggggccgcacgactgggcagagttctatacgccgcaaaccgggtggctcaacgccgacgtgtcatttggatcttctgctcgcaggatgggcgaggagtggcgccgccgtcactactttggcaatctcgatccgtggcgtatggtggccaacaatcgattccaggctgagtttgtgcctgctttcgacggcatgcgtgaggacccctatgacaaccagatgggcgaggcctcggttgacggacgtggatgtcgtaagcgggagatgttgcgcaaggttgagcttatcaaaatgctcgaagttccattttcggactaatcaacagaaagctgtgataaactaactcacgcattacgtgcccgagtggcggaattggcagacgctgtggactcaaaatccaccgttggcaacaacgtgcgagttcgagtctcgcctcgggcaccatacatgcaagtgagcgttcaagggggtcaaggccccctttttcgtgccgaactcgcgtgagcgcgcggagcgttaagcaaacaggcctgtggcctgtttgtagcggagcgtggcgagggcgccatgcgcccgaagcccggggcttcgcgaagcgaaggcccttcgagtctcgcctcgggcaccatacatgcacctgcgcttcaagggggtcaaggccccctttttcgtgtacgtaatgtgatagcgcgttgtacgtgttattattcgcaaggcgttgttcccgcaatgccctaaagaggaacccgagggctcccaccttttggcgccaatgagcagctgactggtcatacaacctagattcccttcctcataccgaggatgtctatgtgtacgacctggttgctgaaaagcgccgggttatttttttatgaatggaggtagggaaaatagctaagtctgatgacacccgcatcaacgacgagatcactgcatcttcgtgccgtttgattggcgtcgatggctctcagctcggcctgttcgccatccgcgatgcccagcgcgttgctgacgatcagggtctcgacctggtcgagatcgctcccaacgcggagccgccggtctgcaaggtcatggactacggtaagttcaagtaccagcaggccatgaaggctaaggccgctcgtaagaaccagtccaaggtcgaggtcaaggaaatgaagttccgacccaagatcgacgttggcgattacgagaccaagaagggccacgttctgcgtttcctcaagaagggcgcacgcgttaagattaccatcatgttccgcggccgtgagatggctcacccggagcagggtcttaacgttctcgagcgtctcgccgaggatctcaagccttacgctacggtcgagtccaagcctaagatggaaggccgtaacatgcttatgctgctcgccccgattaagggcgccttcgatgaggataaagcggcaagcgataccaagtaactagtgttctgtaaccgattaaggagtatttcatgcctaagatgaagtcccacagcggcaccaagaagcgtttccgcaagactggtaccggcaagcttatgcgcgccaaggctttcaagagccacatcctgagcaagaagtccaccaagcgtaagcgtggcttccgtcaggagaccgagatcgccgctgccgaccgcaaggtcatcaagtcgcgtctcgcctaagttcgcgttcccgtttttcgttttaccgtctaggagttgatagaacatggcacgtattaagcgcgctgttgccgccaagaagaagcgccgtaccgttatgcaccgtgcgaagggttactacggtgccgcttcgcgtacttacaagcatgctaaagagcaggtccagcactccctgcagtatcagtatcgtgatcgccgcaacaagaagcgcgagatccgctctctctggatcacccgcatcaacgctgccgctcgcctgaacgacatctcttactctcagttcatgcacggcctgaaggttgccggcatcgagctcgaccgtaaggtcctggctcagatggcttacgaggacatcgagtccttcaacgagctggctgccattgccaagaaggctctcgaggcctaatagattctgttgaatcgctaggggagtgtcgcactgtgcgcggcactccctctttttatctagagcgctggtttatatagcaaaagcgcgggtagatagacacttacaggtgaccgatctttatatatctcttaaccgaagggtcatcatctgatacgcgcagtatttctgcaccagcctttctattacttatataggaagcgataagttgtgtaggacttgtgaagagtggaattgacgtcccacatcgcttcgcggtctggcaatatatctccttgccgcgcggcccggtcgaaccggatgagccgcaaggcgtgcaccttgagaaccggatactgcgaggatggacacattcagtgtcgcatccgggcagacatcgaaccatttgaaatggtctaacttggatttgttcgacacgcataaaaagcctcccatttctcgtgtccaagaaatgggaggcagttcaggcgggcgggccttcggatgacctctcgggaccgtaagctgaggaaaagtttgtgagctggtcgggctttgcccggccagctctttttgatttaaaatacctgctcagttgtgatttatggtgctgggaggcgcttgtgggcaaggcgaaggctaaggcgaagaaaaagacgacgggggcgcgggctaagcgcgatcgtcgtcggaagctcgcgaccgaagcccccgcgtctgccgaggagctgctggcaaacgtgccgggacttgacgcgctgcaggatgttccggcgttcgatgacctgccggtcgatgaagctcagcaggcggcatttgacgacttttgcgcacataccgaggagcccgagcagatgcagcttggcgccgtggtgcgcttggatcgcgggtttccgctggtggcgactgccgacgacaccttccgcgccgagcatgccgtggggtttgccaagtcgcgcggcgaggacgaggtcctgctgcctgccgtgggcgaccgtgtggcggtgcgccgcgctcccgggcacgatatgggcgtgattgagtgcgtgctgccgcgccgtacgagctttgagcgttggcgcggccgtgcccgcggagagcgtcaggtgctctgctccaacgtggattgcgtgctaatcgtgcaggcgctcggtgccggtgaggtgctgctcgaccgcgtggcgcgctcgctggtgttggcgctcgactgcgatgccgaaccggtggtggtgctcaccaaagctgatcgctgcgatgccgaggagctcgagcgcgatctggaccgcgtgcgccgcctggtgggtccggacgtgcgcgtgatcgtgacgtcctctgccgaggggcgcggcctggacgaggttcgttcctgcgtgcctgccgggagctgcgccatgattctgggcgagtcgggtgccggcaagtcgacgctgctcaatgcgctgctgggccacgatacgttggcgactggcggtgtgcgcgaacgcgacgaccagggccgtcacactaccgtcgcgcgcgtgatggtggcactgccgggcgacgccggcgtgatcgccgatgccccgggcctgcgcagcttaccgctcgtgggtcacgagcggggtctggcgcgcgccttccccgagattgtcgaggcatcgcgcgcgtgccggtttggcgattgcacgcatacccatgagccgggttgtgccgttcgcgaggccgaggacgccgggcagatcgacagcctgcgtttggaaacgttccaaaacctggcgtcatccatgcgcgtgagtgctcaaatgctcgatcccgatgtccacctgtaattgatttttcctatgacagccgtcttccaactgttcgggagacggcttttttgctgcgaaaaagcctcgaaacatgcagtttgctgacgtgctgaccaaaaccttgccacgagcttgacgggctggttagtttttggtcagcgattggtttgacatcgaaaaccgagatcgcgattgcgccgctttgcactctgaccacccagacaatggtggtacgggcattcgcccggcactgccatgagaggagcggccgtgaacaagagcaagcgcatcgccatcagtctggtcgcgggcgtgctcgctgcgctgctctgcatggtttacggctcgtcgattcgctcgcaagccgaacaggtccaggctgagaccttggccaagtacggtggcgatcgcgccgaggtatgcgtcgcggcgcgcgatatcgatgtgggcgagaccctcgatgagaccaatgtcataacccaggaatggctgacgagtctgctgccgcgtgacgcggcgaccgagctgcgccaggtgcgcggcgacgtgacgacttcgcgtattcccaaaaacgccgtgatctgcaatgtctacaccaaggccgagagccacaagctcgaggtgcctaagggcaaggtcgccgtttcggtggcggtcgatgccgagcactcggtcggcggtgctacgggcgtgggcagctacgtggatgtgtatgtgcaaaaagacggcgtaaccgatcgactgtgcggcgcgtacgtgatcgataccagtgaggattccggtgccacgcgcgagggcaagatcgaatgggtgacgctggcggctgaccccgaagacgtcaaggaactgctgggagcctcgggcaagggaacggtcagcttgacgattcccgccacggcgcgcggcaaaaagagcggaggcgacgagtgatgaaggcgatctggcttgcgtgctgcgcgtgcggcgattacgggctgttgcagcgggaagtcgagggccgtgatacgggtgcacaggtgcttcgcgtgggtgacctggacgggctggtttccatggcgcgggcgtttccgtcgcgccgcggagctgccatcatcgcggcgtctctgtttgataccgaagatgtgcgcaagactgttgcgcgcctgacggccgaaggccgcgtgagtcgcgtggtcgtgttgatagaagcactcgatccgtcggatatcgaggggctgtttcgcgcaggggcgaccgaggtcatcgctgcgcacagtatatgcggcaacgggcgagcgggcgagggagcggttgattccgatcggcgcatgacgattgagcccgatgcttttgttgatagggaacccggggcgcctcgcgctacaagaggcccgcgtgttgatgattatggaaaagcggaagccgagcatggtcggcgcccccggaacccccttgtatacgatgacgctggaggaccggcgcagcatgctggcgactccccggctgtagatatgggatacgtgcgcggcgtgaatctggcggatgaactcgacgaagttgagggctttgccgggtgcggcgagttgtcgctgatgcagcatgagcagattgcgcagaacgagcctgcctcgcagaccgaacaagccgccatgccggcttggacgcagcgtgtagttgcggcgggggagacggggacgctgtcaccgacgcccgccccgccgcctccgatgccgccggcagacgctgccgcttcgccgcatcgagctccggtcatctgcgccatttcgggttcgggcggttgcggcaagtcgacgatcgttgccaccatggcacacacatcgtcgctgttgggcttgcgtgccgccgtgctcgacctggacctgatgtttggaaacctttacgacttgttaggcgtcgatgctccgcacgatatggcggcacttatcgagccgtcggcggcgggcacgctcaccgagccggatatcgtggccgcatcgatgcgcgtcgccccgggcgttacgctctggggtcccgtcgcggcgcccgagcaagctgagctcatggcacgtccggtggagctgctgctcgatgtcctgcgtcgcgaatccgacgtggtctttatcgatacctcggtcttttggggcgatgccgtggcggctgcggtggcggcgagcgaccgttgcctggtcgttggcgatgcggcggtgtcgtccgcgacatcggcgtcgcgcgtcattgaactggcaagtcgagtaggtgtgccgcgcacgcgcatgagcgccgtgttcaaccggttcggtgcgcgcggggcagacgaggacgtcgccatgcgctttgagattgcctgtgcgttgagctccaagattcatatcgccgatggcgggcaggatctcgccgcgctcatggcgtttggacgcgctgacgaggcagtggggcagaccagcgcttttgcgaccagcgtgcgcgaggctacgcgcgagatgctcgtggaactggggtgcgccgtcggcccttggagcgatatggtcgccgaccgtgcaacgcgtaccgagcgcccgcgtatccgccttccctggtcgcgcgagggtgatcagcgatgagtctgcaaacgaggattaaggctgccggcgctgcagcggcggcagcgcctgtagatgcggggcgtcgccgcgcggtgaaacgacgcaccaagcgcgccgtgatggaccgcatgggttacgacgaagtggcgcgtatcagcgcctatatcgacccggcacttgcccgctcggaattgcgtcccgcggtggaggcggcgctcaatgttgaggaaccgaccgatctcgcgacgcccgagcgcgagaccatcatcgacgagattttggatgacgtggtgggcttggggccgttgcagccgctcatcgaggacgacaccgttaccgagatcatgatcaacggctgccgctcggctttctttgaacgtggtggcgtcttgtaccccatcgagcatgcgtttgaggatgatgagcagatccgtgtgcttatcgaccgcatcatctcgccacttggccgccgtatcgacgaacgcagccccatcgtcaacgcccgcctcaaaacgggctatcgcgtcaacgcggtgattccgcctgtggcgattgacggaccgattctcaccatccgaaagttctcggaccgcatctgctcactggacgagcttgtggggctggggtcgctgccgctttggtatgcgcagctgctgtcgtgcgcggtgtcgctgcgacaggacctggcggttgcgggaggcacgggatctggtaagaccaccctgctcaacgcgttgtcatgcgagatttccaccggcgagcgcatcgtgacgatcgaggactctgccgagctcaagtttgcgcatcatccgcacgtggtgcgcctagaggcgcgcgaggcttcaattgagggtgagggtgcggtgacgattcgcgacctagtaactaatgccctgcgcatgcgccccgaccgcatcgtggtgggcgaggtgcgtggtgccgagtgctgcgacatgttgcaggccatgaacacgggccacgacgggtcgctcaccacacttcatgcgggttcagaacaggagaccgtggtgcgtctgacattgcttgcacgttatggcatcgatctgccgagcgagctcatcgaggagcagattgccatggcgctcgacggcatcgtgatgtccgagcgccacgccgatggcaggcgtttcgtctcctcgtattcgggggtgcgtcgcgccgcgtcgggcggcgtagagctcgagcgctatgtgactttcgatgccgccgagcgcacttggacgcttgaccgcgagccgccgtttatcgcagaaggcctgcggtcggggacgctcacacaagaggaggtggacgaatggaggtcgctgtgcccctcgtcgtagggggtttggcagggttttctgttgcgacggcgtgcggggcggaacctcgtgtgccgcaggtgccgccggcggagctggcgcgtcaggcgctcgagacggtggcagagaggctgccgcgtgagctggtggaaaacgatctgctgaaaaagatcgcccgttcgtggacatcgctggctccggcgcatcgccttggcctcgtgatcgaagatgcttcggggcgtttggcgtttctactgctatcgagcggtgtctgctgcgttttactaacgatggtgtcgttatcgcccctcgggtttgccttgggacttgttgctccgattgccgctggcgccgctcgggatggctttgagagccggcgcgagcaacacgatgcagaagaggcaatgcccgaggcgtttaccgcactttccatgtcgcttgcctcgggacattcgctggcccagggcatgcgctttgtgggcgctcatgcgcaagaaccggtgcataccgagtttttgcgggtggcggcggcgatcgattgcggtatctcggcgaccgacgcgctcgatgacttgctcgtgcgcatcgacgctcccggcctttcgcttgtgaccttggcgcttaaggtgtctcagcgcaccggtgctccgcttgccgacttactgtccgaggcgtcgagcatggtgggggagcgcattgagctcaagcgccgcctggatgtcaagacgtcgcaggctcgcatgtctgcgcatatggtcgcggcgatgccggcgggcatgtgcgcggtgttggcgctgctttcggcagattttcgtcgcggtcttgcgacgcctgccggcgtgggcgctgtggtgctgggtcttgccctcaatgccgttgccctggtggttatccgacgcattatgcgggtggagctatgagcgccccggttgcagttgcggcttgcctgtgcgccctgagtgtatttgtcgcgacgggtttggatcgggcggatgcacgcaagatcgcaggggcctgcaagcgcgaggcggtgctggtcgctgccgcgggtcgctcagtggtcgatgccctgaccgcgcgagtgaagggcgcggttggagtgggcggcccggcgcgagtgtcgctcggcgaagtgtccgagatgatcgatgttgtgcgcttgggtctttcggccggtctttcgtttgatgcggcgcttgagattttctgcgccaaccgccggtcagtgctggctcttcgccttgagcgggcctgcatggcgtggcaggtgggcgtgggcacgcgtgaggacgagttgttggccgccgcgcgcgacctggacgtgcgagcgctcgagacctttgccatcacggtggggcaggcgctcgccctgggtgccccacttgccgagacgctggccgctcaaagtcgcgagatccgtgcggctcatcgcgctgcggtcgagcgcgagatcgagcgtgcgcccgtcaagctgctgattcccaccggcacgctcatcttgccggcgttgcttctgtccatattgggcccgctgctgggagcaggcgggatgatgtagggaggaatacatgaacacgatgactgacgctgctggcaaggtccagggctgggcgttttgccgggcggcacatgttcgtcaacgcgccaaggagctactgcaggaggagagtgcacagggtaccaccgagtatgccatcttggtcggcgtgctcgtggtgatcgcgattatcgccatcgtcgcatttaagggcaaggttaaagagctatgggatgcgatcagcgagggcatcaacagcctgtagagggcgagcgccccatcggggtgctgctggtgtttgcttgcctgaccgtggcgatagcggcggtgctttgggggcttaacgccgcgcggcagcagcgtcctggggccgccttcgattcgggctcagattcggcggtggcgtctcaaaaagatgagatgcgagatgcggacgattcggatgtcgctgtcacggcgcaaacctttctgcggacgctcgacaagcggtctggcactgcgacggatttgcctgaggacaacgcgattgcggtccggcttgcatggtccgaggaccgaccgatgaccgaggcagcggcggatatgttacgcgcctaccgcgaggtgccaacgtcccagctcgccctgagcggctatctcgatattaagggcaacgtatggggcgccatcgtgcgcgatgggcgcggctgggtcgatatggtgacggttgccgcggatactggcgatgcttcgtgtcgtctgcgcgccgtgcgcttggtcccgcaaacaataagctcaaaggagggatcgtgaaatgcatggcgttctgcgtgaagaggttgcccaagcgactgtggaatacgccatcgtcacggtggcgctgttatcgatcgtgctggcgatcgcggggctttggcgtgctggcaccgatgggcgcttggcggcgctggttgagcgggcggcatcccatggcgttgcctcgacgtcggttatcgacgccgctgcgggtgctaaggacatcgcgttgtattgatatcgcgcgtgaggaccgggcgcagtctacggtcgaggccgcttttttgctgccgacgtttctgacgctcatccttctcgcactgcaaccggtgtgcctgctttatacgcgcgcggtcatggagtctgccgccgccgagaccgcgcggctcatgaccacgacgacggcggaggacgacgatcttaaggagttcacccgccgccggcttgccgcagtgcccaacgtttcgatctttcatgccggcgggccgttgtcgtgggatatcgagcttggccgggccggtgcgggtggcgtctcggccgtgtccgtttccggcaaggtcaagccgttgcctgtgatcggtgcgtttgcgcgggctatgggtggtaccgccgagggcggctacgttgagctcaaggtcgatgtctcgtatcaatcgcgtcccgaatggctggagggagattatgattcgtggattgctgcatgggattaagcgtttctggtctagatgcgttttgacgcgccgtccgagctgccatcgcaagcgaggcggctttatgggccgtgccggtgtcgacctgtttatcgaagacggtgcctacaccacgctttcttctgccgtggtcatcctagtggtgctcacgttgttgttttcgtcgaccgcggcgatatggagcatgtcgcgtgccggggatacccaggtggcggccgatagcggcgcgctggcgggtgccaacgtagtgtcgtcctatcacacggctgccacggtggttgatgcgagcatcttgagtctggggctggcggggtttgccacaatcgggacgggcctggtcgccatcctcatcccgggtgccgaaccagttgccggcaatatggtcgacaccgggattgagatcattaaaacgcgcaacaagtttgccaaaagcgcatcggaaggcttacagaaaatcgagacggctctgccgtatctgatcgccgcgcgtgccacgcaggcggtgtcggcgcaggataccgatagcgtgacctataccggtacggcgcttgccgtgcccaggacatccgagtcggacttcgctgcgctcaaagggtcagagatctcgaccgataccattaaagacacatcagatgatttagagcgtgcggccgaggagctgcggaaggcttctgaggacacggcgaaggctaaagagcgcgcttggctggcggattgtggcgggtcggacgagagttcgattggcaagtactcgtgtatgtgggagcgtgcgaaaagcctaacggatctctctggtgctcaaaatccacattacgcttcgagcgttacgtgggaaccgcaagtggcgctcgatcgcgcgaaggcctactatcgccagcgcctggcaaatgagaaaccgcttggcgagggtccggaaaaacaggcagattctgctgcacgaaaggtgttcttcgcttatgcgagcgaagaagtcgagcgggcatatataactgaaaaggacggcaaagtttccgcccacacccctttccttccgcgaaatccagatgaggcgcgggcgactgaactctataccgatgcgtgttggcccacgagtgaagtagataaagttacctatttgcattatgggactgactgtccaaattacaaaaaaggaaagccgggtgggctggcatccgtcgcagattttgacggtcacgaaacgtgtagcgaatgccatttcggtgtgtcgtctttagggtacgttgcgattgcaacgacttctgtcgaaaggggcttcgagtaccacttcgataagttcaaagaggccctggaagactacgtcgaatgccgcaacaaggagttcgagctcgagcgtcagaccgaggacgaggccgaccgtgcaggcaatgcgtttgaccaggccattaaagcgctttccggcgagcgcccgcgtatcgccccacctggacgcaacggcgtggtcgcatttgcagtttcgggtgatattaccagccccgatcaacttaactcctcgtttaacacggcagtcaggcttggcgatcgcggtgctatctctgccgcggtgctggcgcccgatgacgcgacggcgcaaaacaacgtgctttcgcgatttttctcgacattgaaggaacgctcgggcggcgttgccggcgtgctcgacggcgtcatggatgtttggggacggctgctcgtaggatacggtgatattcaaggttcggccgacgaacttatggacgagatgattaaaggcctaggagggggcagcggcgcgttgggctccatcgcatcgtggctcggcgataccgtttcggcgtccgtggcggcgctgggtttggaaccgtgcgacttgcgcctgcgaaagccggtgctgaccgattctgccaacgtcattaagagtccggggtctgacattgcgggtctctctcaagcgcaagacaaactgcgaagtattccgttgggcgtgaccgatcccaaggcgctttgcgaggcgttggaatatcaagtcgaacgcaccattagcggtacggtgttcacacttgcggagattcctctgcccggcggcggttccatcccgctcaccgtcgatgtcgccacgctggttggcgctctgggcggtgggtcgtaatgagtatccgcatgcgtctgcgcgaggagcgcgcccaagcgacggtggagatggcagtggttacgcccgttttgctggtgctggcactcatcgtgtacaacgtcatgatctttgccggcgctgtcgcgcgcttcgaccgcgtggtgcccgacatcgtgctagcgcatgccgtggcgtcggagggggagggcgacgaaagctctgccgatgcctcggcgacggtccagactcaaattctgaatgccatggaaggctatgacttgcagatcgaagtgtcgagcgagcaaggcgcgaaggcatcagatggtggcctgctctccctatccggtacgtttaggacctacacctgcaccatgcactatgagccgtggccgacttctctcagcatcgctggcgttccgctgggggcgccgacaacgttgtcgcacgagcgcgcggtgacggtcgatccatggcatccgggggtggtcatgtgaccgcggtctcgtcctacatcgcctacgcgcgggcactcaataggctgggttggacgccggccgagtttgtggtggcggagtcgtttgtcgtgcgcctgcgcggcatgctgggacggcgtccggttgccgccaacggcctgtcgctcgtcatggcgtttccacgctgctcttcggtccatacgtgttttatggcctatcccatcgacatcgccttcatcgatcgcgacggcaatatcctcgcgcgctacgaaaacgttcgtccttggcgcatgtgctcctgcctcggcgcctgggccgtactagagcgtccttcaatcattgtttcgactcctgctctccaacgcgtgccggcttaagaattggcgacagtggactttcgtcatacgaaattgggtaagatggaggagaagatgcatggatgttgagatccatcccaacgctaaaaagcacctgacggaaaagcaggtgcttagcgcttggcttgcggttactgagtgcattcgtcgcgagccgaaggacgagccgccgagatggcttgcaattggatggctctcagacggacgaagcgtggagcttgtcgcggtcgagcttgtccgtgggtggcttatcattcatgccttgtctccagtccagaagaatttttggcaggagattgaacaggctcggcaaaggggtcgatgatgggcaagacgtatacggccgctaatggtcaggttgtaacggatgaaatgattgacgcgtggtgcgagtcgtacgagcgcggagagtttccggatggcgaacacaccgttggtgggatcgtgcatggacggcccccgctctcaggtgaggggacggcaacgctgtcggtcaagattcctctgggaatgaaggaggccattcgtcgacgggcggctgccgaggggatgacgccaagtgagtttgcccgtgcggctctgagtgaaaaacttcttgctgccggctgatgcctctgacgtgccgatttatagaaccgaggctgtgcccaaaaacttttttaaaattctcggttgaccggaacgcgtccttggttatactaatcaagccttgaaacaaggcacacctcaaatggctgggtagctcagttggtagagcagaggactgaaaatcctcgtgtcaggggttcgattcccttccccgccaccttgaattgactaggacctctgcaaaggggtccttttcttttattgagggctctgcggaaattgcgtcccggaatttggcttcagagtgggatgcgttttccgctttgaggccgcttgggaaagcgcgacccggaatccggcgtcagaatgggatgtgctttccttttgcggtctttggcggaaactgcgtcccagatcccgcgctcagaacgggatgcgcttttcggccgcctacttccggcgcatatgtacatctcggcgcgccatctcgggcccgcccagatattcctcccgcttttgcgccactttacagaccgttcggtcgtctgtccgcacgcgcgggtatactcaaaacgatacttttcctatgcaatacgatgcaggctcggcctgcacgatccgaagggggcagtgatggagaggatactcggcgttaatctctctggctggtttattcccgagccttgggtgaccccgtcgctatacgcggcgaccggtgcatccaacgcggccgagctgcaggaggccatgggcaccgccgcctataacgagcgcatgcgccgtcattacgagacgtttgtgagcgaggacgatttccgtcgcatggcgcagatcggtctcaatgccgtgcgtctgccggtgccctggtatgcctttggctcgcaggagtccgatgcgtcctacatctcggttgtcgactacattgaccgtgcgattgagtgggctgccaagtacgacatccgcgtgctgcttgatctagcaactgtgcccggtggccagggcgattccaatgattcgcccgccacgccagaggctgttgccgagtggcattcgtccaccaacggccgtcatgttgcgctcgacgtgctcgagcgcctggccgatcgctacggcgaggccgagagcctgctgggcattgagctgctggatacgccgcagatgagtgtccgcaagagcctcttcaccatgacggatggcattccggcgcactacctgcgcaacttctatcgcgatgcctatgagctcgtccgttcatatatgcccgaggataagatcgtcgtcttctcgtcgtcggggcatcccagcgagtggaagcattttatgcgcgacgccaagtataagaacgtctacatggaccttcacctgtaccattaccgtgacgagcatgcgctcgatatcacgagcccccgcgggctgacgacggcgatttcgcgcaacaagcgcgagctcaaagaagcgatttcgactgggttccccgtgctggtgggcgaatggtcgggcgcggcgatctttgccaactcgtcggttacgcccgagggccgcaatgcctacgagcgcgtgtttatcgccaatcagctggcttcgtttgcgccggctgccggttggttcttccaaacgtggaagaccgagaagcgcattgcagcatgggacgcccgcgcggcgctcggtacgctcgagcgcggcatgattgaataggttgatatgacgcaaaacagcgcccatacgggcaaactctatgtggtcggcacgcccatcggcaacctgggcgacctgtccccgcgcgttggcgaggcgtttgccgccgccgatgccatctgctgcgaagacacgcgtgtgacgtcaaagctgctgatgcacctgggcatttccaagccgcttgtccgttgcgacgagaatgtgatcgccagccgcgccgccggcctagtcgaccgtctgctggcgggggagaccctcgcctttgcctcggacgccggcatgccgagcgtgtccgatcccggccaggcgctagttgaggcggcgcgtgaggccgatgtgcccgtcgaagttattcccgggccctctgcttgcgtcacggcgcttgtttcgtccggcattccctgcgagcatttcttcttcgaaggctttttgggtcgcaagcacggcgaccgcgtgcgccgactgcagcgccttgccgtggtgcccggcgcgctcatcttctacgagtctccacatcgcatcgtggcgacgctcgaggccgtggcggaggtctttccccagcgtgaggttgccgtctgccgcgaactcaccaagctgcacgaggaggtcttgcgcgggcccgctgctcagcttgccgaggagctgcgtgctcgcggcgaggtaaagggcgagattgcgctggtcatcgcgccgccgagcgaggatgaggaggccggtatcgtgccggttggcgccgcggcagcggatcccgacgaggccctgcgcgaggatatccgcgccgcgctcgaggagggggagcccgcctctgcggtggccaagcgcctgtctcagaagtattcgcgccgcaagcgcgatgtctatgccatggtgctcgatatgcaatagatggaggatatccagcccttgcgctagaatcatcccctgtatgcaacgtttttctggaggacaaaccccatggatcaaagcaagccttcgttctttatcacgacgcccatctactacgtcaacgccgatccgcacctgggcacggcttattccaccatcatcgccgacgttcaggctcgctatcgtcgctccgccggctataacgtcaagttcctgaccggcatggacgagcacggcgagaaggtcgccgaggccgcagccaagcacaacatgacgccgcaggagtggaccgatagccaggctccgcacttcaaggagctttggagcaagctcgagatttccaatgatgacttcatccgcaccaccgagccgcgccagcaccatgccgtgcagtacctgtgggagcgcatgaaggagtccggctacctgtataagggcagctacgacggctggtattgcgtgcctgacgagacctactttaccgatacgcaggtccagaagggcgacgaggagtacggcagcgtcggccagcacctgtgccccgactgccaccgtccgcttgagcgcgtgcaggaggagtcctacttctttaagctttccgctttccaggataagctgctcaagctttacgacgagcaccccgactttgtcgagcctgcgttccgcatgaacgaggtacgtagctttgtcgagggcggccttaatgacctttccgtgagccgtacgagctttgactggggcattcaggtcccgtttgacgagggtcacgtgacctacgtgtggttcgatgcgctgctcaactatatgacggccgtcggctacggtgtcgacaccgacgaggcgcgtgccgagctggcctatcgctggcccgcgcagttccacatcgtgggtaaggacatcatccgcttccactgcgtcatttggcccgccatgctcatggccatcggcgaggccctgcccgagcacgtctttgcccacggcttcctgaccgtgcgcaatgccgagaccggcaaggccgagaagatgtccaagagccgcggcaacgccatcgctccgcaggacgttatcgacatgctgggcgtcgagggctatcgctactacttcatgaccgacgtcgtccccggcaccgacggtgccatcagcttcgatcgcatggagcaggtctacaacgccgacctggccaacagctggggcaaccttatctcgcgttcgctcaacatgagcggcaagtactttgacggttgcgcgcccgccaagcccgcgtcgttcgatgcgttcgacaacccgctggcaaagatcgccgatggcctggtcgagcgctacatggccaagatggacgtgctcgattacggcggagccaaggatgaggtcatggagctcatccatgccgccaaccactacatcgaggactccgagccctgggcgcttgccaaggacgaggccaaggctgacgagctggcatttgtgatctacaacctgctcgaggccatccgcattgccgctcacctgctgatgccgctcatgccccagacttctgtcgaggccctgcgccgcctgtcctgtgagggcgaggccgcgagcgacgacctcaagggcatttgtacttggggcctgcttgccggcggtcagcccgtcgagaagggcgatccgctgttcccgcgtctggcgtagagaccgcgcgagcgccatatcggcaatttgctgtttagctgtaagggcatggccgccacggtccatgcccttttgtttcaagacgccgccatcatgctaaggaggcaaccatgacaacttcgcctttggcaaaccccacggccaccagggagctgctggaggagtttggccttgcgaccaagcatcgcctgggccagaactttctaatcgacaatcatgtgatcgagcgtatctgcgagctttccgagctcacgggcgatgagcgcgtgctcgaggttggcccgggcgttggtacgctcacgcttgcgctgctgcaggaggcggcgtgtgtcacgtcgatcgaggccgaccccgagctcgagccggtgctcgatgcccacgccgccgactacgccaacttccgctttatcatgggcgacgcgctcaaggtgggtccggagcagattgagcaggctgcgggcggtgagccgacggtgtttgtcgcgaacctgccctataacgtggcggcgacgatcatcctgcagttcttccagacgatgcctgcactcaagcgcgccgtcgtcatggttcaaaaggaggttgccgatcgtattgccgcagtgccgggtaacaagacctatggtggctacacggcaaagctgggcctgtatgcgcaggttacgggtcgctttgaggttccgccgcgttgctttatgccggcgccgcacgttgactcggctgtcgtgcgtatcgaccgtgttgacggcgtggtgcccgaaggactcgatcgcgaatttgtggcccgcgtgattgatgctgcatttgcccagcgtcgcaagaccatccgcaattccatgagcgccaacggctttgccaaggacgtgctcgatgccgcctttgaggcttgcggtatcgcacccaccacgcgcgccgagacgcttgatgttgccgactttgtccgtctggcccgggagctaatccatgatgcctaatgccgcatgcgtgacgtttaccaagaaaaagaagacggtcgcctgccccgtgcccttggcaccgcttgccgacacgcatgcgcatctgctttcgttttggggcaaagaagtgcccgagacgctcgtgcgcgccaaagccgcgggcgtcgacctgttggtgacgatgttcgaccccatcgctgacaaacgcagcgtgacggactatagcgactggctcgtgcgcgaaattctgccgatgcaggatatcccgcagatcaagtatcttgccggcgtgcatccgtatggcgcgccggactataccgacgacgttcacgcacaggtcgttgccgcactcgatgaccctttgtgcgccggtatcggcgagatcggtctggactaccacatggattacgacgacgatatcgcgccggcgccccacgacgtgcagatcgactgtatggcgcgccaactcgaggtcgccgtacgccgcaatgtgccggtagagctgcatctgcgtcatgaggatacggacgaggagcgcacctcgcatgtggacgcctacaacgtgttgcgcgaggtcgacgtgccccaggccggttgcgtactgcactgctttggcgaggaccgcgccacgatggagcgctttgtggagctgggctgctatatcgcctatggtggcgcggccacctttaagcgcaacgacgacgtgcgcgaggcatttgcggcaaccccactcgatcgaattttgttcgagacggattgcccgtatatggctccggagcccatccgcggtcttgaatgcgagcccgcaatgatctccattacggcaaacgcgctggttaacgaccgtgtcgatcgcacaggtgaggacgccgaaacaatcgcgcaagccgcttgggaaaatgcctgcaaactttttcaaaaatagttcttgcgttcgcggtggcgctccgttattctaattcctgcacgcgggcgtggcggaattggcagacgcgtacggttcaggtccgtatgggggcaaccccatgaaggttcaagtcctttcgcccgcaccattaaatgaaagagctcccagcgatgggagcttttttgttatgagcccatcgcagggacttgaacctgcgaaggagcgagcgtaaagaaaacgcggagcgttttagcgagctggcgagtccgccggcaggcgggcgaagccggtgcggatccgcgcagcggatacgcggacgtcctttcgcccgcaccattaaatgaaagagctcccagcaatgggggcttttttgttatgcacaatctccttggacgggtatcctaatgccaacgtgtgcctatcagaggagagaccatgctgttgtccggtatcattgccgcccttacgagccttttgattcccatcatcattttgttgctgctgcttcccaacgcctgctatgtcgttgaacaacagcatgccgtgatcatcgagcgtctgggcaagtttaaccgcatcgtcaacgcgggcttccacatgaaggtgcccgtgatcgaccgcaaagccgccacggtgagtctgcgcaccatgaaaaacggttttggtatcgacgttaagacccaggataatgtgaccatcggcctcgaggtctctgctcagtaccacgtgagctatgacatgggtgctggcccggcagattcgggtatctacaagagctactacatgctgcaggagcccgtcgaccagatgcgtgacttcatcaccgacgccctgcgctcttcgattcccgtctacacactcgatgaggtctttgccaagaaggatgacatcgccaaggacgtcaacgctaccgtttccgagcagatggccgcctacggcttcaccctcgtgtcgacgctcatcaccaaaatcgcactgccgaccgaggtcgagaactccatgaacgacatcaacgccgcccagcgcaagcgcgctgcggcacaggagctcgccgaggccgaccgcatcaagcgcgtcaccgaggcgaccgccgaggccgaggctatggaaaaggcgggcgagggcatcgccaaccagcgcaaggccattgcactgggtatcaaagattcgctcgagatcatccaggagacgggtgtcggcaatgacgaggccaaccaactgttcatgtttacgcagtggtccgagatgatgacggagttcgctcgcacgggtaaaacctcgacggtcgtgctgccgagcgacttttcgcagtcggcctctatgttcgagcagatgctggctgccggtaaggttcagaacgagtcaaaggagtaggcacgcgtgaaatacaccgtcgtttgtgttggcaagctcaaagagcgcttttggaaggacgcgtgcgctgagtacaccaagcgcctaggcgcctatgccaaggtggatatccgcgaggtggccgatatcgacccggctaaggcgggcggcgtggatgccgcgcgcgacaaggagggggcggcaattcttgctgcattgccgtctcgagctcatgtgatcctgctggctatcgagggcaaggagcgttcgagtgaggagctctcggcgaggctcgacgatcttatgctgcgaggcagcagcgacatcgcctttgtgattggcggttcggacggcgtgagcgatgaggtgcgcgcccgcgccgacgagatgctcagctttggacgcattaccttgccgcataacttggcgcgcgtggtgctgctggagcaaatctaccgcgcctgcaagatcagccgtggcgagccgtatcacaaataggtcggcaatacgaaacaatggcgtgggacaatagctttcgttttgaagagcgtgtctgagaggactatgagatatgaagattggatttgtcggttttggcaatatggcgagcgctatggccgatggctggatcgctgccggtgtagctgcgagcgacatgtgcgcctgcgcgggtcgctacgacgcactggttgagcgctgcgaggcgcgcggcatggtcgcctgccacgatgccgccgaggttgtcgccgcatccgatatcgtggtcgctgcggtcaaaccgtacatgatcgagaaggtattcgccccgctcaaggatgctcttgccaaaaaggtcgttctgtcggttgcctggacctgggacagtgccaagtgggagcaggtcctgccgggcgtcgcgcatatctcgacggtgcccaacacaccggtttcggtgggcgagggcgtcatcgcttgcgagaaggcttccacgcttagtgatgagcagagcgccgtggtgcttgatctgcttggcaagctcggtgcggtggtcgagcttgatacgagcctgctgttcgtgggcggcacggtgggtggttgcgctccggcatttgtcgctatggcaatcgaggccctgggcgatgcggcggtcaagcacggtatcccgcgtgccgatgcctatcgcattgtgagccagatggtgctaggtacggcaaagttgcagctttcaactggtcagcatcctgcggcgatgaaggatgccgtatgctcgcccggtggcgccaccatcaagggcgtcgttgcgctcgaggatgccggcatgcgcagtgccctggtcaaggcaatcgacgcaactctccagtaaaacctgccatttagggacaggtttattttggcaggtttttcctgcggttttgtcgtatgtgcgaaaagcgccccgcaactggctcaattccagttgcggggcgcttgcgtttgcccagataaaaccgaccaaaataaacctggccctttttggcaggttagtcccagaagctgtcttcctcatcctcggacttgggtccgcggtcgacgtacatcttatgggtacgcttctccattacaaaggcaagaatcgcaaataacaggatgccgccggcgaaaaggatggcaaaaccggtgcgggtgccaaacaaaaaggaaaaaactgcgtccattgggtgccttcttgcgtagttgagttgggtcgtaaacgctcataagtatatacttgcccatacatgtacaaggttgcaacctaaatggaatgtatatcgccggaggatctaatgcttgatatcaagtttgttcgcgagaaccccgatgccatcgatgtcgccatggctaaccgccagacgtcttgggatcgcgagaagttctttgagctcgacgacgagcgccgtgccgtcatcaccgaggtcgaggagctccaggctacgcgtaatgccgagtccaagaagatcggcgccctgatgaaggagggcaagaaggacgaggccgaggctgccaaggaggccgtgcgcgccgtcaacgagaagattgacggtctggccgagcgtcgtaccgccctcgagcaggagcagtacgacttcatggctcacctgcccaacattccttgcgaggccacgccgtacggtaaggacgaggacgagaacatcgagcgtcgccgctggggcaccccgcgcgagttcgacttcgactttaagccgcactgggatctgggcaccgatctggacatcctcgacttcgagcgtggcaacaagctctccggcagccgctttaccgttctcggtggcgccggcgcccgcctggagcgtgcccttatcaacttcttcctcgatacgcacaccagccgtggcttcaaggagtggtggccgcctatcgtcgtcaagcgtcagactatgttcggcacgggccagctgcccaagttcgaggacgacgcctatcatgtctcgggcgacaacttcctgatccccaccgccgaggtcgtgctcaccaatctgcacgccggcgaggtcctcgatgccgacaccctgccgcgccgctacaccgccttcaccccctgcttccgcgaggaggccggttccgccggtcgcgacacccgcggcatcatccgtcagcacgagttcgacaaggtcgagatggtcaagttcgctaagccggaggagtccgacgaggagctcgagaccatgaccgccgaggccgagtacctgctgcagcagctgggccttccgtatcgcgtgattagcctgtgcaccggcgacttgggcttctctgcccgtcagacctacgacgtcgaggtttggctgccgagctacaacgcctacaaggagatcagctcctgctccaactgcggtgacttccaggctcgccgcgccaacatcaagtatcgcgaccccgagaacttcaagggttcgcgctacctgcacactctcaacggttccggcttgccggccggccgcaccatggccgctattctggagaactaccagaacgccgacggcaccatcacgatccccgaggtcttgcgtccttacatgggcggtctcgagaagatcgagccggtcgcgtaaattggctgcataggggatatgcaagggcgctccttcgggggcgccctatttcgtgcgcaggtccataccatgccgtgcggacagctcaatagaaaacacacgaacaactgttctgtatacagccatctacctgctatgcttttgctaaataagagcgagagaaaggggacgcgatggagctgtttgatgatcgggtggttttgtttgagagcgacgagggcggggagtacctgattgtaacgtgtgagccgtctggcatgggtggcctggtggttcgacagacgagcgagggtccgttgacacaatggtgctttgaggagtcgccgcatgtggtcgagacctttgtgacgcacgagggacttgtggcgctggagcacttctatggagttgggacttccaaccaggtcgcgcgcatgctgagcatctcgtttgccgattatgattgtgcccagcgggtgagatcgctcctgagggaacttgacgctaagttcgacgtgatcgaaaagccaatcgatcgtacggggaacggcggtatatgcggagcagcatgacaaaactgcgttccacaaaaaagtttgagattgtgcttgactccaataagctaaagtggttttatatgtcttgcgctgcggcgttacctcagctggatagagggtctgactacgaatcagaacgtcataggttcgaatcctatacgccgcaccaattgaaatcgaaagcctccggcaacgggggcttttcttttatgccaccgctgcatggattcgaacctcggtcgaggcgcgggcgtaaagaaaacgcggagcgtttttagcccgcgggcgagcacgccggaaggcgggcgaagccggtgcggatccgcgcagcggatgcgcggaatcctatacgccgcaccaatcnnnnnnnncgaagccggtgcggatccgcgcagcggatgcgcggaatcctatacgccgcaccaactgaactttaaagcctccggtaacggaggcttttcttatatgtcgatatacttgagaagttgcttttgctgtgtttgaaagtatcgagtcgattgactgcgtcaaatgagtaaaaatcaaattcgataacttttttcgaaaaatgcttgacctttattcagtcgatgtgcataataatcaacaagtcgcggcgttacctcagctggatagagggtctgactacgaatcagaacgtcataggttcgaatcctatacgccgcaccatttgagattaaagctcccggcaacgggggcttttcttttacgtaagcactgcatggattcgaacctcggtcgaggcgcgggcgtcaagaaaacgcggagcgtttttagcgagcgggcgagcacgccggcaggcgggcgaagccggtgcggatccgcgcagcggatgcgcggaatcctatacgccgcaccaattgaacttgaagcctccggcaacgggggcttttcttttaggcggacgccgcatgggttcgagcctcggtcaaaggggactatttctcatcgactcgtgtaagatttcgagtatgcgcctcggtgagcccgtggcgcgctctttctttagacgaccgattagggtgatatttcgtggcagagcgtccgacatacaagctcaggtttcttgatcccaaaaagcgctttccggccatgcccgagcagcctgcgggacgctcgtatggcgtggtttggaagctctttggcgaggacccgcatgaatcatgctatgtcgtcgaattcgtcggcaaaagccatgtgtcgcttttgggctacgtgagcgtttcgggtgaggtctataaggtggaccgtcccgttaacgaagtatcgctgcccgacgatcccgacatgcagctgattcttgacgagtccgattccaacatcggtgagattgcagtcaggggtaccgatgggacgatgcgctcccgggcgcgagtcatcggctctcccgaaggcaccatgcgcgaacaatccgatcgcgagacgtggaattcgacgcgcagccttcgctacggcgagttcatggcctcgatgttcttgcgttacgtgatattcgccgattctgaaaacgctgtctcagacacggcaggcggcgacggcctcgacgagggtatgaaaaatgccgtcgacaaaatcaaacttgtaaaactccccgagccggttgaggtactgctgggttttgattccacgccgctgcccgatgcaatcgaaacgttgctctaccgcattgaccatacggataatccaagtggcattgagcgctatgccgccgcccttatgagcgaaattgacttgccccgcctgcgcaccatcgccgccaagtccgagatgagcctggctcgcatcgatcgctcaaagctgttctatctcaattttgatcgtagtctgctagaccaggacgagattgacacgctgctcgccatcgagtgtcgtctcaaccgcctctccggcatctttgagcgcatcggggccggattggcccctgcggcatcctcgccgagccttgagggctgcgcgctctttgatgcgtggcatatcgccaagacgaccaacgatgttccccgactgctcgatacggcctcgagcgataacccgtggggcaaaccgggtacggtggcttgccagccgggcggcgagtgggacgtgcgcacccgttttgcgcgaatcgttgaggcgctcaacgtggtcacgcggctcgactatacctatcgggcaaacgttgccgaggggattatgctcgttcggtttgggcagtctgtcgttgatgccatgccgcaacgtgaatacgacgctcaagatgacgcctggcgcgagctggacgaggacacgcgcgcgatctgggccgcggagcacgatgcgcgcgtggcactcacgcttgcggcagcgtgttttgccgcgggcacctgcatcacgcgctgctacgtgcagattgctgctcccgacggtgagcagggcgagcgtgttgtcgcaacgtatttctttgagcgcgcggcctatctggccgattgcgtgcctgtcgccaaggatcttgagagcatggacatggacgatatgccgtgcaagcgtgtgcttgaggcgtatgagtcaaccgctccggagacgattgagcctgcggaggttcatgctcgtccgcgtgatgaccatcgcacgctgccgccggcgctgcgcgatctgctgcttgccgatacggctgacgagttggaggtcatggaagaggacgacgacccatacgtggcccgtgttgttgaattgcgcgagcaggcaaaagtcgaccgtacaggtgcttttgaaggcttttcccgtcttgtcgaggagttggaggctaagtgcgctgtcgccgagcttttggcgacaggtccggttcaaacgcagttttgcgataaccagctggtacgcatggtgctaccggtgttggaagaagaccgctctgtgcgaatccttcgtgcgcccgatgcgctgtactttgcccagcacgagatctgcagcttttacgccgagcaagaggactttgaacgagcgctgcccgaggtgcgccatctttacgatctggcgcgctcgtccatgcaatcgcactttgcgctcatcaacgtgcttgcgcgtctggagcgctttgacgagattatcgaggtggcgcgccacggcctacgtattgccagcgatcgttctgcaattggctacctgttctatcgcttggcgtttgcctattggaattgcgatcagctcgacctggcgctggcttgttaccgtctggtgccgcgcggcgaggagtcgggcagcagcgcgctggaagaaatgcagggccttatgaatgagatgggcgtcagcgagcctccgacgttcgaggaggcggtcgagaccatccgcaaggctggactcgagctgccgccagtgtccgccgtgacgaatcagctggcagatgccgctgtgcaactggtcgacaacggcttctttttcctggcacgcggttgcatcttccaaatgtggcgcaccatgggcaacgacgagctcggctcccttaaccgttcgctggggtaggcgaagcttccaaggaggaaaggatgctaggcaattagaaaatttcctcttgcccatccttggctgtttggttactatagaacggctgttacggagagctgaccgagaggccgaaggtgctcgcctgctaagcgagtatgccccaaaagggcatctggggttcgaatccccagctctccgccagtacgaatttgaagaagggtcccatttggggcccttttttgtgcggagaaaggaggctggggattcggcttataggacaaaatgtgtgtccacgttgggggcatcggcgcaggtcgatgcctccttggtcgtagcgagatagactttgtcggcgccagcatcgcgagcattacggagcatttcaatgacgatatcctcgacatgctgaatgtcgtgctttgcctggcgcctctcggcctccgaaacgcggaggcggacataaccctcgccaaggttctcctcgacgcgaaggttgccctcccccgacatcgacgcgataaatgagatgagctcgttcgcgtcgctcatgttatttagcgatatcgacagcgcggctctcgcgaatcacgacgacgcgcacctgaccgggatactccatctcttcctcgatctgatgggcgatatcgtgagccaggaccgtggactgggcatcggagatcttgtccggctgaaccatgacgtggacctcgcgaccagcctgcatggcataggtacgctcgacgccatcatgggagttggcgatctcctcgagcttctcaagacgcttgatgtagttctcggcagactcgcgacgggcaccggggcgagaggcagagacagcatcggcggcctgtaccaggacatcgagcaccgtgttggggtcgacgtcggcatggtgagcctcgatagcgtggacgataacgggcttctcgccataacggcgggcaagctcggcgccgatgacggcatgcgggccctcgacgtcatggtcgattgccttgcccaggtcgtgcagcaggccggcgcgcttggcggtcacaacgtccaggccaagctcggaagccatcacgccgcacaggtcagagacttcgagggagtgctgaagcacgttctgaccaaacgaggtacggtagcgcagggcaccaagggtcttgacgatctcgggatgcaggtcgtggatgccggtatcgaaggcagcctgctcgccagcctcgcgcacgcgctgctgaaccaggtcggcagccttgtgatacatctcctcgatgcgggcggggtgaatgcggccgtcggcgatgaggttctcgagggcaacacgggcggtctcacgacggaccgggtcgaagctcgaaagaacgacagtctcgggcgtgtcgtcgatcacgaggttgacgccggaaacctgctcgaaggtccggatgttgcgaccctcgcgaccgatgatacggcccttgaggtcatcagagggaatgtgcacggaggtaacggtgacctcggctgtgtggtcggcagcgcagcgctgaatcgccagggacagaatctcctgggcggtcttgtggcactcggcgcgaacctgctgctcggactcgcgaatgatcgtggcagcctcgtgggtgacctcgccgcgaaccttatcgaggagctccttgtgggcgtcctcgcgggtaaggtcggcaatacgctcgagctcggaggtctgctttgcgcagagctcctcgagctcacgggagcgcttctcgacctgaccggcctggctggacagctgatgctcgcgcttgtcgagagcgtcgttgcggcgatcgagggattcctcgcgctgcatcacgcggttctcgagcgtacgaatctcgttcttacgctgcttgtcctcggcctcgaccgcctgcttgttcttgatgatttcctctttagcctcgagcagagcctcttttttgagggtctcggcctgacgcttagcatcaccgatcagggactcagcctgtgcgtgtgccgactgaatcttttcgtcggcctcgtgaagactaccctgcttggcggtgcgcatgaaggcaatggcggcgatggcacccaaaacgatgccaacgagcgctgcgatgataggcatgctcactcctttttatggattcgttacacaacaaagcgaaccatccttacgaacggctcgcgacatttgagtaatatgggcgcagcttatgcgggtcggatacagataaacatataaacaaactcatcacagatgagcacatatcacaaagcaaatgacagtgtttatcgtacgttgaaccacaacaactgtcaaataaatggccccagcacggcggctaaaacgcggtgaacggcaggaccacaaaacgcatatgcctaaaccgcacattcctcgcattcggcatcgaggcgtgccttaacggcatcggcggcgatgtgatacgagaagcccttgcccatcaaaaaccgaaccagtttttcgaatccgcgcgtctctggaacacgtcgcttggcgagcagggctgacgcacgcgccaaatcgtcttcgacggcaaaatattcctcgggataaccgggaatgtcatcgagcacgacatgacgacgcttgagctcggtctcgattttgcgctgtccccaaccacgccgtttgcgttcctcgataaagtacgagcaaaagcggttctcgtctaaaaagcgatactcggtggcgcgctcgacggcgaaatcaatcgctgtctggtgaaagccgtagcaagccagcttgtcacggacctcacccgtcgcatggtcgcggcgcgataacatctcggtcaccatggtaagtgcacatttacgctcgatgagctgcaccgcctcacgaaagttgtcccaatcacagggaagatctgggcggtttttgacatacaggcgcgcgacccgcacgggaatccaaatagaacgctcaaaaccgccctcaagctcacaatcgatatgtgcgcaaggctttttggacgcatacccgctcgagaacgaggaggccgccttcttatcgggaaagacgaccgtggcctcggtcaccgtatacgacatgagcgtaaccgctactcgtcgtcatcatcgagcatggcggaaccatcgatggcgtaaagctcgtcaaactcctcaggcgcaggctgatcggtcagctcgacctcggacggagcatcgtcatcaaactcaagtccgcaggcaaggcggaccttatgctcaatctcgtcggcgcaatcggggtgttcgcgcaggaaagccttggcggcctcgcgaccgttgccgagcttgtcctcgccataggcaaaccaggagcccatcttcttgcagatgccgcactcgacagccatgtccagaatcgagccttccttagagatgcccgtaccgtacatgatgtcgaactcagcagaacggaacggagctgccaccttgttcttaacgaccttggctcgcacgcggttaccgataacctcgtccttaagcttaatgctgtcgatacggcgaatgtcgatacgcaccgaagagaagaacttaagggcgcggccgcccgtcgtagtctcggggttgccgaacatgacgccaatcttctcacgcagttggttaatgaagatgcacgtcgtgttggacttggacagcgagccggcgagcttgcggagcgcctggctcatcaggcgagcctgaagaccgaccgtagtgtcgccgatctctccctcgatctcggcacgcggggtcagcgcggcgacggagtcgacgacgatggcatcgatggcgccggagcgcacgagcatgtcaacaatctcgagcgcctgctcgcccgtatcgggctgggaaatgagcacctcgtcgatatccacgccgatgcgcgcggcatacgtgggatcgagcgcgtgctcggcatcgataaatgcaacaacgccacccattgcctgggcctcggccaagatctcgagcgaaagcgtcgtcttaccggaggactcgggaccgtagatctcgacgattcggccgcgcggcacaccgccgatacccagagcggcatcgagtgccagagcgcccgtagggatggcctcgacctcgagctcggggccaccgtcgccgtacctcatgatggaaccctggccgaatttcttctcgatctcggccttggtggtggcgatcatctcatcgcgctctttacccgtcgtgcgagcatgaacggtacgtacgggacctgaattcttggccatgaatagccctcctcttaacaacctgcatcgataataaacgaacggctgttcgtggtcaaccgttcagataaatcatatgcagccgacctttccaaaacccaaccaaacgccgaccaaacactgaccaaatgcttgaccacaaaggaccaaaaatgaacaaggcaggcaaaaatacacccatgaacagcacaaacgctaaattcttctgaggtccctatctccacaattaaggggcccggaggccccttaaaacacgtctattccatagagttgagcacaagggcaatgcgtcccaatgcctccgcgaccgcatgggcacgaacacacgaacggtcgccctcatagtggcagcgcacagagtccacgaccggcacgcccccatcggcggagcgatacgcccagccaatatagaaagtgcccgccggatcttcctcagtgccaccgccggggccggcataacccgttgcgctcactgcaatatcgctctggtacagctccagcgaacccgccgccatctcgcgcgcggtctgatgcgacaccgcggtatagcggtcgagcgtctcctgctcaacaccaagaacgcgatgcttgatctcatcgcaataggtcaccgcaccgccacgcagcaccgccgaggcgcccgggatatcggcaatcgtcgaggcgatcatacccgccgtcagcgactcagccgtcgaaaccgtcacgccccgagcgctcgcgcgctcgacaatatcgcgcgccagctcctcgttatgtgcggaaatctgctcaaaagagtccgtcatacccaccaggacctagaccgaaaagacgatcttgcggcagttccagaagtactgggcgcccgagataacggtcaggacaacggcaacggcgtacaggaagcgcgacaccgagtagatgccgagcgtcagcgccaccgggccaaggtgcaagccggccatcgcaaagacgcacagataaccgcagatggagaccatcgtggtcgccgtcttgtacttgccgagcttatcggccgcaacgaccacaccagcagcactcgcgaccatgcgaagagcgctcaccagcagctcgcggaacaggataatgaacacggaccacacggtcaccgcgccaaaatccaagaacagcagcagggccgagaacaccagcagcttgtccgcgatggggtccaagaacttgccgaaatcggtgatctcgttgcgcgagcgcgccagatagccgtcgaccttatcggtgcacgacagaatcacgtacagaataaaagcggcggcggcgagcgggccgtcgaagatgctccaatccgtaccggcaacactcgtgtgagacagcgccgacacaatcatgaacaccgggataaagacgatgcgcacgcacgtcacgatattggcgggcgtccaaacactcgtcagttccttattgctctcgtttgccacgacgctctcctactccacaacatggccgataagctcatagcagaagctatcggtaaactcgacagtcagaatatcgcccacggacgcctcgctggcgtccaagtgcacagcgccatcggaatcgggcgcctggaaccaggcatggccgatcagctcggcgccgtcctcggtctcttcgataccgtcgacgatcacctgggcgcgctcgcccacatgtgcggcggtagcggcaaaaccgagcgactcggccagatccatggcctcctgggcgcgctcaagcttgacctcttcgtcgacctgaccctccatcttggcggccaggctgccttcctcacgcgagtaggcaaagacactcgtgtagtcgaagccgacggtgtccataaagtcgatgaggtcgcggaactcgtcgtcggtctcggtcgggaagccgaccatggccgtggaacggatcacgatgccggggatacgctcacgcagatcgcggaacagatcctcgagctcttgacgcgaaccggagcgacgcatggccttaaggatgcgcgcgtcacagtgctgcacggggatatcgatatagggcagcacctcgggcgtatcgcgaatcgtatcgataagctcgtcggtcatgccctcgggctgcagatagagcacgcggacccagacgttgtgcgggcgcacggcctcggcgacggcacgcagcagctgcgccagattgcgcggcgagccctcggtgacgtcctcgtcggcaaagtcggtaccccagatgcccgtgtcctggccaatcagcacaatctcgcgcacgccgccggcaaccaggtcgcgcacctcggagataatgctctcggcattgcgcgaatgatagcgaccgcgaatataggggatcatgcagaagctgcagaaacggttgcagccatcggaaatcttgacgtaggcaacggcgccctcgacggtacgcttgacctgcgggatataggctgcgatctcacgctcgacacccagcacgccatcgatgaccgccacgatgccgtcctcctcgtcggccttcacaaaggcagcgacctcgggcagctcgtcaggcaggtcgtcgccatagcgcgacggcacgcagccgcacataacgatggggcaagaacgaacgccgtcctgaacctcgttggcgagctcgagcgtggtctcgatgctctcggacgttgcggaggcgagaaacgagcatgtattgacgatggcgatatcggcatcctgcgggtcgaatgcctcttcgtagcccgcggcggtcaaaagagaacgcatgcggtcggtgtcaacctcgttcttagcgcacccgagggtgatgtagagcacggagcccaacggtgtatccatgttggagagcggtcctttcgaatgatattagcggtagttggtgaactgtagcggctggccgtagtcctggtcgcgcaagaactggatcacggtctgcaacgcgtccttcgaagcagaggaaacacgcagcttgtcggcctcgatggtcaccttgaccttaagcttttggtccttgatgtccttattgatcttcttggcggtcgcctggtcgataccctcgacgacatggccgagcacgcgcacggtgccgcccgacgccgcctgtggagcatcccacgagacagccttgaggtcgatgccgcgcttgatgagcttggagctcagcacgtcgataatctgcttggagacaaagtcggccggggcgttgatcgtaaagagcttgtcgcccttcgaaagctcgatcgtggcgccggaatccttaaggtcatagcgctgggaaatctcgcgcgtggtctgctggaaggcgttgtcgacctcttgcatgttgacctcggacacgacgtcgaagctggaatctttagccatgatgtttcctttcgcgtacgagcggcttagtagctatcgtacgaatagtcggtagaatcggtgggcgtctgaccgtcagttgcggtatcggcgccatccgcggactgggcaccggtgcggtcggtggtatcggtaccatcggtggtgtcggtgccatcagaactttcaccattctcggaatcagtcgtctccttcttaggaacggtgatcgtcacacgagccacgcccgaggtcttggtatcgtaacggaccttttcaccgttcttggtaacggtaacatcggaaggcttggacgtggtgatctcgatcgaggactcgggcgtgtactcctgctcaaaggggccagtcgcctgagcgccatagaccgacttgccgtcgaccttgacctcaatccacgcggtctttcccttggcaacggaaactttgaccttcgtgacctcgttctcttccttcttggccgtcgtcttggtagcgtccgaatcagtcgacgcatccgtcgcttcatcggtgtcttcgtcctcgtcgaccgtttcggacttcttagaagacttcttggtcgtcgtcttggtagcagcgggcgtctcgggcgtggtctcgggcgtcgaagatgcgcagccgcgcagaagcaccacgatgagcacaatcagcagcaacaccacggcaccgatgccggcgtagacgatacgcggatcgagcccgttgttttgaggagtacgggatccgccgcgtccacgaccggaactgctgcggccgcttccctgaggcatacggccgcgattgctatcggaacggccgcgatagccgccctggccctgaaggctgcgctgacccgagcggagcgcaagctcaccgcggccttgatagccacgctggcccgaacgcgaagccgaagagcgctggccatacggctgtgattgagagcgaagacgcggcgttacctgcgtggtatcggcatccgcatagccaccgcgagagcgtcccgtagaggcaccacggtaaccgcgatcggaatagccgccgtcgccgtagccggcacgagggtcacgcgccacgccgcgggcagcgggaagcgcacggtcctcaggcatcggcgtactgcggaaccggtcacgctgtgagcgaatctcctcgcccgaacccgtctcggtaatataaccggcctgctgaggacgctgtccatagcgggtcgaacgaccgccctgaaccatcaggaagcgcccgttatcgaccgaggagcgcgaattgacgtagccagcggcgtcctgaaaacgaccgccctgctgagacgtctcgcgttcgtatgccatcaggtcgtcaaagtaggcattgacgacctcgcgcggattgaggcccaaaaagcgagcatagctcgaaatcatgccctgcgcatagccgcgcggcggcatcgaagcaaagttaccggtctcgaaaaactcgatgatctgcggcctgattttgatggtgttggcgacctgctgaatggaaaggcccattcggcgacgctgctcgagcagcatgtcaccaaagcgtgcagccatcagaatcctccaaactcacgatcttcacgtgccatctcggcgtcgacagactccagcgcggcaagcccctcctcgtccaacaggacctcgcgcggcttggaaccgtcgggcgggccgacgacacccttttcttccagcatgtccataatacgcccggcgcgcgcatagccaaccttaaggcggcgttgcaggccagatgtggagcccagctgcgattccaccacaatatgggcggcttcccaaatgagcggatcatcgtcttgcggctcggcaactccggtgcggacaatgccgccacccgccatggacatggaagcgggcgccacagccgacaggatctcctcatggtagtcgggctcgctttgcgacttgacgaactcgacaatctcgttgatttcatcgtccgagacaaagcagccctgaatacgacgaggcttgccccagtcgaccttggagaacagcatgtcgcccaaaccggtgagcttttcggcacccatctggtcgatgatgacgcgcgagtcgatgcccgtggcgacgttaaaggcgatgcggttggtgatgttggccttaatgaggcccgtcaccacgttggagctcgggcgctgcgtggccacgataaggtggataccggcggcacggcccagctgagcaatacgcacgatcgaggcctcgacatccttaccggcgaccatcatcaggtccgagagctcgtcgatgataatgaccagatagggcatcttttgcggcgggttatcgtaatgttcaaactcgccggcggcctgcttttcgttataggtcgagatcttacgtacattgagacgctcgaagaccttcaggcgacgctccatctcggacacggcccattgcagagcgctcgcggcctgcttgggctcggtcactacaggcacgtaaagatgcggcagaccgttatagcccgcaagctcgacgcgcttggggtcgaccatgatcaggcgaacgtcctcgggaagcgcgcgcatgagcagggtcgtgatgatggagttgatcatcaccgacttaccagaaccggtcgtgccggcgatcagcaggtggggcatcttggcgaggtcggcgacgaccggcgtaccctcggcatcgcgaccgatggccagctcgagcggaccgcccttcacatagggcagcacgtcgcccaggttgacgttctggcgcttgcgattggggatctcgatacccacgagcgacgtgccggggatcggggcaaagatacgaaccgactgagctgcgagcgaaagcgcgatatcgtcctcgaggctcgaaatcttgctcacgcgctcgccctcgccaggttgcagcttaaaggtcgtcaccgtggggccggcgatccagccgaccacgcgggcgctgcggccaaactcaagcagggtcgactgcagcgactcggcagtttgctccagctccttgtccgaagacgcagcggaagccgactgcgggttggcatgcagaatctcaagtggcggaagtttgaggccgtcctcttcttcgccctcgttatctgcggcgccgccgtccgttcccccatcgctggccgcagccgattcgacagcactcaaggcaggcgcatcggcaaccttgggatgcttcaagaagtcggggatctgaggtgctgccgagacaggattcacggcaaacggcggctcggactcgtcgatcttatcggggtcgtcttccatcgaaagctgaccggttacctggtcgcgctttgcatggcgacgcggcagcaaagttgtctttgcggtctcaatcggagcctcgtcgtcctcgtcatcaccctcggtgagctcaatctcgctctcggaccaagacgggtcgggctcactcgtattgagtttgggcgcagccttgcccttcttggcatggcggcgcggcaacagcgttgtcttggcccgctcggcctccacggcctcagacacgtcgacaaacggatcttcgtccacgtcctcatcgtccagaatcggatcgacttcgctacccataaccgtagtcacggccgcatcggggcccttttgacgaagaatgctcaggtgcggacgggcaacgccgggcaccgacagggcttcgtcgtcaccccacgggctggcgttgacatcggcacggcggcgctcggcaaaatcggccgcacggtcgcgagcagagcgcaaaacgccgccaaccgaaaagccgatgatgaccaagcccacgacgacaaagcccaacaggactaccatcgcgataggcttacccagggcattctgcagcgcactcgcaataaacgcaccgatgtagccacccgaggcggacaaattttgcggcgtgaacataaggtcacaagagacactcgtacccggcaccatcagcgaaagaatggagacgacggcgataaagaccacggcgccgcccgcaacagagcgtacgttgagcggcgagtcctcgcctaaaaagagcgtggcggcaaacagcaaaatgacgatcggcagcacgtaggcgcccagaccaaagcccaggtggtagaaaccggcaaccgcagccgtaacgggtgcggtcgccggcgaaatcacggcaatgaaggacgcaatcgccaaaacggcgatgaccacgccggcgatatcacggttggccgagggctcaaccaaaggctcaaaatcgtcgaagtccgcctcgtggcccttattggcacgcagatgggaaccggcacccttagcagatgccggttggttattggccttattgcttttggcgttttgtgcagatccacgcgccaaactaaacctccatgacgaccgggatgatcatcggacgggtgcgcgtacggctccagataaagttagagagcgaatcgcgcacggccttacgaatagcatcggaaccgctgctcgtaaagctgaacttgcccttctcgatcgtcttcatgatggacgcggaggcatcctcagagaactggtcgtcgatggcaaacgagacgccgcggcccgagaactcgatggcctcgatcttcttgtgtttaagcgagacgatggcaacagcggtaaccataccgtcattggcgagcttctgacgatcgcgcaagacgatggggtcggtatcgccgatacgaaggccgtcgacgtagacgacgccggactcgacgggcgtaccgcgcttgacgataccgccgcgcatctcgagcgtgtcgccgttatcgaggataaagatatgatcgtccttgatgcccatcttgcgggcaagctgggcatgggcgcgcagatgcacggcctcaccgtgaaccggcataaagtaagtgggcttggccatggccatcaggagcttgagctcctcctggctaccgtggcccgagacgtggacaagagcgcggttcttatcccacacgtcgcagccgagcttggccaggctgttgacgacctgctggacggctttctcgttgccgggaacgggagttgccgagaggatgacggtatcgccctcgtggatagagagcgtcttgtgctcgccattggccatgcgggacagggccgacagcggctcgccctgcgaaccggtgcacatgacgacgatcttgtcgtcgggcaggttatcgatatcgaaggcatcgatgatatcggcatcgtcgatgttgaggtagcccagctcgcgcgcgacgcgggtgttggtgagcatggaacgaccggtcacaacgaccttacggccgcacttgcgggcggcatcgcagatctgctgcaaacgatggatatggctcgagaacgaagcgacgaacacgcgacccggggcgttcttgatggcatgcagcaggttgggaccaacctcggcctcggacttggtaaagccgggaaccgtggcattggtggagtcggacagcaacaggtcgatgccctgcttggcaaagcggctgatagcggcatagtcgggcgtgacgccgtcgatgggcgtctggtcgagcttaaagtcgccggtgtgcataacggtgccctgattggtgcggatgaacacgcccagagcgccggggatggagtgcgtcatcgagaagaagtcgagcgagatgccgccgaggttgacatggctgccgcccttgacctcgcggaacttgggtgcgcggatgcggaactcagaaagcttaccctcgataaagccaagcgtcagcttgctcgaaaagatgggcaccttgttgttgaggtcctgcagcagatacggaagcgaaccggtgtggtcctcgtggccgtgggtaacgacgataccgcggagcttttcctcgttctccaaaacataggtgtagtcgggaagcaccaggtcgataccgggctgggagtcatccgggaacatgaggccggcgtcgacgagcaccatgtcgtcgccgcactcgaagaccgtcatgttcttgccgatgccgtcaaggccaccgagcggaatgatcttcaagggagatgattttttagctgccataggttagtgtggtttcctttcttcgaaacgggtctggaacaaccggcggggcgcttctggcaaaccgaccgccgggaacgtacaaacatgcatcatagagtcgacgcagtaacctcagtatgatacccatttgcccaccaacagaccacccatgcatcaaagccccatctgaactggtccatcccgccggtttcccgtggggcgggcactgatgaagtttcctgctctacagtcctgctcacgacggaggccacattaagtggcctcctgttcgtgcggaactcgcgataaacttcatcagtgcccgccccacgggaaacctgccaaatagagacaggtttattttggtcggttttatctgggaagatgctgctgcggctatctacagatctgtaatctgactactgaatagactgtctaactaaatagcgagcggcattaaccagcccttttgcttgcgcccgggagggacgcatatgaagtttatcgcgagttccgcacgcaaaggaaagcacttaatatgctctccgtgcgagcaggactgtagagcaggaaactttacctgcggccccgccgagaatagcaaaagggcgacccccttaggagtcgcccttgttgagctgcttatgtacggctgttactcggcgtcgtggtgacggcgaggcttgcggcctccgttgtcaccgggacggcgcggacggtcgctgcgctcggagcgctcgcgacgcggacgctcacggcgctggaagtgctcgccgtcgccctcagaagcaccctcggcgcgagccggggcctcgggcttatccagacgatcaagcgagatcttgccacgatcgtcgacctcgatgacgacgaccttgacctcgtcgcccacgttgaggacgtcctcgaccttctccacgcggcccttggcgacgcgagagatgtgcagcaggccgtccttaccgggcagcaggttgacgaaggcgccgaagggctggatggagaccacgcgaccggtgtactcctcgcccggctcgggaaccttgatgatgagcttgatgcgctcgacggcctggtccacggactcgccggtgccgccgacaaagacggtgccgtcctcctggatgtcgaccgaagcgccggtctcgtcctgaataccgcggatgaccttaccgccggaaccgatgacgtcgcggatcttgtcggtcgggacctggatggagacgatgcgcggagcggtgctgcgtgtggtgtggcgcggctcggggatcacatcgagcatcttctgcaggatgaaggcgcgaccctccttggcctgctgcagggcgcgggccaggatgtcgaaggtgaggccggtggccttgttgtccatctgcagggcggtgatgccctcggtggtgccggtgaccttaaagtccatgtcgcccaggaagtcctcgagaccctggatgtcggacaggaccacggtcttaccctcctcctggatcaggcccatggcgataccggagaccgggcgcttaatgggcacgccgccgtccataagggcgagcgtggagccgcaggtcgaagccatcgaagaggagccgttggactccatgacctcggagacgacgcggatggcgtaggggaactcgttctcgtcgggaagcaccggaagcagagcgcgctctgccagattgccgtgaccgatctcgcgacgcttggggctgcccatgcggccagtctcgccggtgcagaacggcgggaagttgtagtggtgcatgtagcgcttgccctcggtgggctcgatggtatccagacgctggccctcgttgagcatgccgagcgacaggacggagagcacctgggtctggccgcgctggaacagaccggagccgtgaacgagcggcaggtagttgtccttcaccatgatgggacggatctcgtcggcggcacggccgtcgacgcgctcgccggtctcgacgaccatagtacgcatggccttcttctcgagcttcttgagcgccacggggatctcgcgctcccaagcagcctgctcctcctcggtgaactcggcgcggatggactccttcagagcctcgaccttgccgatacgggagagcttgtcggcgtcgcgcaaggcggctgccatctcgtcgtagtgggcgaagatgcgctcctggacctcctcgacgggctggtcgagcgggtactccttcttgacgatggggccgttgacctgctcccactcggcgacgaactcatcctgagcctggcagaaggcagcaagggcctcctggccaaacttcatggcggcgagcatgtcgtcctcagagatctcctcggcgccggcctcgaccatcgagatgaagtcggcggagccgcccagctccaagtccagatcggagttctcgcgctcctcgtaggtggggttgacgataaactcgccggtctccacgttacggccgatgcgcacgcaggcaagcgggccctcgaagggcacgccgccgagcgtcatggccagggaagcacccatgacgttgatgacgtcaaaggggttgacctggtcggcgacaagcgaggtagcgacgatgtgcacctcgttgcggaagccgtccgggaagctcgggcgaatcggacggtcgatcatgcgcgcggtgagcgtggccttctcgctgggacggccctcacgcttgaggtagccacccgggatgcggccggcagcgtacatcttctcgttgaagtcgacggtcagcgggaagaagtcatagttcttgcgctccttggagacgaccacggtatcgagcatcgtggtgtcgccctgcttgaccaggcaggcgccggtggcctgcttggcaagctcgcccgactcaaaggtgtaggtcttgccgtacagctcaaaggtcttggatacgagtgtcattgttctcctttaccccacaggccccttgcctgcgggcttctcatgtgacgcggaccccctgcccccgccacgcttcagagcgtgattgttcgcgcccttacacaaaaagagcgccccgctgcgcaggacgctcttagcatgtacaaatcctactggatgttgtcgcggatgcccagagccttgatgagctcacggtactcgacgatgtcgttcttcttgatgtaggagagaagacgacgacgacgaccgacgagcatgagcagaccacgacgggtgtggaagtccttctgatgggacttcatgtgctcggtcagctccttgatgcgctcggacaggatggcgacctgaaccttggggttgccggtgtcgaccggggtgttaccgaactgggcagtcagctccgccttgcgctctttggaaacagtcattgtttcacctttctttttgcgtcgccatcgggcgactcgattcgcctcggactgggaagccgccggtggagcgagcaaccaaggtcgaggtaccaacaggtcggtatgttaccacaagcagcccgcgcctgcgcatcatcaccgacccaacatgaattccatcgcacggaggcgctgatcggtgtgcgtcgcagcccaaacatgcgaaagccccagcaaaaaggctgcggtatgcgggtcgattcgctcggccaaaagcgcatcgaaggtcatggacatgagggcgcgcagccatgcggcctcaccggtcgacaccagttcggcacctggaacgctcgacgcgcacgacccgcacatgaggccgcccgcctggggcgaaaaatacgacagcatggggtctccgcacagcacgcaggccgaaaaatcgggtcgatagccaacgtgcgacagcagcttaaagacatatgccgccacaagtagatccatatgcgccgtgtcgagcccgctgcccaccagggcaagcgctcgctgcgtgatggcaaaggtaaacgggtcctcggcgtcctcgaacgagcacacgcgcgcgacctcggcgatcgcgcttgcggcgcaggtcgtctcgtaatcgggcgcaacgccgagcggcgcctccataagctcggcctgggaaaccacgtcgagtgaccgtccatgtgcgagcagcatatctaccgtacagaacagctcgcagcgcgcagccaggcgtccgccgggtttgcgggcgccctttgccacggcacgaacctgccgcccccgctcgtcaagcatcgtcaagatcaggtcggtctctttgagcttagtcttatcgagcacgagcactttcgtgcgatatgtccgggagcctgccatgcgcgccgcgcgtccttagtcctcggcgttatagccaaagcggcgaatctggnnnnnnnnnntcttctaagctgaatctgggcctcgtcgtcacgccagccggccttgaccttcacgtccaactccaaaaagacctgcgtgccaaaaatgcgctcaagatcgcgacgggcgtcgataccgatatgcttgatcatctcgccgcccttgccgatgatgatgcccttttggccctcgcgctcgacgtaaatggtggcgtgcacgcgcagcaccttcttggtctgctcgagcgcatcgcagatcacgccaacggagtgcgggatctcatcacgggtgcggcgcaagaccttctcgcgcacaaactcggcaacgagcgtctcatcggaagcgtcggtacccatgtcctcggggaaccaacgcgggccctcgggcaaaaagtgggcaacggtctcgatgaaggcgtcgacgttgaagttcttcaccgacgaggtcacgatctcgtcgtcgtattccataagctcatgcgctgccttaagctgctccatgacctgcgcggggtcggcctcatcggccttggtgagcaccaggaccttcttagaacgggcgctcttgacgcgctcggcaacccaggcgtctcccctgccgatcggtttggtggcatcaatcaaaaacgcgacgacatcgacatcgttcagctcgaacagcgcgctcttgttgagctcggaccccaggccgtccttgggcttgtgaatacccggggtatcgacaaagaccagctggtagccgggacggttgacgacggcgcgcatgcggcggcgggtcgtctgggccacaggcgaggtgatggcgacctttttgccatagcaggcgttgagcagcgtggacttgccggcgttggggcggccgaccagggccacgaagccgctgcggaaaccgggctcaacgtctccaaagcccgcgaggctgtcgtcctcgtcgcacagggcgtcgagctcctcgtcgctcatgccctcaaacgggtcgaactcctcgatctcctcgtatgcctcggccgcttcggcatccaccgcatccagggactcgtcatccagagtttcatcgataggctgcatattgtcggacatggaaatccctttctaaataaagtcgagcgcgtgggcaaataccagcaatcccacaatcgcggcggtgatggaaagcacgtatacggaggcggcggcgatatccttcgcacgctttgccagcggatgaagttcctgggtcgccaggtcgacgatcgcctccatagcggtattgcacagctcgccgtgaatcaccaagccacagcagatgataactgtggcccactcggcaatgtcgaggccgacaatgcagccggcaacgacggtgcaaacgcccgccgcgagcataaccttaatgttgcgctcggtcttgacggcggtgacgaagccctccatggcgtaggagaacgactttaagaaggacggatggtccttgttcgatccgggaatcatagacggctcctagtcgtgggcgtggttggtgatggggccgacgtggaccagcttggggtcctcgccgcgctcgagcgccagatcgcgcaggatgacgtcctcacgggcctccatgacctcggcctcgtcgtcctcaatatggtcatatcccagcaggtgcagcatgccatgcacgagcatcaggcggcactcgtcggcagggctattgccaaagccgggggcctgacgggcaatgacctgcggggccaggatgatatcgccgagctcgagcgtcttgtctgcgggaatatcctcatcaaaggccgagtcgcattcaaacgagaggacatcggtggtacggtcgataccgcgccactcgtggttgagctcgtgcatctcgtcctcgtcgacatacgaaagggaaatctcaacttcacgctcaacgccctcggcggtaagcacgacctcgcagatgtgctctacctcctgcgcgtcgagcagcgtatcgagctcggcatcgttgctgatcaatacactcaacgggactcctttcgatcgtgcacgcgcttctcgcgtacatcatcataagcatcgtatgcctcaacgatacgccccaccaaggcatggcgcaccacgtcggcacgctcgaggtgagaaaatgcgacatcgtcgacacggcctaaaatccgctcaacgtcggcaagaccgccgcgacgacccaccaggtcgcgctgactcaggtcgccggtaatcacaaacttggagttaaaacccaggcgcgtcaggaacatcttcatctgctcgggcgtggtattttgcgcctcgtcgagcaccacgaaggcatcgctcagcgtgcggccgcgcatgtaggcaagcggggcgatctcgatcacgccacgctccataagctcatcggtgcgctcgcgatccatcatgtcaaaaagggcgtcgtagagcggacgcatgtaaggatcgatcttttcctcgagggtaccgggcaaaaagcccaggttctcccccgcctcgacaaccggacgcgtcaagatcagacggcccacctcgtgacgcttgagcgcggcaacggcgagcgccatggccagataggtcttaccggtaccggcaggacccaggccaaacgtgatggtatgcgagcggatggcatccacatagcgcttttgaccgagcgtcttggggcgaatgacacggccgcgatacgaaagcagcacatcatcgcgaagcgatgtagcctcgtgctcaccgtcgcgcaatacggccaggcagcgagagacatcgtcggcagaaagcgtgcgcccggaagcagcctcacgaaaggcatgttcgaaaaaacgcgcgaccagttcgacctcgtccgggtcaccgctcacggcgatgctgtcgccacgggcgaccacgtgggcgcgaactgagctctccagcgcacgaaggacgccgtcgccggcacccaaaacgcgcgaggggtcaataccctcgggaacggtaagtctaatcttcgaggcttccatgaacctccctgcgtgcatggaccaagccggaatcatcgactccgatgatagcaacatcgagcaggcacggggctgtaagtccacaggtatcgtcaagacgggcatgatggaacgagccgagcgtcaggttgtcaccatactcgagcacggcacgctcgaccgtgcccacgcgacgacgagcgtcggcaatagcgagctcctgtgcggcggcccgcatacggcggctgcgctcggccataacctcgggtggcacctggtcgggcatgtcggcagcaagggtaccgggacgcttgctgtagcggaacacgtgcatacgcgagaaacccacacggcggcacagcgccagcgactcctcgaactcctcgtccgtctcaccaggaaaaccgacgatgacatcgcacgaaagggacgcctggggcaagttggcgcgaatcatacgcaccgtgtcctcaaaggcctcggcgctatagggacggcccatgcgatgcagggtcgccgtgcagccggactgcacgggcaggtgcaaaaacggggcgatacgctgcgggtagcgcgccataaccttaagcaggcgctcggagatatccatgggctcgaccgaggaaatgcgcacatgcggaatagacgtgcgctccatgatggcctcgagcagctcatcgatttcgacgtgctcgtcggtcgcgctcttgccatcgtaggcacccaggttcacaccggtcagcaccacctcgggcacgccggcctcctgggcctcgcgaacttgctcgagcacggactcgacgggcacggagcgctcggggccgcgcgccttccacacaatgcaataggtgcagcgatggttgcagccatcctgaatcttcacgcccaggcgagagcgaccgagcgtatcgaccacctcgccatcgctgcaggcgggaacgctatcggactcaacacccagcacctcgcaaacacgttcggcgacatctatcttggacggctcggcaatcacgcgatccgaaagctccgacagctcctcgggatgcaaattgaccacgcatccggtcacgaccacatagggctcgtttggatgggccagcgcatgacggacggccttacgggtcttagcctcggcctcgcccgtaacggcacaagtgttaatgacgatcagatcggcatcctggggctccacaatagcaaagcccaaacgcataagatcggcagtgatacggtcagactcaacccggttgacacggcagccgaggttgacgacggaaatatggggtgcgagcacgcgggctccttaatcgaggatatcgtcgagggcactcttgatacggtcggtcaccgacttcttaccagaagcgacgtcatcgcccatctcatcggcaaaagcacggagcagctcgcgctgcttattggaaagattggtgggaacgaccacgcgcagttgcacgatcaggcggccacgcgaaccgccaccgccaatgcgcggcatgccgtaattattgacgctcacggtgtcgccgtactgggcgccggcgggaaccgtcaccttaacgacctcgtcgggcataatgccctcgacctcaatctcgcagccgagcgcagcctgcgcaatcgagatatcgctcaccaggtacaggtcatcaccgttgcgcttaaagcgctcatggtcggcgacgcgcacgttgacaatcaggtcgcccgaaggctcgccgcgaaggccggcctcgccaaagccgctcacacgaagctggcgaccggtcgaaacgccggcgggaatatcgatgtcgatcttttcgtgcgaaggcgtgcggccttgaccgtcgcaggtctcgcagggatgatcgataaccgtgccctcgccatggcagtcggggcaaggcgaggaagactgaacctggcccaaaaacgatcgctgaaccgtcgtgacgtagcccgtaccgtggcagcggccgcactgcttttcctgtgcgccctctgccctaccggtgccattgcagtcctcgcaaggagcaaggcggtcatagctgattgtctttttgcagccgagcgccgcctcctcgagcgtcaccgaaagcgagatggccatatcacgtccgcgacgacgctcacgacggctgcgggcgccaccgccggcaccgccgccaaagaacgacgagaacaagtcgtccatgcccatgccaccaaagatatcgttgatatcgacgtagccggagccaccggggccgtcggcagtgccgtaacggtcgtagttagcacgcttctgctcatcggaaagaacggaatatgcctcgttgagctctttgaacttagcctcggcctcggggtcgtccgaaacgtccgggtgtacggtacgggccttctttagaaacgcgcgcttaatcgtccgcgcgtcggcatccttgtcgacgccaagcacctcgtagtaatccctattttccgacacgaccgaatccttccgactttcattattgtcacagtgcgtcctatacccaagctgggccggccgcaaacagagggtttgatgttattgcattgcgtagggcgaaagcatggcacgttgcgagcagctcgcaaaccaaaccgacacgagcgcaaacataaatccgttggcaaaaccgttggcaaactgcatcgcgccgcgcttccaccacagcaggctgcggtgcagcacgccgtccgagagcaccatgaacaggcccatggcaaacggaataaagcacatcacggcaaaggccgagaacacgcccgagatggccgatagcaccaaaaacggcgccacgatgcccatcaggtaaaaaccggtacgggccttgccttccaggcgctcggcctcaacatgggcccgaccgaccagatcaccgccagaggcgccgttggtgccggcgtgacccatgccgccaatacggacctcgtcgccatcgtgcgtgccggcgggaaactcaatcgtctgctcggaggtcacacgggttcgcccgctgccgccgcaatcgggacaggggtcggcgacgaccttaccggagccaccgcactcagggcagacagactggaacgtgccggcaccaaacagaaaggacaggtcgacatcgatgtggccgcgaccgccgcagctcggacaggtatgtgcatgctcggacgaaacagagcccgaaccgccgcagtgaccacaggtatcgaagcgcgtatagcggacggtcttgcgggcaccgcccttggcctccttggcgtcgagcttaatatcgacgacgacgttggcgccgttctcgggattataggcagcctgcccgcgacgcggctgaccccaggcgccaccaaagggaaagccgccctcaaagggattgccgtagcccgcgctgccggcgtaaccgccgccatagggcgaagccgtgggagcgccggcaaagggattgcccgagcgcatggcgtcgtagcgcgcacgcttctgctcgtccgaaagcacagcataggcctcggaaacctctttgaacttttcctcggcatccggttctttgttgacgtccggatggagcttgcgggccttttgctggaaggctttctgtatatcacgcgaggtggcgtccttggagacacccaaaatctcgtagtaatctttttcgttcatcgtcgccatgcgcggcaacctcctgctcacagcagcgtatatattgcggtaattctacccgagcggcctaggctagaccccaaaacagctcgaacagcacatttccatcgagccagcccaagtgagtgggcgctaaacgagcacggacgcgacctgcgataacgtctttcgaggtgacgcgccccgcatgtccttcaatatgatcgggcacccaggtggcaaggcccaactcgaccgcacggtcgcaggccgccgccaactcatctgcagcgatcacgcttgccgagcgaaccaacagatcgggcccaatgccacgcgtcatgcgacaggcaagcatcaaatcctcggccgccgcctcgcgctgcgacagatactcggcatcaaacgtcgtcgcggcatcgtcgcgttgcaccaagcgcacgcgatacgcatcgccgcgagcaagcacgtcgggaaacagcccggccaagcgatcgaaatcctcggcgtcgagcataccggcggcagagcggcccaaacccagatagccctgtccggtccaataggcaatgttgtgggcgcactcatggccgtcgagcgcgtagcttgccacctcatacgggtgatagccggccgcactcaggcgctcacgcgccgcatccatgcatgcagcctgaaaatcctcgtcgggctcgagcgactcgtcgcgacacgccatgcgatagagcggcgtgccctcctcgagcgtgagcgggtacaccgacacatgatgcggcgccgccgccaacacgccatcgagtgtgcgctgccagcttaggtcggtctgcccgggaaggccgcacatcaggtcgcacgacacgacaagcccagcgtccttgaccgtcgtgatggcagcgagcgcccgatcggcatcgtgaatgcggccgatggcggtaagttcggcgttatcgagcgtttgcacgcccagagagacgcgcgtgacacccaccccggcaagcgcagtggcaaaggcgcaggctgttgttgagctcggtcatggtaccaaaggtcgagcgcacgcccgcagtcctgcgcaagacgaaggccacattaagtggccttctttgcgtgcggaactcattttgaggaagcacccgccctgccggggctcccgggttctacaacgactcggccgttcgggtcaggcgggctgaatggaatttggtgaatgagggtgccgttggcgccctcattttttgtgcgggtggcaaaggggctgtccctttggtcacatcgcgcatcaagatttccaaaaagttaacctttgttgaacttaatagttagataaactaaactattttccaaaagtgtgctcgagcaaacttgtttactcgggtgctgaggcaccgtgccgcgtccaatgcggcaaaagggagaagcaacatgaagaagtcgacgttcaataccctgcttgtcggtggcggttttctgcttggcacggccggcatcaagctgctcaccagcgctccggtcaagaatgcctgcgtgcagggcatcgcgtgcggtatgcgcgtcaagaactgctaccaggacatggtcgagcaggccaaggctaatgtcgacgacatggttgccgaggcggcctacatcacccagagcgaggccgctgctgacgaggcagccgagtaacgctcccaggcacaaactatgagattctcgattattagcgagatccccggcaggacccgtcttcaattggcgggtcctgtgccagagagcgatctcgacgcacttcttaagcttggcggcgacatcgatggcgtgcacaaggtgcgcgtgtatggccgcattggccagatggcgttggagtacgacgagccgcgccgcgcaagcgtgctcgacgccctaggcgcactcgatgctcaagctatcgccgatgccaagtcgggctacgtgatgcaactcgagccgcgcaagcacaaactcgttatggacctggcgacactcgtcggtgcccattacgcacgtcgctggttcttgcccacgcccctgcgcgcggtgtttgtcgtggccggttacatggcatttttgcgcgccgccctccgtgagctggcgcagccgcgcctgaccgttcccgtgctcgacgcttcggccattggcatttcgttcgtcaagcgtgatgtcgacaccgcgggccagacgatgtttctgctcaacgtgggcgagctgctcgaggactacacccgcgccatgagcgaaaacgagctcatcaactcgctgctcgatgtgcccgacaaggcgcaaaaggtcgtcggcgacaccgaggtaagcgttgccgcgaccgagcttgagcccggcgacttggtcgccgtgcgaactggcatgtccatttgcatcgacggtgttgtcgagcaggggagcgctatggtcaaccaggcgaccctgaccggcgagccgcttgccgtcgagcgcagcgcaggcgacgacgtgttcgccggcactgtcgtggaagacggcagcatcttggtgcgcgtgcgcgccaacacggcgcagaccaaactgcgctcgatcgtctcactcgtgcagacggccgactcgctcaagtccgagggccagtcgcacatggaagacctcgccaacaagatcgtcccgtggaacttcctgcttgcgggcttggttgcgcttgccacccgcagcctcatcaagacctcagcggcactgatggtcgactactcgtgcgcactcaagctcacgggctccgtcgccgtcatgactgctatgagcgatgctgccaagatgggcgtgatggtcaagggcgcgaagtactttgagtcgtttgccaaggccgacaccattgtgtttgataagaccggcacgctcaccgaggcgcagccgcgtcttgtctgcgtactcaccaccgatggctggagtgaggacgaggtcctgcgcctttccgcttgcttggaggagcattttccgcatccggtggcgcgcgccgtggtcaatgcggcacgcgagcgcgggctcgagcaccgcgagcgccatgccgccgtcgagtacatcgtggcgcacggcatcgcttcgtccatcgaggggcgtcgcgccatcatcggttccgcgcactttgtatttgaggacgagagcgcgcagctcgattccgacatcaaggaacgcattgagtcccagatgcagggtctgtcgccgctgtatctggcggtcgacggcaccgttgtgggcgtgctcggtatcgaggacccgcttaagcccggggtccgcgaggccatcgccgacttgcacgcgttgggcgttaagcacgtggtcatgctcacgggcgactcggagcgcacggccgagcgcattgcgcgcgaggcgggtgtcgacgagtttaaggccgaactgctgcccgaggacaagtacgcctatgttgagcgcattaagagcgaggggcgccacgttgccatggtgggcgacggcgtcaacgattcgccggcgctgggcctggccgatgtgggtctggccatgggcggcggaagcgacatcgccaaggaggtcgccgatatcatcctgaccgatacggatctggctgcaatcgtgcgcctgcgccgcatgagccaggggcttatcgaccgtctgacgagttcgtattccaaggtgatgctcaccaactcggcgctgttggcattgggcattaccggcatgatcactccgcagacgtcgtcactgctgcacaacggctcgacgattgcctacagcctgagcaacgcgaaggcttacctgcgttagcagacgtgttcgtccacgttatctggcctgcgcccagacggcatcggtgtcgtccgggcgcaggctttttgcatttgaccatttgctagcttttttatatattggtgctagcaaggctagcaattgaagggagtgggatcgacgtgggtgctgttagcggcatggcgcaggtgaacgttcgcgtggatcgccaggtcaaggatcatgcggaggaagcgcttcggctttcgggcgcctcgctgcccgagctcatcaaaaaggtggtggccaaggtcgcgcagggtggcgggcagtgcgaggaagtgcttgcggccgtcgacgaccggcggcagaccgtcgcgcacgatactccgttcgccgcatcatgggcggcggcggatcagctttatgcggacctgggcattgctacgtcgcccgtatccgacgatcgcgactgggacgcaatctattccgaagccatggacgagcattatcgccaaaaggggatgatccagtgagtggggcgcctctcaagatcatggtggatgccaacgtatgggttgattcgttttgcgtcgaccatgccgagtcgcttgctgcgcgtgcgtttattgggcgggcgacggagacgggggcgttactgttcttcccggtgcatatcgctaaggacgtgctgtacgttgtccaacacgagctgaagcgaagcgttcttgccagcgggggagcgctcgacgaggcttctgcccgcgcgattggtgatgcggcgttggcgtttgtgcggaacatgaccgaaaacgccacggccgtgggtgcagatgcgtcggacctttggcttgccgacaaatacttagcgctccatcgcgattacgaggacaacttggtgctcgctgcgtgcaagcgcgcacaggtcgattacttggtgactaacgatcgcaagctgctcgaacatgccgatcttgcagcaaagaccccgcgccaaatgatgccgattcttgctttggccgaacgcggcgacgcggctatcggttgacgcgaactgtttgcgggcctcttggacgacgatgcgccaaggggacccgcgtctgctatttacaaaagctcggccatgatggcggggctttctgcgagctgctcggctgccttttcgtcggagctgtcgagtgctgccagactgcggtagacccactcgttgacctgggtgttcttgacgcctgcggtctgcataagggcgcctacctcgcggattgctgcgaatagatcggccttgggccccgcgagctcgacctcgatgccgtggtaggcggccacgccgcggttctcactcacgtggtcgataaagccctcgacggtctcaagctgctgggcgagagctgcatcatcgtcagcgtccagcgcaacaagggcgttcgaaaccgtgagggcgggatgtccgcaggggacaaagccttcgatgacatccatagcttcggtaatggttgaacccaggcctgcgagggcattgacgagttgctgcttggtatccataacggtcctttcgacgggtcaattttgcttggcgaaaatatacgtgacgcgatcggtagcaaaagtgcgaagtgcggcgcacattggggtcttcacagctcgtgcatagaacagctgtccgctttcagaacgtggtaagataacactccacaagcggggctcgccctgcatgttccttgaaaagtcgacgggtgttgggtgctcgtgcccaatgccatccagacttcccgacattcgggggcgactggtttcgacacgatagctctgagagaggaagcaagccgaggtctcctcgcctcgttaaacaggggtaccgtcaaattgaattgacaacaactcttcttttgagcctatggctctcgctgcttaatttatagcggcgcgtcaacccggtgatttccccgccaccggtgcgacgtcatattaggggaatgctcctgcgcacgtaatcggtatgacgcaggctaagaccgaaccggttaggacgttgcgagcgtgtcgctgcgcgcaaagcgtccgagactaaaccagcgactgagcttggagatgccaatcagggggctttcgtggaccggagttcgattctccgcgcctccaccaatagttacaagcaggtagagaagtgtctctacctgcttttttattacttacagataccgcggagaatcgaactctatgcagggcgcgggcgtaaagaaaacgcgtaagcgtttttagcccgcgggcgaggacgccggcaggcggccgaagccggtgcggatttgcgaagcaaatacgcggattctccgcgcaaagcctcagccagatatagatgagatgccgaccgggcgtcatgccccggtttcaacccatcaacggatcccccccacccgcggagaatcgaactctgtgcagggcgcgggcgtaaagaaaacgctacggcaacgcagaccgggacacgctttcccgatggcagcccaggcggaaagcgcgtcccggaatccgcgctcagactgggacgtagtttccggatgacacatcaagcggaaagcgcatcccggaatctaagctcgaaatgggattcattttcctgatgacgggctcagcggaaaatgcgacccggaatttgctctgagaacgggacacgctttcccgccgaccgctccgccctcctcaactccaaaaactgcgcgctcgccatcccaaaactgggtagaagaaagccaaaacgcaatcgcaggaggtcaacatgactgcagaagataaggcaaagaacgctggcaaggtcgcgctcgttttggagggcggcagcttccgcgggcaatttaccgcaggcgtgctcgacgtcctcatggaggctggcgtcgagattccggctgtctacggtgtatcggccggcgccctcaacggcgtgaactacaagtcgcaccagatcggtcgtgccaaccgcatcaacctggctttctgcaacgatagccgcttcatgggtgccgcatcgtttgcgtccacgggctccatcgtcggctacgactttatcttcaacgatgttcaggaccgcctggatccctttgacaacgagacgttcgacgccagtcccatcgagatgtacgccgtcgcgacggacatgctctttggaaccgccacgtacctcccggttaaaagcgccgtgctcgacctcgacgccgtgcgtgcctcgacctcgctgccgctggtgacgccgccagtcgagattgacgggcacaaatacgtcgacggcggcgtagccgattcgatccccatcgagcacgtgctggaggaggcgggcttcgaccgtgcggtcgtcatcgtcacgcaggaccgctcgtacgagaaaaagccctacgagtttatgcctgccgcgcgcgcccgctatgccgactacccctatctgctcgagggaatcgagacgcgtcacgaccgttacaacatccagcgcatgcacctgtggaagtatgagcgcgagggccgtgcgttggtcgttgctccgcaaaagccggtcgaggtcggtcatgtcgagcacgatccggcaaagctcctcgacctgtatattcagggccgccaggaggcaaagcgcttgctgggagatatcgaggcatttgtcgagcgctagtgtcgcgacatcatgacccatggatgacatgtgcagaaactctggtcggagccaaaatacctgttgactcgtacggcgagcggggtaatatggacgggttacttgcagagccccgtgaatctctgtaacaacacgtactgtacatggaggagtctaagtgatttcgaaatcgactcactacgccaagcagggcgaggtccagcgcaactgggttctcgtcgacgccgatggtgctgtcctgggccgtcttgccacccagatcgcaatgatcctgcgcggtaagaacaagccccagttcacgcccaacagcgactgcggcgacttcgttgtcgtcatcaacgccgataaggtccagcttaccggtaacaaggccgacacgaagacctattatcgccacagcggctacaacggcggcctcaaggctgagagcttccgccaggctatggagaagcacccggagaaggtcatcgagcgcgccgttcgcggtatgctgcccaagaccaccctcggtcgtgcccagatgaccaagcttaaggtctacgctggtgccgagcatccgcatgctgcccagaaccccacgaagattgagctggaggcttaaagatggctgagaacaccgttgtctaccagggtaccggccgtcgtaagaacgccgtcgcccgcgtccgtctcgtccccggcaccggcaaggtgaccatcaacaagcgtgacgccgagcagtatttcggccgtcatcagctcgttgagaacgcccttgctcccttcaaggtgaccgacaccgccggtcagttcgacgttatcgctctgtgcgatggcggcggcatctccggtcagtccggcgctctgcgcctgggcatcgctcgcgctcttctgaacgctggcgactaccgtgctgacctcaagaaggccggtttccttacgcgcgatgctcgcgtggtcgagcgcaagaagtacggcctcaagaaggcccgccgcgctccccagttctccaagcgctaaggttttatctcctttcgagatacaatgtacaagcggggcctgccgattcctcggcgggtcccgcttttctttttcgactagggtgggcggttgcatatcgcctgctagggaaggagcaatcctatgccccagaacatcttcggtaccgacggcgtccgtggcgtcgccaacgccgatctttcgtgcgacctcgcgtttcgtctgggccgcgcggcgaccaagtttcttggtccggatatctgcatcggccgcgatacgcgtctttcgggcaccatgctcgagagtgctctgaccgccggcattatggccgagggcggccgtccgcactgctgcggcgtcatccccacgcctgccgtggcgctgctcaccgttcaaaacgagctcgatggcggcatcgtcatctctgcttcgcataatccgccggagtttaatggcatcaagttctttagccgcaagggcatgaagcttcccgatgctgtcgaggaagagatcagcgcctgggtcatgtccgaggaagccatggctgccgacacgctgccgaccggtgccggcgtgggccacatcatcaagatgaaggacgctcgcaaggcatacgtcgaccacgccatcgatacgcttgatggcctgaggctcgacggcctggtcgttgccgtcgactgcggccacggtgcttcttgccagaccacgcccgccgcgctgcagcgcctgggtgccacggtccatgccatcaacaccgattattgcggcaccgacattaatgttgagtgcggctctacgcacctcgagccccttcgcgagctcgtgctgcgcacccatgctgatatcggcctggcccacgacggcgacgccgaccgcgtactgttcgtggacagcgagggcaatgagatcgacggtgactacatcctggctatctgcggttctgacctcgccgctcgcggcaagctcgccaactccgagatcgtctcgaccgtcatgtgcaacctgggcttctccatcgctatgaaggagcagggcttcgagatggtccagaccgccgtgggcgaccgctacgttctggagcgcatgctcgcggacggcgccgtcatcggcggcgaacagtccggccacatcatcttcctggagcacaacaccaccggtgacggcctggtgacggctctgcagctgctggccgtgctcaagcgcaccggtcgcaccctcaccgatcttgccggtatcatgaagaagtacccgcaggtactcgtcaacgtgcattccgacaacaaggctggtctggacgattgccagcccatctgggatgccgtcgctgccgccgagaaggagcttgacggccgcggccgcattctggtgcgcccgagcggtaccgagccgctggtccgcgtgatggccgaggccgagacgcacgagctgacccagcgcgttgtcgacgacatcgtcgaggttgtcaagcgcgaacttccctaatggtcaaaaacgggtgccaagtggtaaactgttaaggttattttggttaatcggtatgtccgagggggagcatgttcactaaagtcctaaggtcttttggtatgcgtggtcgagtccttacgctggatgctcccatctcgggcgacgtcattccgctctccgaggtaaacgatcagacgtttgccaccggccttttgggccagggcgtggcgattcagcccaccggaacgcgtgtgattgcaccggctgatgccaaggtcgaggccatttttcccacgggacacgccgttgcgcttaacacggtcgatggcttggacgtgctcatccacgttggtttggacactgttcagctcgagggcaagcactttaccgtacatgcgcaagtgggtgacatcgtccataagggcgatgtactcattgagttcgatcgcgaggcaattgctgccgagggctacgatgtgacggttcccatcttggtgtgcaactccgttgagttctcgagcatcaagggttccgttggcgtgcatgtcgaagagatggaccagctcatcgttgctcgcgagcgctagcaagtgcacgtggccattagcctacaattcaaacacgtttacggagggcgctcttgaaagaggacgccctccgtggcaagatgggatttgtccgaagctaaaaggctttgggtcaccgtggacgggcaggggcctcgacgcggttagacacgagacacatacattacgcgacctcgccctggtggccgcacacgttggttgcggccgacgcgggccgcgggcaagtgcttgtaagggagccttgcctctcttgtacgagaaaggacgcgtaatgaagatcattaaagctaaagactacgaggatatgagccgcaaggccgccaatattatctcggcgcaggtcatcctcaagcccgattgcgtgctgggccttgccaccggctccaccccgattggcgcctacaagcagcttgccgcttggtatgagaaaggcgacgtcgactttgccgaggtcagcacttacaacctggacgagtatcgtggcctttcgcacgacgatccccagagctatcactactttatgcgtgagaacttcttcgatcacatcaacatcgatctgaacaacacgcatgtgcccgacggttctaaccccgatgccgccgctgcctgctctgagtacgacaagatcgttgctgccgccggctaccccgatctgcagctgctcggcattggtaacaacggtcacattggcttcaacgagcccgacgatcacttctccaagggtacgcactgcgtcgacctcaccgagagcaccatccaggccaacagccgcctgttcgacagcatcgacgacgtgccccgtcaggcctacaccatgggcacccagaccatcatgtatgcccgcatgattctggtcgtcgccaacggcgaggccaaggctcaggccgtgcgcgacatgtgctatggcccggttacgcccgagtgcccggcttcgatcctgcagctgcacaccaactgcgtcgtagtcgccgacgaggccgccctttcgctctgcgagtagcgcgagcccgtcacctcgacatagctttgccgaaggcctccgctttgcgggggcctttttgctgtccttgtcatatgcttgaccaaaatcttgctgcaagcttgacgaatgtcgaatgcccaacagcttgattcattccataccagattctatgcaaaaatgccactaaaaggtcgcagacggtagcgggtgctaggcgagttgaatgacatggctgaaccttgttcatttgcgttacactgccgcttagatgggacaagctgacaagccatttacctgcttaaagaccgattagtcgggggattaataacaatcggccctcgctgtacaaaaacttgccgcttgcgtaccaaaagacaacctaaaacacaaggtcgctctattcatagcgcggcttgtatggtcttgcggttacagtgtccatacggtcgagttgaggagcgggcatggtaaacgatttgggcagtatagacgacctcgagctgatgccgctgggcggaggctatatggtgcgacgcgaacgcttgatgaatgagcttatcgccaagggccgaaaggccggcatcgtggttctttatgcgcccgacgggtttgggaagacctcggtgctgctgcagtacacccatgaggttaaatgcgacccgacgcgaggccccgtgcggattatcgaggccgatcgcgccactgggcgcgaggtgtttatgcagctcgaggtggtcaccgaagaactcaaagacaaaccgcactccctgatcgcgattgataatgtgccaaacctcgatcagcgcgataccgaagacctcatcgacaggattcgcggcctgcgcgctatgggggtaggggtctttatctcctgccgtccttcaaatcgtcagctgattcatgggctgggcgattcggttaagatcaatgcgcagatgctcaaggtgcatgcctatgagtattcggcgtgggcatcggcgttttcgatcagcacatcgctcgacttttatcagctcacgcagggcgtgcccgagctcgtttcggcattgcagacgggtctgtatggccaaggcgacgtagccggtctgctcgaaaacgagattgtcaacgtatatggcgcggcacttgccgatctggcttcgctcgacaataatgcgctgttttgcgtggcatgtctcatggttttgatgggcgagggcaatatcgcagaactcgaggcttgcggggtgaggctgtcgatggtcgaccagtcctactttgtacgcgactacccgatctttggcttggatcccgccgagcggagttttacgtgtctgggcacggaggataacggacgcttgcgcttgcgtaagttggtggccgaggttcgccccgaacttgttccgagggcggcccggattttgcttaaggcgggccgatgcgatgcggcgatgggcctggcggacgcctttttggaccgtgaggcggttcttgaacttgctgggcagtatggggtcgattttgctctgacggggcacggggccgatatctgccgagcagcgctgggcacgatcgacgctgacgatccggctccagagccaacgcctgccgaggcgcttggcgtatatctggcagcggtcagcgtgtccaacacaaagctcgcccgctatatggcatcggtcatcgagcgcgggggcgaacgggcggcctgcgaaatagaccctgtttcatggagggtggcccagacactgacggctgtttgctatggggacaacgggcttgggcttcctacgaatctggccgtgccagaaatcgagacatcccataccgcactcgatatgttgtctgcgcatatcgaggtcaagcgctgtctgaccgagcggggaaatgacggcggcgttctacagcagctcaaaacgagcagggcctacgactgcgagctcgacatcgcggggattgttatacgggccgatagcatgctggtggagctctttgatgggtcgtttgcgggaaccgacgagcgcgacgacgagatgacggtggtgcgggaggcgctcgacgtacgtgggcttaaggcgatggctatctgggtgcgcatggtgttggcggcacggcggctcctttccggcttgccggtaaccgacgatgcggcgttcaacgagctcgatcgttttgccgtgcgcatgcgcgacaaccagattcagctgtttggcctgttgctagaaggttggcagtcgctggcagagggacggccggttaatgcaaagttccgtgcggtccaagtgcttaaacttgccgaggagtcgattgcgtacatgcgcgataacgcattgctgctggagcgcgcagcgtatctgcgtaacacgtcgatggtttcggtacgcgaggaagcggagctactcgatataagccagacgcaggttggtggcgcagaagcctggatggtggcgctgcatttggcctgtgcgggccgagacagcgatcttgcggcctggatgtccatgaatcgtgcgggaattctagagccatcgtatcggctctttgcgcgccttgccatgcattgtctgggcgagccggcggccaggatacgcaagaagcttcccgtgcgcgagctgtcgcggtattcgctgcgcgacgatttagaaggggagggcgagcgcctgttccaggccggcgaggttgaagccgttgataccatcgaccatatcgagattcgtatgtttggggcgtttcgcgccgagcgcgacgggtttcccatcacggacaaaatgtggcgccgcaagaaggcggcgacacttgccgagcggcttgcgctgggcatggatgcgctcgtcgatcgtgagacgctggccatggagctgtggccccatgccgagttcaatagcgcccgcaacaacctgtactcgacgatatcgcgcttgcggtcggctttggggccgacgccggatggcaagtcatgcgtgctcatccaaaatgaatgcattgggctcaacggcgactacgtcaagaccgatgtacggctgtttgaccagataagccgcgaggttttgggaaatcgcacgggtgcgcgcgggccccatctggtcgagttgtgccttaagattgaacagctttatgccggaccgttgtatgttcccaatggctgtaatcccacctactttttgcgcatgcggcgcattatgcagtcaaagtacatcgattgcatgattaagggagcaaatgccgctctagaagaaaacgatctgcagtcggcgatttggctggcggagtcggggcttcgacaggaaacggcgcgtgaggatatggtgcgctgcgccatgcgcgtctacagtgcggcggggcgacggcgcgatatcgtcgagctgtacagcgggcatatgcaccacctgagggagcaggtcaatggcgtgcccgagcccgagacgcggcgcctatacgagcgcttggtggaggggcggctcaatcgcgtgctggtcgaacgataaaaaacgggcgcccgaagtacttgggcacccgtaagcttgctatgtgttggctcgccggatcattggctcctagacgagtttgatcttctcgatgtccttgcgcgaggactcgcgatacagcgagaacttgcggccgatgacctggacgacctcggcgtggcaacgctcggcgagctcctcggcggcttcgcgggcggaaaggctggagccatcgagcacggagcacttaacgagctcgtgcttctctaggtaggcgaccgtctgctcgacggtgccctcgttgacgtcggacttgccgatgatgatggcggggttgaggtgatgggccatgctgcgaagctgcttgacctgtgctcctgtcagtgccatgggttctcgctttctatgtatggggcgccccgcgacggggccttaatctacgtgagctgtcccacgatagcgcaggaacggcgcggtgtggagcgcgttttcccagttcaaaaagaatgcggatgccgagtgagtgggcggtgcgggctgtgaacaggctatgagctgggcgcagagaccggctcccatgcaataaacgcccaacgaaccttgcggacatgatcgagcatatagcgcccctgcggcacgcccttggaccccggctcgccggcatgggggttctcaatcatgtgttgagcgatgtagtcacgcaggcagtcgatcttgtcctcgttgccatgctcgagcatacgagaaaagtccgccacacccgcttcaaggctgtcgaaggtatcgcgacggggcgattcaaagtacgtaacctgcggcaggacacccatctgaacgaggatattaaaagcatacacaaagccattactgcaggtaaccgaggcgccgatggcgttcatcaggtgcaggtcatagcgcgggctggagttggcgaccatcgtgacagcacaacgccgacgagccgtacggtcaagcttggcaagtgcaccttttagattggtcgtcgtaaccgaccgactggcaaaggcaacatccaccgctttcgcgaccggtccaaccagatcccaatcgtcatcccaagcaagctcaagcggcgttatacgcccctcgagcccgtagtactcaatgccggcatcaagcgtgcccaacatggcaggggaaaaatcagcggcaatcacgggatgtccgtcttgcgcaagcggaatagcaatcgacccagccccacaccccatatccagcacggattcaccaggctttaacgccaacagctttataaaatcccgagcataaggggcagtctccaacggccgaaaatgccgagcccttttatcccactcaaaagaatcatcagcccgccgccgaccagcctgcagacgcatccattcgccattccaatccgcagaaagcagctcagaacgaatcaaatcatcagccacgggccatccccctcacaacaaaaaagcgactcctcccaaaagaagagccgcaaccagcatatatcagaaagaaccgatccaacgccaaaccgccataccagtaaagtagggcagaagcgaagcgactgccaaagggatagaacccaaccgaggtcccgttgtgcgggagccccggggagggcaaatatataaggtcgatcgcgagttccgcacgagccggagagcacttaatgtgctctccgtgcgagtcaggactgtccgagcaggcgaccttatatatttgccctccccggggctcctcgccagtccccctcagctagttcttcagcgagttcagcggcgccgggaagcgtccgccacggtgggcaagcacggtgccggcgttggggttcaccggcatgatgggcgcacggccgaacaggccgccatactcgacgcagtcgcccacgcccttgccgatagcaggaatcacgcggacggccgtggtcttgttgttgatgacgccgatggccatctcgtcggcgatgatgccggcgatggtctcgaccggggtgtcgccggggatggcgatcatgtccaggccaacggagcacacgcaggtcatggcctcgagcttctcgagcgaaagcgcgccggcctcgacggcggcgatcatgccggcgtcctcggacacggggatgaaagcgcccgagagaccgcccacgctggagctggccatgacgccgcccttcttgacggcatcgttgagcatggcgagcgcgcaggtcgtgcccgggccaccgcaggtgcccacgccgatgatctcgaggatgcgcgcgacggagtcgccgatggcgggcgtgggagccagcgacaggtcgacaatgcccttctcgacacccaggcgatgggcggcctcgcggctcatgagctcgccggcacgggtgatcttaaaggcggtctgcttgatcttctcggcgacttccatcatcgatgcggaatcgggcagcgtttccagggctgcggccataacgccggggcccgagacgcctacgttgatgacggcgtcggcctcgccaccgccgtggacggcgcccgccataaacggggagtcctcgaccatgttggcaaagcagacaaatttggaagcgccgacggaatcctggtcggccgtgagtttagcagcatcgatgatggtctgggcggccatgagcacggcgtccatgttgataccggcgcgcaggctggcgacgttgacgctggagcaaacgcggctcgtggtggcgagcgcctgggggatggactggatgacgcggcggtcggcgtcgccgatgcccttctggacgagtgcagagaagccgcccaggtaatcgatgccgagcgtctcggccgcgcggtcgagggcatgcgcgataggggtgaggtcctcatccttgcagcacgcggcgatctgcgccaccggggtgacggaaacgcgcttgttgacgatggggataccgtactcgcgctcgaggttctcggcggtctcgaccagatgctcagccgtgtgcgtcacgtggtcgtagatcttcgtgcacatgcggtcgaggttctcgtcaccgcaacccatgagcgaaacacccatggtgatggtcctgatgtcgaggttctgctcctcaaccatgccgcgggtttccgcgatttctgcgggcgtgatcgccatccttgcgctcctatctgccaaaacgagcataatcttatctattctaacgtgctgcacgtgccaagtggcgcatgcggcacgttttggtgctcggttgtttccgttgtgttactgcccaaagacctcttcggcgatgcgcgcgctctcggcggcgtccttggcgtagtagtccgcgccgatctgcttggcgtattcgggggtgagtacggcgccgcccacgatgatcttgacgcctggcacctcggtatgaagcagcttgatggtttcctccatggcgacgaccgtggtagtcataagcgccgagaggccgacgagcttgatatcgcgctccttgacggtcttgagcacttcttgcggatcgacgtcgcggcctaggtcaaagacggtatagccgtagttatcgagcagcattttgacgatgttcttgccaatatcgtggatgtcgcccttgacggtggccacgcagatcttgcccttgtcggcgatctcgccggcgggcatcaggcgcttgatggtgtcgaagcccacgcgcgcggcctcggccgaggccatgagctgcggcaggaagaacttgccctggtcaaagaggacacccacctcgtcgagggcggggataaagtggttgttgatgaggtccatggcgtcgtgatccgctagcaggcgctcggtctcgcccgcgatctcgcctttgcggcccgagacgaccatgcgacgaatcgggtcgtcgttgccgtcggtgccggcggtgccggcagcgggcgcggcatcactcgatgcggcctgagcagctgccgggttggcggcgatcttgtacggatcggtccagccggcatagcgctcgatgtatccggtcgagccctcgtcctcaacgctcaacacgcgatagctgtagacggtatccataaagcgcttggaacccgggttcatgatgggggcgtccaggcccgcgccgaaggcggcagccaaaaagaccgagcccagcagcgggcgggcaggcaggccaaagctgatgttcgacacgccgagcgcacatttgacgcccaggcgctccttgcacagggacatggcgcgcaggatctgctcggcctggcgctggttggtcgaggcggtcatgaccaggcagtcgatgaggacgcggtccgggccgatgccgtaacgggcagcctcggccacgatgtgctcggcgatggcgaagcgagcctcggcggtatcggggatgccgccttcgtcgagcgtaaggccgacaacgttggtgccgtagtgggcgaccagcggaaagatctcatccatgatctgctgcttgccattgaccgagttgatgatgggcttgccggcgtagcggcgcacggcggcctcgacagcggcgggatcggtggagtcgatctgcagcggcaacagcgtggagccctggagctgttcggtcgcctgttggatgatcttgacctcgtcgatctcgggcaggccgacgttgacgtccaggatatcggcgccctgttcctgctggctgatgccctggctcacgacgtagtccagatcgccgtcgcgcagggcctgctgcagacgctttttgccggtggggttgatgcgctcgccgatgacggcgatcttgtggccgtcgcagggaaggtccaccacggtctgggcgcttgtgaccgacatgctgggcttgcggtggcgcgggctgggcgtgtggttgtcgataagcgtgcgcaaggccgccatgtgcgccggcgtggttccgcagcaaccgcccacgacgctcacgccgtcggcgatcatgccggcgacggcctcggcgtattcgggggcctggatatcaaagacggtgttgccgtcgtcgtccacatgggggagtcccgcgttggcctgcaccataacgggcttgtcggtaacggtgagcatacgtgcggcgagtcctcggagctcggccggtccttggctgcagttgatgcccaaaacgtcggcaccgatggcgtcgagcgtgatggcggcgacctcgggactcgtgcccaggaaggtacggccgtcttcctcaaaggtcatggtggcaaagacgggcaggtcggagttctcgcggcaggcgaggaccgccgccttgatctcggccaggtcggtcatggtctcgataataaagaggtccacgcccgcggcgacgccggcgcgcacttcctcggcaaagaggtcataggcctcgtcgaagctgagggtgcctaagggacgaagcagtgcgccgatggggccgatgtcaccggcgacgtagcgggcaccagccgcgcgggcgcaggcgacagcggcggcaaagacatctgccacggtggcggcgccgtcgagcttgtgggcattggcgccaaaggtgttggcggtgatcacgtcgcagccggcttcgacgtactggcgctgaatgtcggtaatgacctggggctcctcaaagttgagcagctcgggcagggcgcccgccttcatgccagcggcctgcaacatggtgcccatgccgccgtcgaacagcaggtgccccgtgccctctatggccgcacgcaggcgatcgtccttaatgcgcagatcgtcgatcgtgcgcgtcttgtacgtggcaccgttgcgacgtgcggcatcaacgggtgccgccaatgcagtgccgtcagaatcatgagtgataagcggagtaaacatcgggggctcctaatggctggaatagcaggtggtgtgggcggcacggaagcggcagttctcgcgcatgcggcagatattgcaggtggggcggctctgggcgtcgtggacctcgccgtcaaacagaccgatcaccgcggtcacgcttttggtgggcataagcaggctggtgggcgtgacggtcaggccgatgagccgcgtggcgttgagcgtattgacgatcgagcgctgggccgagagcgggcagtcgccgtagccgggactaaagcgccagttgccggcgagcccatgaacggcggcgtccgtcttggcctgctggtccatttgctcaacggcggcttccacgtaagcggagcacgcggcgtcgagcacggcgccctccaggggatgttgggctcccgtggtgcgcaggcgacgctcggcgtccatgccgagggtacatgccatgagcgcggcaaagcgggcatctttgagatgtcgatagatatcgcgacctcgcagctcaacattggtgccgaccaagcgaatgcaaggctcactttgttcgtccacgcccgtggcatcgacggcaaatacgcggcgcacgccacggggctcaatgtccagttccagacgttcaacgacaagctcaatacgtcgtgacagttcgggctcaatctgctggccgccgtaacccagataccgcagcatctcggcacggtcgacacggggatggtgcgcagcatcgacacggtaaagcgccggcgacgcaaggtcggccggcacttcgacagcggttgtatcgatgtgcggtttttccattaccccaggcgctccataatggtcgcggcgatcgcaggacggttcatagtgtacaggtgcaggccgtcggcgccgtgctccttgaggtcgcaaagctggcgggcggcataatctacaccagctgcctgcaggctctcggggtcattctcgtacttggcgagaatcttgatgacgggggagggcagcgacgcgccgcacataaagaccatgcggctgatctgcgacttgcccataaacggcatgatgcccgcggtaatgggcacggtgatgccggccttgtcggcaagctcgcgaaaacggtagaagcactcgttatcaaagaagagctgcgtcacaaagaagctcgcgccggcgtcctgtttttgcttgaggtgttcgaccgagaggttgagatcctcacaggcaatgtggccctcggggtaggctgcggcgcccacgcaaaagccggcgtcgacgagctcggggatgaggtcgcgggcgtaggcgtagtcggaggcgggcttgtcgtcctcggtcgcgccggcagggagatctccacgcagggccaggatgtttttcacgccggcggtgcggtactcatcgatcttggcggcgatatcggcgtgggtacggcccacacaggtgaggtgcgccaccgagggcgtgtcgaattcgctcgaaatcatatgcgcgatgggggcggtggtggcaccgttgcccgagccgccggccgagcaggtgaccgagacaaagctcggcgaaagcttgcacagattgcctgccacttcgcgagccgtgtcgagggtgagctcgcccttgggcgggaacatctcaaacgaaacgggtgcggtgccctgggatgctgcctgcttaaaaacctcgtcgacgcgcatatcgtgctcctctagatacgtaatagtgtgatgtgttgtaaggattctacagcaccactgtgtcacggcggagtttcactcgctatttggggataccaatcgaaaatgctttgctatcggcattccctataacagggcggtcaatctaggatggggctataaagactggtattcgatgtgaaataccagttaatagagccccatctcaaattgactacccttaaaccatggggaaaggtctgcaatttatacagttgattggctgttgagggtggcaacgccgccgcgatgcggtaacctcattgattggtttcgcgacagcaacataacggtaatgttgcggaaacacgccgagtctaagctatgactcgttcgttagtaatcaacaccgcttctcacgcggtgccgatacgaagggagttccgtatggccgaacttactgaccgcttcgggaccatggtgttctcggaggaagtcatgaaggactacctccccaaggacatttggaagcgccttgctgcaaccctcgaggacggtgagccgctcgacctggatgtggccaacgctgttgcccacgctatgaaggtctgggccatctccaagggcgcgacgcactacgcgcactggttccagccgctttcgggcattacttccgagaagcacgacagcttcctcgagcccaaccacgacggcaccgccatcaccaagtttacgggcaagaacctcatccagggcgagcccgatgcctcgagcttccccaacggcggcctgcgtgccaccttcgaggcccgtggctacaccgcctgggatcccaccagccctgccttcattaaggacgatgtcctgtgcatccccacggctttttgctcctacacgggcgaggccctggacaagaagaccccgctgctgcgctccatgaccgcgctctcgcgtgagtccaagcgcgttttggcgctgtttggcaagacccccaagaaggtcgttccttccgtgggcgatgagcaggagtacttcctgatcaagaaggacgcttaccgcaagcgcagggacctggtcatcaccggtcgcaccctctttggcgccgctccctgcaagggccaggagctcgaggagcactactttggcgctatccgccccaccgtctcggcctatatgaaggacctggacgatgagctgtgggcgcttggcattcccgccaagaccaagcacaacgaggtcgctccctgccagcatgagctcgcccctgtctatggcgaggtcaacgaggccatcgaccagaatctggtcatgatggagaagatgaagctcatcgcctcccgccacgacttggtctgcctgctgcacgagaagccctttgagggcatcaatggttcgggcaagcacaacaactggtcgcttggcaccgagtccgagaacctgctcgatccgggcgacaccccgctcgacaacctgcagttcatcgtcttcctcaccgcggtgatcgaggccgtcgataactatcaggagctcctgcgtgcctctgttgcctcggccggcaacgatcatcgtctgggcgccaatgaggctcctccggcgattatgtccatcttcctgggcgaccagcttaccgaggtcgtcgagaagatcatcgatggcaaggcttctgtccatgccacgcgcggcgtgctcgacctgggcgccgatactctgcccaaactgatgcaggacaacaccgaccgcaaccgtacctccccgttcgccttcaccggcaacaagttcgagttccgtgcctgcggctccgagcagaacgtctccgactccaacctggtgctcgatgccgccgtggccaagtcgctcaagtccttcgccgacgcgcttgagggtacgcccgaggatgagttccaggacgccgcgctcgagtactgcaagaaggtcctgaccgaccaccagcgcatcctcttctccggcgatggctactccgacgagtggcccgtcgaggccgagaagcgcggccttgccaacaacaagaccacggccgacgccctgcccgcctttgtttccgataaggccattgcgctctttgaggagacgggtgttctgaccaaggccgaggcccagtgccgctacgattgcaagctcgagaagtacaacaagctcatgaacatcgaggccaccacgatggttcgcgaggcgcgtcgtacctatcgcccggtcattaccgcctatgccaccaaggtcgctaagggccttgagactattcgtgccgccggtgctgaggccgccatgcagtgcgagcagaacacgctcaacaagctctgcaacggcatcaccaccatcaacgactccatcaaggcgcttgacgccgtgcatcagaaggctgaggccctcgataaccaggagcaggccaacgtgtacgcgcacgaggtcgttcccgctatggatgcgctgcgcgccgccgtggatgccatggaggagatcgtggctgccgactactggccggtcccgacttacgacgacatcctgttctacgtgtagagcgtaactgacatatcgtcacggtattgagccggggtccgcatcatgcgggccccggtttttgtttgcgaaggacgctttgaagcccgttttgcacctgattcgcccacgcaataagggggcgtggacaaaaaacgtcaaatatgagtactgtcacaagtcctgtagcattatttttttttgcaaaatatgcagtgttacacaacatatgttcaagtacttagctgataaacgcctgcaattctttcgcgtaggacccctggcgtctaaatcgccttctgatggcatgaaatcgctgttactaaattggtgacagtactcatatttgctattttttgcccacaggcccttggacgacagtgtgatttaatgccctcggggttcgaatcccggcgttggggaagaaaaaagcccgtcgccgtgaactgcctcccatttcttggacacgagaaatgggaggctttttatgcgtatcgagtcccttgcggcgtagttcttatttaagccgtccaggttttggggtgcagttcagcggacgggaggggagccttatatgtgaccgcggcaaaaggatggcaataccgcagtcgcccaaagggagggcctggatgcaccgggcctagataaggttcttgccagacaccttatcgaagagatgggtcgcgttcttctcgaacttgaaccagatggtgtcgccagccttgagcgcgcccttggcctcgaggtcgacgacggggataatcaggacaaactggccgtcgggggcggtcacgtggacgtgctcggtcgaacccatgagctcggtcacctcgacggtaccctggagcgcaccctcctcgcccttgtcggcaagcaggatctgctcggggcgcacgccggccgtgatctccttcacgtcgccgccgtcccagttaagagcgagttgagcgcaggtctcgggggcgagagcaacgttcatgtcctcggtcttgacggtaaagccgttgcccgagcgcaccagctgggcatcgaagaagttcatctgcggcacgccgatgaagccggcgacgaagatgttcgcgggatggttgaagacctcctgcggcgtggcgatctgctggacgacgccgtccttcatgaccacgatgcggtcgccaagggtcatggcctcggtctggtcgtgagtgacgtagatgaacgtgcccttgatctcgtggcgcagcttgatgagctcggcacgcatctggttacgaagcttggcgtccaggttggacagcggctcgtccatcaggaagaccttggggtcacgcacgatggcgcggccgatagcgacacgctgacgctggccgcccgaaagcgccttgggcttacggtcgaggtactcggtaatacccaggatctcggcagcggagcgaaccttacggtcgatctcgtccttggagaccttcttgagctcaagcgtaaacgccatgttctcgtacaccgtcatgttggggtacagagcgtagctctggaacaccatggcgatgtcgcggtccttgggcgccacgtcgttgacccgcttgccgtcgatgagcacgtcgcccgaggtaatgtcctccaggccggcgaccatgcgcatcgtcgtggacttaccgcagccagacgggccaacgaggacgacgaactcctggtcgtgaacggtgaggttaaagtcctcaacagcgagcacgccatcctcggtaaccttgaggttgtgcttcttctcctcggtcttcttctttttgccaaagaagcccttctttttggactcggtgttgggatacaccttctgaacatgtttgagaacgatctcggccatgtctttacctttcgatatgcggcaccatgttgagggcgccgcagaaacttgcaaaacagttacggcatcagcccttgacggcacctgccaccacgccgtcgatgatgtacttctggcagaggatgtacatgatgacgatggggataacgaccatcatgatgcaggccatcatggggccgagctcgacgtggccgtagccgccgcggaagtactggatcaagataggaatggtcttgtacttggtggagtcgagcgtaaggtagggcagcagatagtcgttccagacccacatggtctcgaggatgccgaccgaaagataggtgggcttcatgatgggaaggacgatcttaaagaacacctggaccgggttgcagccgtcgatcatggccgcctcttcgatctcgagcgggatgttctttacaaagccggcgaacataaagaccgccaggcccgcgccaaagccgaggtagataaagcagatgttgaacggcgtgttgaagccgatgcggtccgccaaattggacagcgtgaacatgagcatctggaagggcacgaccatcgagaagacgaacaggtaatagaagaagttcgagatcttgctgttgacgcgcactacgtaccaagcacacatggagcagcacaccagaatcagcacgaccgacgtgaccgtgatgatgagcgagtacataaatgccgaggcaaagccctgctcgttaagggcatgcatgtagtttgcgaggccgttgaacgtctcgggcgtgagcagatcgaatgccgtggtggtgctgattgcagttgcctttttaaaggaattgagcgcaatcatgaacacggggtagatccacgcgagcgacagaatcgtaaagaaaatcgagagcgcgcggttgataaccttatcgcgtttcattactgctgcacctccttggacctcgtggccttaagctgaatcatggagatggctacgaccaggatgcagaagataactgccttggcctgaccgatgccctgccatgcgataccggcacgcgaatagaacgtgttgtagatgttcagggcgagcatctcggtggagtgcgcgggggcgccgccggtaagggcgaggttctggtcgaacagcttaaagccgttggtgatggacaggaacaggcagatagtgatggtcggcatcaggttagggatcttaaccttccaaaacgtctgccatgccgtggcaccgtcgaccttggcggcctcgatgtagtcggacggaatggactgcagaccagcgatgtagatgatcatcatgtagccgacctgctgccacagggtcaggatgataaggccccagaagccagcagcagagttaagggcgatgagctgggcgcccacgttggagagcaggcagttgatcagaatctgccagatgtagcccagcacgatgccgccgatcaggttaggcataaagaagatcgtacggaagatgttggtgcccttgagcgctttgcgggtgagcgcctgcgcgatggcgagggcgatcacgttgatgagcaccgtcgacaggaaggcaaacgccacggtaaagaagaacgacgtggcaaactgcggatcggacagtgcgcgcacgtagttctcgataccgacaaagtgcgtgttgttgatggtaataaactggcagaacgagagatagaaaccctggataaaggggatcacgaacccgatcataaacgccagacacgtgggcagcataaagagcggccaccagcgcttgagtgctttgcccatagaagggtcctttcaatatgcagggggcgggcaaaccaacgtctgcccgccccctgtcgctaatcagatagcttgggcagcaactgcttactcggaagcagccttctcggtcttccagccatcgacgaaggcgttcttgacgccgtcccacttgctgttgtcggcagcataggcaatcagagcctgcttgaggttcttcttccactcctcagaggggatgtaaacgaagtcccaagcgacggtcttcttgccgtccttggccatggcaacggcctgctgcgagaagacgttggtggtctccttagcgctcttgaacggggcagtcagacccatcttgtcagcgatgatgctggtggcggtgtcagaagtgacgcaccaatacatgaagtcctcggtggccttctgggcatcctcggaagcctgggagctgacgcaccagtagttctcgccgccggagcacaggccctggttctcctcgccgtcgacaccgatgtagatgggcatcatgccaatctgatcgtcggtcatgccggccttggtgaggtcagcgtaggcccaagaaccgttctgatagaagacggccttgccggttgcgaactcgttggtggcgtcgtcgccggtcttggaggcaagctgcgaaggatcgcaggtggagtcggtgatgtacaggtcgaaaatctgcttgaagttgtcgagatactcgcccttgatctcgtcgtcctcctggttgtgctccttctcgaactcgtagtagagcgggaggttggcgaggtgggtggtgtagcgccagctggaggagtcatccatgccggcggaagtaaaggcaccctcaacaccaagctcgtccttgcgggcctggatgtcgtcggcacaagccttcagcttgtcgaaggagttgatgtcctcggccttgtagccagccttctcgagcagctgcttgttgtagatgatgccgtagctctcctggacccagtcgatacccagatccttgccgtcggactgcagagccaaggagtcgtcaatgagctcaccgcgaagcttggtatcggacaggtcggcgcagtaatccttccagttcttaaggccggtggggccgttgacctggaacagggtcggagcggagctcttggacatctcggacttgagcttctcctcgtaggtgttggaggcggcggtcacgatcttgacctcgacgcccttctccttcttataggccttggcgatctccttccactccttatcgacctcgggcttgaattggaggaagtagacctcggcagcgtcaccagaagcagaggagccggagccggcagaaccaccgcagcccacgagacccagaccaagaaccgcagccgcggaaccagcaaagcccaggaactgccttctgctcatttcgttcttcattacaatccaccctttcacaccgtggcggcaccctttgccgccgccttcggagattggctcggggactttgccccttttgctgatttgtacgatacgctatttggctagttgtttgaacaagtattactagagcggtagaaaaacttcggtgaacggtaatttcaacttgatacttgacaagttttgtataaacaattatttgttatcgaatgcagagaaaacgcccggtcaagccgatgcatcgtcggtttgaccgggcgttttctctttgagggcatgagtctcgtcaggctgcgagctagccggctatcgcttggaattgacgcggtaatggaagatctcggggtgtgtgcgagtgtgcgtcacctcaaacaagatgccatccgaggtgtacgactgactctccatgacggcaacgcagttgtatttgccgaggtcaagatagctgcagtcttcatcgttggcgagctcgacactcaccgtacggcggctcgccatcactttgacaccgcgcttgtgctccagatagccgtaaatagaatctgccgcgatctcgggggtcaggcccttggcgatcgacgccaaaaaatagccatggtccacttggcgcgcgttgccgttgaggcttcggacacgcactacgcgaataagctcctcgcccaccctaaagcccaggcgacaagagagctgctcggtgcaaatcaaatgttcaaaggacttaacgaccgtcgatgcaacggcattgttgcgctttgcaaactcgccaaacgactcaacctcttcgagtgcgcccaacatgtcggtttcgcccttaagccaaataacgcgcacgcccttgccgtgtatgggctgcacaaacatcccgtcggccagcatgctcaaagcgcggcggacggtattgcgcgtgcagccaaattccgcggtcagctcggcttcggttggcagcatctcctgaaacgcataggtcccgttaatgatgcgcgaacggatctcgcggtagattccttcgtatatcgcttttggcattgtttcacctctacataatttatttccggctaggcacgatagcatttcttaaagttgtttaaaccgaatatcggtaaagcgacaggatttaaccgttgacggtttctgtcgtgcccaaatcggtttcgctcaaaactgccggtacgacaatcgtctggtcctctacaatgaatccattgtttaaacgtttccccacgcgcaacgcgcctcgatattcggaaggcagaacatgctgcaaaaaatccaacgctttggcggggcgatgttcgctcccgccatgctgttttctatatcgggcctcatggtcggcgtctccgctctcgcaacgactgcggacatcgtcggcgatctcgccgtatacggaaccccttggtacgttttttggaccatcatccagcgcggctcatggacggtctttaaacgcctcccgctcctttttgccgtagcgctgcctatcggtcttgcccaaaagcaaccggcacgctgctgcctcgaggcactcgtggcctattttgcctattgcttctttttgagcgagatcattaagctgagcggagacaaccttggacttaagtacccgtcatctttgacccccgccaacggtatcaccgtcatcgacggcattaagacgctcgacaccggcattatcggcccgctggcggtatcggcaaccgtcgtcgccatccatgaccgcttctacgatgccaaggttcccgattggctcggcaccttctcgggctcctcgctggtctacctcatcagcttttttgccgtgtttgcccttgccgctatctcggccgccatcgtgccctccgtatacgcaatgaccgaaacgctgcgccatgcacttacgagcgtcggcccctttggcgtgggcatctttgtgcttttggagcgagcactcgagcccatggggctgcaccacctgctctacatgccgatctactacgacaacctggtcattaacgacggcatctacgccacgtggagcagcttgctccccatcctctcccatagcacgcgcccccttaatgagcttgcgccgtgggccggttttaccgccactggctgggtcaagctctttggccttcctgccatcgcagccgcgttctactccaccgcaaaacccgagcgccgcgccggcctcagggtcatccttgttcccgccatcatcgcctcggtggtttgcggtgttaccgagccactcgagtttctctttatgttcacccaccccgggctcttttttctctacgccgtcttatcgtcttgccttgccacaaccatgaatctctttggcatcgtcggcatcttctcaggcggcctcatggagatggcagccttcaactttattccgctcatgcgcacgcatgccggtgcctatcttttggcgctcggtatcggccttgcctttagcctcatcttttttgttagttttcgagcactcatcttggcctatgaccttaagacgccgggccgcgaggatcatgtcgccaatcgcgcggcaatcgatcgtttaacggaaagcggctttgccaaagagcaatctcccaacgacgaggtcgatagtcgatccgatcaagatcacgtcctcgctgagcgggtaattcagcttttaggtggcgttggcaatatcgtgggcgcaaccaactgcgccacgcgtctgcgcgtcgaggtcgcagacccttccatcgttgcagataacgcgtcgtttgtcgcggtgggcgccaagggcctcatcattaccggcaagaccgcccaggtggtcatcggcatctccgttccccgcgttaaagagcattttgaccagatcatgggcctcgagccggaatttgtgcccaccacctcggcctcccctgccgccagcgcagcccataagcgcggcgatatctgcttcttcgatatcgacggaacgctcgcctggcaagaccccaggctcgcccaagaccttcccgaagacgagcgggacctctccccctatcccaacgaggcggtttcgcaggcaatccgcgagtttgtcgccaacggcaacatggcctttatctgcacggggcgcaccctcagctgcatccaccccaaactttttgagctgccctggaccggcatcgtctgtcttgcgggcggttacgccgagatcaacggacacgcaattcgcgatctgtcgatgacgcccagcatgctgcagcatcttgccccctatcttgagcaatcgggcgaggtcatccgctttgagggcctcaacggcgtcgtgcgcatgagtgccgatgcccccgatgcccccggatacgcgcgcaccctgggcgacgcagtcacgcagctgcaacattacagtgtctacaagatcttgatgtctacatcgctcgccaaccacatcgctcaagataaggcacttgagccgctgctgtgctttaacgagctcgaactcgaggtaaccgaaatctcgccccgcgaatgcacgaagcgcgggggcatccagtctgtactcgacgccctcgatccccaccacggaaccgtatacggcatcggcgacgccagcaatgacgtctcgctgatgaacgccgtcgatgtcggtatcgccatgggcaatgcgccggactatctcaaaaagcgcgccgactacatcaccgactcggtcgacaaagatggcgtcgtcaaggcgctcgagcactttaggcttatataagcagccggcacgcgcacacgtcccgtttccccaaatcgccaaaacagacgcgccggcaactccaatgtggcaatatggtatctgcacaccgcaacgatgcaacctaagaaagaatgcgagaacccgtgtccagtccgtttaccagctttttagcccagcactttgaccagatcaacgactatctggccacgttctttgacggacaggcgacctctgccgatatcgagcgctacctgtataccccgctctcggcatttaccgccaatgccggcaagcgccaccgcccgctcatctgcatgctcgccgccaccgcagtgggcggcagctttgagagcgcccgcagcgccgcggcggccatcgagcatttccagtcgggtgcgctcatccacgacgacatcgccgataacgggcagctgcgccgcggtaagccctgcatgcacctcaccgagggcacggggcttgctatcaactgcggcgacctggcacttaccatggtcaccaagacggttctcgacgaccccacgctggagcccaacgtaaaactccgcgtgctccacgagcttaccgagatgatcgtccgcaccatcgagggccaggcgctcgacctgggttgggtacgcgacgggcgcttcgacatctcggtcgacgattacctggacatggcgacgcacaagaccgcgtactacagcggagccacgccgcttgccaccggagccatcatcggcggaggcagcgaggagcaaattgaggcgctgcgcgcctttggcctgcacacgggccttgccttccagattcaagatgatctgctcaacttgatcggtaccaaggaggccgccaacaaggacttccgcaccgacatcaccgagggcaagcgcacgcttgtcgccgtacacgccctctccgatgagcgctatcacgacgagattgaagcgatcctctcctcgggcaccgaggaccccgcgcagctcgcacgcgccgtggagatcttccaggagaccggctccatcgattacgcccacacttacgcgctcgacctgaccgctaaggccaaagcggccatcgagaacgttgagcttgatccgcacgcacgcgagctgttcctctccatggcagatttctttgtggagcgccttaactaacgggggttataaaacctgtcagcagcgtatttaggcacaacttgctacactgttgagtgcatgtttatgcatccctttgcgttgtctatccgacagacgctcaaatagtacgaatggtacgccgaaaggggttcgttcatggaacctattacaacgggcatgcaaggagcagccgtcgaggacgtgcagtctcgtctcctgcagctcggctacacgattgatgccgccgaagtcaccgacaagtactttggagccaccactgagcaggccgtcagcaccttcaggctcgacagcggccttgctgccggtcatgccgtcgatatcccctgttggagcgcccttgtagacgcttcgtataagctgggcgaccgcaccctctatctacgcatgcccaatttccatggcgccgatgtgcaggccctgcagcgcgctctcaacgttttgggctttgcctgtggcgaagacgacggctactttggtccgcataccgaggccgccctgcagcagttccaggaaaatgtcggcctgtttgccgacggcatggccttccaggacacctacgcctacatcaaccgcctgcaccatgtgtgggagggcaagccctcggtcaccgaagccgagtcccgcatcggttttgctcgcgccgccaacgtgctcgagcgcttccagattgccgttatcggcgaggaccccatcgcacgcagcgttgcgtcgcgcatgtggaatatcgccacggcaacgaccgacaacagcggcatgatgctctgcgactccgaggtcccaaccgacgttgacctagtgctcgagatcgcaagcgatgagctgcccgcagatgcagcgccgcgcgccacgatcgccctcgccgagtgccacaacctggcccagcgcatccgcactgccaatgtcgccgcgcagcagaagccggcacgcattcgcattgagctcacgggcatgacgcgctacaacggcaccttcacggccagcgacgcgcagacactcgccgtacgcctgctcgacggcgtttgcgatgccctcgcagattaggtaaactaaacgagttgcttttgggcaacaccgcacattgggacgtagttcaacggtagaactccggtttttggtgccggctgttgggggttcgaatccctccgtcccagcccttaagaacacagcgctccgggcccttatgaacctggagcgctttcttgtgggcaagcggagggattcgaacccgcaagggtgcggagctgaggaaacgcgaagcgttttccagcgcagcacgcaaggagcgaagcgacgcagcggggcgcggccgccgaaaaggcggacgcggaatccctccgtcccataccagtcgagaacacctcgcatcaagaaatatcagcccagttccgaaaagcgagccgccatctacaaaatggcgcgtggccccggcggaccgggcattaagcttgtcgcgagttccgcacgcaaagaaggccacgcgacctcgatgttttggacgtgacagcgagaggggtcctggtatggcaaggtgacgtgaaacaaggcggcgctgaccttctggtcgcgccgccgaagttgaacgtcagattgccgtgccagggcccctcgcagcgtcaggaagaccgccgttcggtagaacggcggaatctagttgttgagcatgcggtcgaagcttcccgagtcgccatcccgatagtctgcggtcatcagaatctcctgcggaatgcgcccgccctcgcgcagcacgttgcggaactgcacgcgcgtaaccatgggcagatccttgatcgtcgccgccaggttctgcggcacgccctggttggcagccgcgggctcgcactcgccgccggccttcacgcgacgcttatgctcggcgagcatagcgcgatacatgccggcatgcaggcgaatctcaaccacattggcattgcgagtctgctcgacgatacgcgcgccctcgcgatcgatatcgcccacgtagtagacgtagttaaagcgatagccaatctcggccagataatcgtccagggcatgcgagacgctcgccttgcatccgccgccaaaaatcacgccgcccaccttgatgccaaagagcttggcgtgcttgcggccacgcagcagcttgacgatctcgtcgtaggtgtccaggttctcgaccataatgaacggcttgtcggctcccagcgtaaaaaagcccgtaaagtgcacggggcgattgggggcgaccttgatcgcctgcatgctgatgcccttttcggtcatacgcctgatcaggcgctcaccgtgcttgccgtcaaaagccttctcgtcgttaaagatctggtaggcacgctggcggcgcgaggcaaccggcgtatcggcacctcggttctgctcgatccaagcctggatgattgcgatttcctcggcaatcttgcggttggacatctcgttgtgctgagtgcgctgcggagcctttttgccgtccttgccctcgacctttacgatctgtgtctgctgctccttgatcttagagagcgccgtaggcgtagggacaactttgagcagctgcctgcctaaaacgcgggcaagggcaaacgccgagacctcgccgtggactgccgacttgggctgctgggcagcagtatctgctgcggtagactccggcttcctctgagacttgcgcttagaatcgccttgggaattgcgctcgcgcttcggcataggcgcctgcttctgcggacgatcggacttgctctccttcgccggctggcgcttaggctgccccgaagaaacctcgaccttcgcatcctcgtcctgtggcatggtcttctcggctgcagtctcggcatgggaactgcggcccccacgatggcgacggcggcgaggcttgctcgacgcgccctgctccgcctgctcatcagtaggctgctggcccttggcctcggcatcaacctcaagctgcggctcagcaggcttctgttcgcgagccgccgcctcaacggccttctcgtcctgagtggtcgaagccggctcgctcttctcctgatgccttacgggatacgcgcgccccgcaaaaccacgtccgggacggcatgaacccggagccttcttgaccggttcatcggacgcgtcagcagcctcgacggaatcctggacctcgcatgcaatacctcgctgctcggccttaaagtgggcaccgcggcgacgcttggggtcctggatctcagcatgctcttgagcgcgagtcggctcctgcatcccgacggacttttcctcgacggcctcagcatccgtctcacccttttgagcaacggcgcgacggaagcgctcctgctgggcgcggcgctgcgcatcgcgcttgccacccccgccaaaaccgccgcgtcctgccttggccgtaaaggcacgcacgacgttctcatcgagcaactcatcggtatcgacatgctcacgcggagcaacttcttccacagcaggcacgtcagcagaatcctcgacgacaaaatcttcgacggactcggcaggctgctcctggacatcgcggatctcggcattgatggtatagaacgccgggcgcccgttaatgccgctaccctcgatctttgtcacgatatttgccgcgataagctcatcgcgcatcgccttggtgtcacattccttatcgacggagcggaaaatctgcgccagcgcactcgacttaatcttgagcaccttgcggcagagcaggtcgtaggcaaccagcttggcacgctcggcagaaagcgacgtccggctgctcagacgttcagccagggcatcgacattattttggttatcggaatataccgtcttggccacggggcccctttcatatgcacacatatacgtctatatggtacaacgcgcgcccttatccacgcaaaacatctgcgagaacactcgagcgtcacccgcttttgcatgaaaaaaggaccgagcccgcgaaatcgcggacccggtctttccgagtcatatagatgtgacgttcaactcgtcaggtcaactaagccttggcggcctcggcgtcggcaggagcctcagcggcagcggcgcggccgtactcggccttgcccatctcagaccactcgggctcctcgtcgggcatggaaccggcctccttgccgaagaactccttgaggcagttaacggcaacgatgaggcccaggaccatcagcaggacggcgaagacaagctgcaggcccttggtggcggcgacggagacggcggccgtggtggcggtagccgggatggtgccgaagaagccgtaagcctggacagcggccatgcagcccatggcgctctggaccagcgaggtgaaggtgcagcagagcaggaaggcgacgggcacatagagcatccagcccttgcggccggtgcacttgcagaacacggcgagggtgatcatggtcatgccgccgagcagctggttggaagcaccaaagagcggccagatgttggcatagccaccaaaagcgagggcgaaaccgggaagcagggtaacgaccgtggcgaaccaggggttgccgaggaccttcatgtagccggccttggactcgatggccagggcatcgttggtctgggcaaagaactcggagaacgaagtgcgggcgatgcgggcgacggcgtcgagcgaggtcagggccagagcggagacgttcatggtcataaagacggtagcgagcgtgccgtcaacaccgaaggcctgcataccgcgggagatgccagcggcgaagatctggaacggggtggaagcgacaccggcgttgagggcgccggtaccggcggtgttcatgtcggagaacatgatgccggcgacgatgatggcaaggatgccgacgaaggactcgacgatcatggcgccgtaaccgaccttgacggcgtcctgctccttctcgacctgcttagaagaggtgccggaagaaacgaggctgtggaaaccggagagagcaccgcaagcgacggagacgaacaggaccgggaacatcatgccggaggcagtggagaagccggtgaagaccggagcggtgatagtggcctgaccgttgacgcccaggacgacgatgccgaggacagcgcagacgatcatgacgatcatcatgatggaagtgaggtagtcacgcggggtcttgagcatctggatgggcatagcgccagcgaagaccaggtagaccatgacgacggcgaaccactggaacttatccaggtagaccgggaactgcataccgacggcgaacatgagaaccatgaggacaacgccggtgacgaactcggcagcgccggtgaggttgaacttcttctgggcccaaccaaaggcgatagcgacgaaggtgaacaggatggagatggtaccagcgcagccggcggcataggacttggtgaagtcgatggcaccggtagcagcaccagaagcgtcaacggccggggtgaacatgaacgtcttgcagaccatgtcggtgaaggcggcgatgacgatgatgcagaacagccagcagaacagcaggaacaggcgacggccggtcttgccgatgtacttctcgatgagctgagcgagcgacttgccgttgttcttcatcgaagcgtacagggcaccaaagtcgtggacggcgccaaagaagatgccgccgatgaggacccagagcacgacaggcagccagccaaaggccatggcgacgatcgtacccgtgacagggccagcaccgcagatcgagctgaactggtgcgagaacgcggtgaaggcggagacgggcgagaagctcttgccgtccttcatgcgcttggccggcgtgagggcctctttgtcaacgccccacttgttggccagccatcggccatagcccagatagccgcaggcgagcaccgccgcggccacaaccatgagcaaaactccgttcattacatttcctcctctaaaaagaacttcctagacataaaaaatgagggccgtcggttgcgctcgacggccctcatcttcatcagccgcccgttatcgtacgggctagctgtatgtgctaacccgcatcagataattactacgctgataatgtttagctgatgcgtgaacatgtctaagaaatcctcttcaatcatgatgtgaacgatccgtgcgtgttcacatcccccagtggttgaaaaggagtatgaaactttagttacctaaagtcaacgcaaatatgtaatgaattttcaacttttttgaatttctcggtacaaaacgccattgacctcggactttaccccacgacagtttttgcatgagagatgcccctgagagtcgcgggagccgggcggcgcatatgaactttatcgcgagttccgcacgcaaagaaggccacttaatgcggccttcgtcttgcgcaggactgtagagcaggaaaccttatatccggcccctccgtccggggaccgcgccgtaccagctacagcgtcatgtttggatcggcgtcgacgtcgaacggcgagatttcacctcggtcgaatttacggcgagcgacctccgcgatcatggctgcgttatcggtacaggcagacaagggcggcaccgttacgcgaatcccctgacgtccaagcttcttgatcatcatctcgcgcagatgcgggttggccgagacgccgccgccgatgcagtattccttacatccggtagcgtgcaatgcgtttttggccttcttgtactgcacgtcaaagacagccgcctcaaacgaagccgccagatcgggcaggtgaatcgtgcgcccggctttggtctcttgctcgatgtagagcgtcaccgccgtcttgaggcccgaaagcgagaaacgatagtctcccctgctgttaagcgcgcggggaaaatcgatcgccttggggttgcctgtctcggccagcttggaaatgatggggccaccgggatagcccaggcccaacgccttggccaccttgtcgaaggcctcgcccacggcgtcgtcgagcgtctcaccgagcacctcgtaatcgtcccacgccttcacgtgcacgagcatggtgtgcccacccgagacaagcgtgaagataaacggcggtttgaggtcgggttgcgccagcaggttggcaaacaggtgcccctccagatggttgacgcatatgagcggcttaccggcagcgtaggcaaagcctttggcaaaggcaacgcccaccacgagggcgcccaccaggcccggaccctgtgtcacgcccacggcggcaagctcgctgggcgcaatcgccccaccctcaaggccaagcgatgccgcggcatcctcgagcgccgcatctacgacactcacaatcacctcaacgtgcttgcgcgaggcgatctcgggcaccacgccgccaaagcgggcgtgaaaatcaatctgtgtcgacacctggttggccagcatattgccatccgcatcgataatcgccacggccgtctcgtcgcaggaactctcgatagcgagcactaggcgacgacgctcaatttcagcgcgctcctcaacggttcgctcgggcgcaggcagcggccatacacgctgctcagccgccgtcggctcgggcgaagcgttgtcgaccgggagcaccaagggcagcggcgccgtcatgacgatggcatccttgccggcaccatagtagccgcggcgccgtcctgcctcggtaaagcccagagcgttataaagcgcgatcgctccctcgttgccgtcctcgacctcgagcgaagccgtggtgcagccgagcatctgggcatcatagctcacatgcgacagcagcttgcgggcaatgccctcacggcgatgtgccgggtcgacggcgacatccagaatctgcacatcaccgtccacgaccataccgccggcaaggcccagcagcttgccgtcgtcgtgtgccacccaccaactacgcggcgcagcgacgtcctcgcccagttcggacaggaacatgcccggcgtccacgcctcgtgtccggcaccttcaaagcaggcagcctccagcgcgctcgcgccctcggcatccgccgcgcccatgggacggaactgcagatgacgaccggcgagctcatcggcaacacccgtaatttcgctctgcgcactctcggcaagaccaagacgcttgcgctcgttttcctcggcatccgaaaggcgcgtgtaaatcggcaagacgcgggccggatcgccgtcacccgcagcgtgcgcgagcagcaagccctcgcccgaaggccaccacaggtcgcgctccacgcagcgggcggtctcgtcctcgcccagcagcttgccatagcgcacgagaccgtcaccggtcagctgaacctggtcccagtccgctgcttggcgccactcatcgagcgcaacggcggccttgaccacgtgttcgcgctcaaattgacgctcgggaccctcatcgaccagcatatacagcgccggatatacctcaccgcgcatagcatcggccaagataccaagcttgccgcgcacgccagccttccacgccgtccaagcgtaggcgtcgagcgtcgacacgcccagcagcggaacattggcaccacgcgcgaggcccttggcagtggagatgccgatgcgcacacccgtaaaggaccccgggccgcggccgaccacatagcaaccaacatcgctgcgatccagaccggcttgagccagcacgccatcaacggtattcacgagctcaacgttggcgtgacggcgacacatgtggtcgccactcacgagcttcgtctcgcccgtctgcccatcaatccagcttgccgcgcaggcaagcatgtcggtcgaggtatcgagcgccaccaccagcgcgttgtcgttatgcaagctcatcttgtacagccctatcaatcaaatgggaaagctccattgcgcggtcaccgtgcgcctcaagcgttatcgttcgcacatcgctgtcgccctcatcacgcttgagcgtcaccgaaagatactcatccgtcagctcgtcctggaattgttcgccccattccagcaggcaagcaccctcatagcccagcacatcgaaaatgcccgtatcctcgagctcgtaggcatgctccaggcggtatagatcaaagtgaaacagcggaatacgaccttgatcgtgaacggccatgagcgcaaacgtagggctcgtaaccatatgcccatcgcccagcccgcgcgagacgcccttggtaaagtgagttttgcccacccccaggccaccggtcaggatgagcacatcgccgtcctcaaggcacggtgcaattagctcgccaaagtactccgtatcggcagcgcaagtcgttttgtaagtacctacccccaggcgctccagggacatatatgctccttattattccgaggcgtcctctggtgcgggatgtcgctccagataatcgcccagcatcttaaagtcttcctccagcagctcctgccacgccggattgcgcagcgctgctgccggatgaaaagtgggcattactacaaaatgccccatctggtggaacctgccgcgcagcttagtaataccaatctcggtcttaagcacaaagtgtgtcgcggggttgccgagcgtcacgataatatcgggccagatgcttcgaatctgctcacgcaaaaacggcgagcaagccagcacttcctcgggacgcggattgcggtttcccggcgggcggcacttaagcacgttggcaatgtagacgtcttcgcgtttgagccccgccagcgacaaaatgccgttgaggtcctcgcctgccgcccccacaaagggctcgccctgcaaatcctcattgcggcccggcgcctcaccaataaacatcacgcgagcgcgggggtttcccacgccaaacacgatattgtgacgcgactggtagagctggcagaggtgacaatcgcccagaacggcctcaatttcctcgagtgcgacctcacgtggtgcctgatgggtatggccggggatgtgcatgacgcccatagcggctcctacacgtagaccttgtcgagacgcatgccaaagccgcaggcgacctcgtagttaatcgttccgcgcagtcgggccatctcgtccatagtgatctcggcatcgccatcgcggccgacaatgatcatctcgtcaccatactcggcctcgggaatctcgtgtgccgggttggactgaatggcgaccataaactggtccatgcagatattgccaacctgatgcacacgctcgccgcgatacagcacatccatacgattggaaagcgtacgcgataggccatcggcataaccgatcggcagcgtgcagatctgaacgcgcgtacgcggtacgcggtaggtaaaaccgtagcccacgccctcacccatcgcagggtgtgccacgcgcgtcacacgcgcatggacgctcataacgggatcaagctgcatcacgcggccactcagctcgcacggctgcatgccatacaagccaacgccggcgcggatcatatcaaaatgcatcgaggggtcaagcatcgaggacggcgtgttggcgcagtgcacgataccgcactcaaaacccgcatccttaatggcctgaacggcctcggtaaagcgctgacactgcagcttgtagtcccagcccgaaggttcatcggccgtggcgaagtgcgtaaatacgccgtcacactgaataccgcgatggaaatttataccgcggacaaagtcgagcacctgcgtgtagtgaacgccgatacgattcatgcccgtctcgatggcgagatgatacttgcccactttgcccgccgcgacggcacattcgccatacgcaagagcaaaatcagacgtatagaccgaaggcatgatatcaaactcgagcaacgtcggaatggcctcgataggcggctcgcttaggatgaggatgggtttcgtaatcccgccctgtcggagctcaacgccctcgttaaccgtcgccacggcaaacatgtcggcaccggccgaatacatgatcttggcgcactcaacagctccatgaccataagcatcggccttgaccacgcagcacaggcgctgacgtggattcagcaagttcttataggccctcgtgttgcgacggagcgccccgcggtcgatctcgacccaggaccagcgcgtcaaatcggctttattcatgattagtcatccgacccttcgtccatgattcccagatcttcgagcgcatcctttgccgccagttccatggccggaccgatcaagtcgataagatcggtcgcgatgacgctcttctcaccatactccgtcgccgcggcaaaaccggcgtagctgtgaagtgcgacggcgtacgaatacagcagctcccaacgatccatctcgtcgcgcatggtggcaagcgtgccggccaaaatacccgcgagaacatcacccgaaccggcagttgccagagaagccggacccgagagcggcagcagcacacgctcaacgccacagatagccgtcgtcggccccttggcaatgaccaccagattgtcagagcctgcagcccagacaaccttctgcgcggctgcaatcgcagtaccaaggtcgttcacctcgtcaccggcaaccagacgcgaaagttcacgatagtgcggcgtcataaccaacggctgctcgcgacgatacatctcgggattactatcaataccgtcaatggcaatcttagcaaggcagttgagtgcatcggcgtccaagataagcggcacatcaagctcgagcaagcccgaaaccacctgcatagcgccggcagatgtcgtcataccgggaccgcacagcacacagctgtacttctttgcaatctcgcacacagtcatgcgcgcagcggcgccaaaggagccgcgggaatcagacggaatagcaaagacgggaatcgaaggaagtgccatgcgaataagattggcgcaggcgtcaggagccgcgactgccacgtaaccagcacccgcgcgagctgcagacttggccgccataatggcagcaccaggatattgcgcagatccggcgacaataagcacagagccacgggaatacttatcgatattcgtaggtagtggggcaaagtaatcaactaagtcaccgggctcgacaatctcggcggcgtggtcgacatcatcgatgacctcgtcaagacggtcgtaaagattgccgcagatcaaatcgccagcatactcagggccatcagcgctatacagaccaatcttgggcgcaatcatcgtcaccgtatgctcggcacgaatgcagtcgtcatcaacaacgcccgtctcggcattcaggcccgaggggacatcaatggatacgacacaatcggcgcattcattgaccgtaggaatccagatggagaacggcgcacgcagattcccgtgaaaaccggtaccaaaaatggcatcgacaacaacatcggccttatcgatcaaaacctcgagttcgtcacgcgaagggccgacgcaaacgtgcacatcgcggccggcagtacgacgagcaacatgacgtgccagagcagcaggaatctcatccggttcaaccggagaaacgatatccacgtccacacccttatggctcaggatttcggcggcaacccaaccgtcgccgccgttattaccaaaaccgaccagaacgagaacccgatcgggattgagcttcaagacctcgttggcggcaaactcacccgctagctccataagctcggccttcgaagtcccttcgcgttcgatgatatcctcgagacgaacgacttcttcggtactcaaaaccggtttcatctatgctcctagcgtatcttgcgaagcatcgcccaggtgctccgtcaatgctgaattctgcagctgctcaagctcatctaaaacagagcgagcctctttaaatgtctgcgcaacgcgtttcttggtgctcaccttttcctcttttggcttaggccgagcatcttcggtaatcgcgatggcattcgcaacggctaagtctcctgtaagcgtaatggaaagagcaacctcaacaacacccagctcttgagcgatctcgagtgcacgacccgaaagcagcgccttcggtttgccgagtttatcacgcgttaccgaaacatccttgcgacccacgccttgactaaaacccgtgccgagagctttaagcaccgcctcgcgcgaagcaaagcggctcgcatagtgagcggcggggcgcgatgatgcatcgcaatacgcacactcttcttcggtaaacacacgccgagcaaacgacggcgtcttttcaagaattgatttcatgcgggaaatctcgacgatatcaacgccgataccagcttcagccatgttcacctccatatcgcacagactaagttattgtagcccgttcacagaagatgcgacaaacgagggttataaaacacagctactatgtgagacaaaagcccgtaaacgcaaaaaagggggaggccgcgaggcctcccccttccaagttcaagcgtacggctcggtgccgtccaccggtcagcggcgccctggcctcccacgggctgacccagcggtcggcggggccattgtggctcttgacagcggattgggtcatatgagcgaacgggccgcattcggagcaagacgacgccgcgggtagagaacggacagcgagcgggtcgcatttgaggcaaggtgacgtgaaacgaaagggcgctgaccttctggtcgcgcccttgaagttgaacgtcagattgtccaaatgcggcccgcgcagcgtcgagtagttacgcggttcgtagaaccgcgtaactaacaaatgagcatcgcgtcgccaaagctgaagaagcgataacgttcttcgatggcagcggcgtaggcatccatgatctggtcgcgggtggcaagcgcgctcacgagcatcatgagcgtggagcgcggcacatggaagttcgtgatcagcgcgtcgaccacgtgataggtcgagccgggcatgaggtaaagctgcgtcgtggcgttctcgcgcaccacgatgtcaccgcggccaagcgtatcggccccgtcctcgcggccttcaaaatagcgcgccgtcacggccggatcggacaccggcgcgtccgtgtcaaacgcgctctcgagcgagcgcaccgcggtagtgccgacggcgatcacacgatgaccctcggccttggccttatgcacggcgtcgacaacctcctgcgacacgtggtagcgctcggtgtgcatgacgtgctgcgtggggtcgtcctcctccaccaagcggaaggtatcgatgcccacctcgagctcgacggcggcaaacttggcacccttggcctcgatagcggccatgagctcaggagtaaaatgcaggcccgccgtgggagcggcagccgagtgctcctccttcatggcgtacacggtctgatatttctcgggatcgccctcgtaatcggtaatgtagggcggcagcggcacgtgaccggcagcatggatggcctcgtcaagcgtgcgcggctcgccggcggcattgcaaccggccggctcaaaacgcaccaggcggccgccgcgactatcggtgacaaagtcgacgacctcggccgtcagcaccacgggagccccctcgggcgcatgagcgccaccggcgcgatactcaatctgagcaccgggcttcaggcgcttacccggcttgaccaagcactcccaaacatggcccagcgggtcaacatcctcgcggcgcttgagcagcaacgtctcgaccacgccgcccgagcccgtcttgcgaccgataagacgggccggcatcacgcgcgtctggttgatgacgagcacgtcgcccggctcgatatagtcgatgatgtcacggaagatgcggtgctcgacggtgccgccatgccctaacggcgttcctgtctcggagcctttgcgatcaaccaccagcaggcggcaggagtcgcgcggctcggcaggcgcctgggcgatgagctcttcgggcaggttatagtcaaaatcatcggtacgcatagacacgtcggattctccttatatagctaaagtccgctctacatcctagcaggctgacgtcccaagtgaactactttttggcggctttgcgctcgtcgcggatgcgggcgcggtccatggccgcctcgacggccgagaaacggcagccgcagtagttctgccgatacatgcccagctcgcgcgaacgacgtgtcgcctcggggtaatacgtgcgaaaatcgcgaatcaccggagtgagaccgcgggcagcagccagacgctccaacacatcattgcaggtttcgaacaactggtacggcgagacggcgagcgtcgtgcccacaaactcaaacccgcgctcctgggccacacgnnnnnnnnnnnnnnnnnnnnnnnnnnnnnnncacacggcacgcctcggccagacgcagggcatagcatgagcgacagcgacgggctcgatcggcgcccagcggggccacgccggcctcccagcgctcccggtcctcccccgcctcgataagctcgatgtcgccatcggcacaccaccggcgcagctcgtccaaacgccgctgccattcatcgtgcggctgaatattggggtttgtccagcagattgtgggctcaaacccttcctcgcgcagcaggcggaccggctcaagagagcacggcgcacagcacgcatgcagcaacaacggcttcatcgacatctcctcacccgaaaaagcgcacgccaaaggacgtatcctcgcaggcgacaatgcggcggtcgcgcaaaatggtccgcacgtaataccagtcgcccacacagcccgacaaatgcaagccggccgccaggtagcacagcagcggatagcccgaaaacgcaaaccccagggcaagcgccgccgtcacaacaaccgtcggcgccaggcaaaccgccatgtaccgccggcgcgaatacacaacgccctcggcgcaggcatagatcatcgccgtctcgcgattcgccccaaaggtcaccttcgcgcccgcaggcgccagcagcttaaaaaacacaccgtgcaccagctcgtgcacggcgaacgacgccattgagatcgcagccaagccgactatccagcccacgacagccatccagccgcccgcgtcagccgcatccaagtctgcaggcccacccagcaacataaacaccggcaccaagcacacggcaaacacgccgactacgaccatcccccacacaaagcaagcgtgcagaaaatcctcgtcttcaaacgcatgtatgttggaaatctcattcatagcatcttaggatagcgcccctgccacgtacccgtccgcatgtgcgataatgtcgaacgatatgcacgaattgaccaccgcgtcgccaggccttgcgcccggccgcgctctcaccatatgcgaaggagtcccatggcatccaaatactccatgaacgaccgtcccagctggcctcgccgcgccatcgttaccgccggcgagccctacggcaacaagggccttcactttggccacgtcggcggcgtctttgtccctgccgacttcttcgcccgcttcctgcgcgaccgtctgggccgcgagaacgtcatcttcacctcgggcaccgactgctacggctcgcccatcatggagagctaccgcaagctcaaggagaacgagggctacgacaagtccattaacgagtacgtcgagtccaatcactcccgccaggccgcgaccctcaacaactacaacatcagctgcgatatctacggcggctcgggccttgagccggctgcgcagattcacaacgaagtgaccgccgagattatcgagcgcctgcatgagcagggcaccatctccaagcgctccacgctgcagttctacgacgccaaggccggcacgttcctcaacggccgccaagtgatcggccgctgccccatccagggctgcaagtccgagaaggcttatgccgacgagtgcgacctgggtcaccagtttgagcccgaggagctcatcgcacccaagagccagctcaccggcgaggtgcccgagctgcgcccggtcgacaacctctacttcgacctgccggcctacctcgactttatgaagacctacaccgccaagctcgcccagaacccgcaggttcgttccgtggtctccaagaccatggaggagtggctgctgccggcccagctctatatccaaaacaagttccgcgaggccttcgatgccgtcgaggaccagctgcccgagcacaccgtgctggagcccgagggaaacaagagcagctttaccgtcaccttccccagctggaaggagcgcgacgacgcccatgcggtgctcgccaacggcggcgtgcgcttccgcagcggcaaagcgctcgtgcctttccgcatcaccggcaacatcgactggggcgttccggtgccccaggtcgacggcgtttccgacgtcacctgctggtgctggccagagagcctgtgggcgcccatcagctatacgcgtaccgtgctcgcgcgcgatgccaaggccgccggcgtgaccgagggcgtcgccgcccaggatgccgccctcatgggcgagcccgctgccgactccacacaggtgcccgcgcccacctaccagcacagctcgctcgactggcgcgactggtggtgctcggacgacgcacagatctaccagtttatcggtcaggacaacatctacttctactgcatcgcgcagaccgccatgtgggaggccctgggctgggacctcacgcagagcaccgtcagcgcctgctaccacctgctctacatgggcaaaaaggccagctcgtcctcgcagacgcctcccccgccggcagacgacctactcaaccactacacctgcgagcagatgcgcgcgcactggctgtcgctcggcctgtccgaaaagccggtgagctttagccccaaggcatacgacacgcgtgtgaccggcaaggacaaggacggcaacgaggtgcgcgcctgcgacgacaagcgcgttatcgatccggcccttaaggagagcgcccttttgaccggcgtattcaaccgtctggcccgcagctgcttctacggcgtcgccgtcaaggaaggcgacgagagcccctatcgcaacggctgcatccccgccggtgccgcctctgccgccgtggtcgaggctgccgagcaggcagctcttgcctttgagcaggccatgtacaagttcgagacgcaccgcgcgcttgccgtgtgcgacgactacctgcgcgccgccaacaagcgctggagcgacgcctccaaggccgccaacaagctcgaggnnnnnnnnnnctcgagggcgacgaagcaaacgcagcgatgacgcaggccctggttgatgcctttaccgagctgcgcgtggcgaccgtcctgatgcacggtatcgtcccggccggctgcgaactcatctgcgagtacttcgacgtcgatccggtcgccttctttagctgggataacatctttgcctccacggacgagttcgtagagagcctgggcgagaagcccggcgaccaccgcgtgaagccgctgcccccgcgcttcgacttcttcagcaagcacgagagccagtactaaagcacgctagtagcaacgcgcccgggaatgattattctgggacggggattaaaaaatcattcccgggcgccacagtacagtctttttgtgacgggagtcatggaatgattatttaatccccgtcccagaataatcatttaggtggaaggaaagacggatgtccaagcagcgtcgtcgtaagcagaaaaagcaggttaagcccgagctcaagctcaggcagtttgccgctaccgagctttccgaccagcttgccgcccttccctgcgccgccgacctgccgcgctttatggtcgacacggtcgccggcgcctatgcgcccgccgatgccgagctcatgatcgagggcttcggcgccgcggccacacgcccggtcacgctgcgcgccaacacgctcaaggcgaccgccgaggacatcgctgcggcgctcggtgccgccggcatcgcccacaaccccgtcgcttggtatccggacgcctttatcctgcccgaggcccaggtttccgacctatgggacctcgacatctaccgcgacggcaagatctacctacagagcctgtcgtccatgatgccgcctttggtgttgggcgcccaggcaggcgaggacatcctggacatgtgcgcagcccctggcggcaagacgacgcagatcgccgccctcacccagggccaggcacacctcacggcctgcgagatgagcattccccgcgccgaaaagcttgagtccaacctccaccgccaaggtgccaaaaacgtgcccgtcatgcgcatcgacgcacgcgagctcgacgagttcttccgctttgaccgcatcctgctcgacgctccctgcaccggcacgggcaccgtcatcagtggcaacgagaaaagcctgcgcggcctcaccgagcagctgctcgtcaagtgcgcccgctcgcagcgcgcgcttctggaccgcgccatgggagccctcaaaccgggcggcacgctcgtctattccacctgttcgatcatgccgcaggaaaacgaggacgccctgcaagaggccctcgacaagcacatggattgcgagcttatccccctcgacggcacaccgagcgaaagtgaagcgcgtcgcgcccaggatgccggcgaggagccgcatatcgagtgcaacgccctcaccgaggccatcgccgccggccatgtctcggccatcgccaacggtatgcccggcacgctgaccattccgcctagccgcgattttgagggcttctacattgccctgatccgaaaacgcagctagcgcacggatcaaaaactcaacaagctatctctgtgcgcgtttgccctgctggtcgcgatgctgtttaagcatcgcgcgctccttgcgttcggcccttttgcccttaatggccgtgaccacaaagtagatgaccgcggcggcaacgattgcgcccacgcacaggccaatcgagccaaacattgctgtcaattccataccgcgtcacctctcttttaaacgggactttcaagatagcacctcgatcctcgccaccacagctccttcacgttctcccgcccttcggtctaacggatggtgcggcggggaaaaatcaactcgtcaaacgatttagcattcgcaattccggctgcatcgcgccggccaccatcgcatagaatcgagcctccatggataccctcaacgacctaaacgaacgcgtcgacgcctttgtcggcaccagctccttcgacacgcctgccgcggcaaacgaccaagctcccatcgatgtacccgccgaggttcacgaggacatcgtcgcctcggtcgatttctccgaggtcgagctcgcagacgagttcaccgagccccaggtagccgtgacccccaacggactgctccccatggagcccctgcccatcgacggacgtctgcgcaaggctgctcttcgcatgcccgacgagatcgaggaggccagcggcttcacgctcttcggccgccgcatcaagtcgctcatttacactaccgatgtcgcggttatccgcaactccaacgccgatgccgtttttgcggtctaccctttcacgccgcagcccgccattacgcaagcgctgctgaccgtcgccgagtgcccggtctttgtaggcgtgggcggcggaactacgaccggtaagcgctccgtgcagatggcagccgtctccgagatgcagggcgcggcgggctgcgtggtcaactcccccgctactgccgagatggtcgagcacatcaccaacatcgccgacatccccgtcatcgccacggtcgtacgttgcgacgacgatgcgcatgccaaagtgcgcgccggagccaagattctcaacatcgccgccggcaaaaacacgccccaggtcttgcgtgaactgcgcgagcactatcccaacctgccgctcatcgcgccgggcggcaagacgcccgagagcatccgtgagaccatcgccgccggcgccaacgccatcatctggacgccgccttcggcacagcagctacagaccgacatgatgcagcgttatcgcaagatgaaggaagaagccacacctgtcatctcgcgcgacgatgtgcccattatcgaccaggtcgccgccgccgaggtcagccaggtcgagaacatgaatcccgatgtgccgattcccgacgaagtcatcgagcgcgtcgcttcgatccacgagcgcgtcgaggagcatcgcgccaaccgcggcctcaagccgtcactgcacggcttcttcttccgcggaaagaaacgctaatcgtaacagcaaggcccgccccacaaacgtgaggcgggccgttatcgtttgagcaatcatgcagcgacgtgatggggcaaattaatccacgcgcttgtcgcccataaagaagagcgccaccgtaccaggtccggtatgcgagccaatcagagtaccgatgtcattgatctcaatcttgcctttaagctgcggaacctgttcctcaatcagcgccgcaactgcctcggcatcctcgcggcacgccgagtgcgacatgatgcacttacccgaataatccgcaccgtcctgcacgtgtgccatcatggtcttggccatctcggaaatcgcgcgcttcttagtgcgaatcttctcacgtggcgacagcttgccgtcgcaatcgaccgtcataagcgggcaaatcttaagcgccgtgccgatgatcgcactcgcagccgaaatgcgaccgcctcgtagatagctcgacagatcggtcgagaagaaccagtggtgcaggttgagtttgtgctcctcgatccaggcagccgtctcgtcgagtgaagccccgctatcgcgcacgttggcggcatattccagcaacaggccaaagcccgaagacgccgccagcgaatcgatgacgcgcaccttgccgccctggggatagcgatccgcgagcatctgcgccgcaacgcaggccgatccatacgtgcccgaaatacccgacgacaacgccaggtgcagcacgtctttaccctcggcaacaaacggctcccaaaactccttgtactcacccacgctcacctgagacgtcttgggcatggcgcccgcggcaatctgggcaaaaaacttgtccggcgtaatcgactgatacagatcgtccgtatggacaacatcgtcgatctcgtaatgaaaacacacgacagggatattgcgcgacgcaaagaactcacgggttcggtcggcggcggattcacaggtcaggacaaaatcactcatatgaggctccttactcattgctgcgcaaattatcgcacagtgagcctacatacggtacatatgtccactatttaccaaatcgaaccaaaaatagcgaacatctttaccaccatcgtctccaccggccccacgcataaatatctgagaaaacaccttctgtcgtctccactcaaccgccatatccacctcaactaaatcgatttaccaaaccgttcagccgacaattcagccgccggcgcaaaatcgaaacaaaagcggcgcatactgataaacgtttgacgctgtttatcagttttaccagccccatcggaaggtgtttcatggtcgcattcgatcgcaacccgcaagacttcaagtatctgcgcctgctgtcgagacagttccccaccgaacaatccgcgtttaccgaaattatcaacctctcggccatcctcaacctacccaagggcaccgagcattttatgagcgacgtgcatggcgagtacgaagcctttatgcacatcctcaacaactgctcgggcgtcgtgcgcgagcatgtcgacgaaatttttggcgacacgctctcctttgacgaaaagggcgagctgtgcacgctcatctactacccgcgcgagaagatcgacctggtccgcagccagcgcgaggactcgccaacttggtacaagacgatgcttgaccagctcatcatggtcgctcgctcgctttcaagccgctacacgcgctccaaggtgcgtaaggccatcccgcgcgactacgcctatatcatcgacgagttgttgcacacgcacccggacgagaacaactatcgcgtgcgctatcacgagcgcatcgtggagtccatcctggagaccgccagcgccgacgactttatcgagtcgctcgcctcgctcatcaagcgcctggccgtcgaccacctgcacctggtgggcgacatcttcgaccgcggcggcggcgcggccaagattatggaccgtctgctcacctaccattcactcgacatccagtggggcaaccacgacctactgtggatgggcgctgcggccggtgagcccgcctgcatcgccacggtgttgcgcaacaacctacgctacgacaactacgagatcctggagaacaactacggcatctcgctgcgtgagcttgtcgcctttgccgatgccacctacaccgccggtgagtccatcaccccgctgatcaaggccatcaacgtgctgctctttaagctcgagggccagattatccagcgccaccccgagttcgatatgaccgaccgcctgttactcgacaagatcgaccacgacaccggcacggtcacgctcgccgacggcagcgtgtggccgctcacgaccaacgacttccccaccgtcgacccggcggacccctacacgctcacgtctcaggagcagcacatcatcgacaagctcgtgtccgagtttgtcaccgccgatcacctgcatcgccatatcgatttcctctacacccacggctcgatgtacaaggtcgccaacggcaacctgctcttccacggctgcgttccactcaacgaagacggcaccttcagcagcatgaactgcctgggcacctggcacgctggccgcgattatctcgatttttgcgaccacatcgcccgccgcgcgtggcgcgtgggcgaccgcgatgccctcgactggatgtggtacctgtggattggcttcaattcacccgccagcggacgcctggtgcgtacctttgagcgcgcctatatcgccgataagagcacctgggtcgagccgatggacccgtactttacgcttaccaagtcgccctcggtctgcgatgatatcatgcgcgagtttggcgtcgcggccatggcatgctcgccgaccggccacatcatcaacggccacacgcccgttaaaaccaccaagggtgagcagcccatccgcgccgagggcaagctactggtcatcgatggcggcttctgccgcgcttaccatcccaagacgggcatcgccggctatacgctcatctcgagctcgcgcggctgccgcctcaagtcgcaccgggcctttacgacggttgccgaggcactcacgcgcaacgtggacatcgagagcgagaccaaccgttttgaccaagcagaccgtcgccgcatggtgagcgacaccgatactggcgccaagattcgcagccagatccaggacctgcgccagctgctcgatgcatatagaaacggtgctatcgaggagcgcgcctagcaccacccgcggggattggctaaacttgctaagtttgtcatccccgcggcgcttcggcgccagcttaaggcaggtaccatgcaaaagctccttgcgcagattatgaaatttggcgtcgtcggtgtcattgccacggttatcgactttggcattatgaatctgctccactacggtctgggcctcaacatcctaatcgccaacaccagcggctttatcatctcactcatctttaactacctcgcaagcatgaaatacgtgtttgcgcacaaggaaggcatgagccgccgccgcgagttcatcatctttgtcgtgctgtccgtgatcggtttggtgctcaacgatggcatcgtgctggcgctcaacgccggcctgggactcgaggccaatatcgccaagatctgtgccaccgcgcttgtcatggtctacaactttgtgacccgaaaaatcttcctggagggcgacgagacaaaatagctcgaaacccctgtagcattacggcgcccacggacgacgcgcactcagcgcagtatcgtccgtgggtgtcgctcgtttacgggcaaattttcaacgtttgcggattagctcttgaaaatttggcgagttcatatagttcttggcaaagaccttacgtttcccttgtaaaagctctaaagtatcctctgctcgattcatcaacgcattggatgtgattacgtgcgcaaggcgctggcacaacctcataccaagcagttcctcaagtttgccgtcgtgggtcttatctcctttggcatcgactggggcatgctcattgcgctcgtcgagctgttccacctcgactttttgatgagcaccacggtttcgtttatcacgtccgtcgtggtcaactactggctcagcatgaagtacgtgttcgaccaccgcgaaggcatgagccgcaagcgcgagttcacgatcttcaccatcctgtcggtgatcggcctgggcctcaacgacctgtacatgtttgtgggcgtcacgtttttgagcatcggctaccaggccatgaaggccatcgccacattcctcgtcacctggtacaactacttcagccgccgcttcttcctcgagggcgcacggtcgtagtcgattcactatttgcttgaatgtataaccggttggaattcccgttccaaccggttttttgtttgccgagagacccggcgatccagtcccattcgcatgaaaaacgggcggctcggatgttggtccgaaccgcccgtctggcgcgctatgtcgaggcctctagtctgtaacgtaataccagactacgttgtcgccgtttgagagaacgtagttactacaggccgtcatgggcgttgtgccgttgacggaatacatccagccgctcgtgccgccgtactgtttctcggccaaaccaccaatcgcagaaacatacgtgccgtacgatgagccgtgtgcgttgacagaaaggcccagcgcgcacagggcatcgtagacggtagcaccttcgttaaaggtaaaggtgccaccagaggacacaggattgtccacagcgctcgatgtgaccgaaaccgtcaccgtaacgtagttggactcctgtgagccgctctggccgcccgaggaggcgtttccaccattagaggatgaggctccatcagacgactggccaccgcccgaagaagcaccgccagacgcattggaagtatcactggctcccgtattttgggcagcggatttatcgccagacttcttgccgccccggtcctcggacttcttgctatccgagtttttgtccgattccttgtttgaagactcggaatcgtccttgtcgtcgttcgaacccttggactcatcttttgcgtcattcgatgacttggaatccttggaactggcctcgcccgaagtcgtagtcgagccagacgccttggtgtccttggtgacgacgctctcccccgtcacggtctgaatgatccagtcgatggaccaggcaccgcttgtggaaggatggacgaaacccagcgagacgacgatcagaatggtgcatgcagcagtcagaacgccgaggagcgccttgcgacgagaggtggacgccgccgaagcggtgcccttttgctttggatcatcgagctggataaacgaggagtcgggctgttgcccgctggtctccttgggcttatcgggcattaccgtcacccttgccgcgcttggtcagcacgaagacggcgatgagcgcgaggccaatcacgccggcggcgatgccaacgatggcgagcggattggtgccagtctccggctcggaagcactagaggacttcttagcagtggtcgtggaaacagcacccgtatcggacttggaatcggacttcttgtcggacgtgccgtccttcctgtcagacttcttgtcagacttcttctcgtccttcttatcggacttatcggagtccttcttgtcggacttgttgtccctggtctcggtcttggtcgacaccgtcgtcttggtcaccggcttctggcccggggcaataacgccgcccttcgagccggagccagaaccagcgccagcgccagtgccggaaccagtaccggtactagaaccgccgccgccattcgaaccaacgccaccgttgccaccattagcgccagaaccgccattaccgccagggttaacggcattcttggtccacttggcatacaacgtcaggtcggccgtcaccggcgtactgaagtcatacgcctgcgcgcaagtctcatcggtataccaaccgccgaaagtgtagccatcgcgcgtcggatcggctggcttgaccagcttgccatcggccgtagcaacaaacttagtattgcaagcagacccgccgttggaattaaagacaaccgtccaagactcaacggccccaagcttgaacagcgtgcccgagtcattgatgtagtacaggttgccagatgcatcggcaatgaccggagagtcacagtgctggtaatggccagccgcatcataaatctgcgtcgcctctgcatcaccgagcgtatagcgatacacgccaccaccagcagagtagttgacgtaatccttgctatccgcgctgttaacggtgaagtacacataggtcttgccaccctgaacactcaccagcggagtagcagcaataccgttaaatccggccggcagttctttaccgtcagcagcggtgaccatcgtggtcttaccggtcttcagattatagagagccagagcagagccagtagccgtctgtccgccgacaatcaagttttcgccagccaccgccggtgcgctcatgttattagtaagacccaggtcgaccgtcttctgctcgctcagtacgcccttcgccgaaagcgaaatcacatggagctttccatcgtgcgtcatctgatagaaggtggaaccattggacggatcggcgacacagtcggcgttcgcgagagcgccgagcttcatggtcgaaacgacatcgcccgtcgtcttatcaatgcacttaagcgtgcccgcgctcgtaggaacgatggcatacttatccgtcaaagccgcaccagtccagtaataaccctcggaagcgtcaatgttctgccaagaaacttcgcccgtggcaatcttaatgcgcataaaggagccgttgccgtaggtcgcgttgtaattctcgtcatacgaaatatcgaccgtaccaacatagacgtactcgccgtccgaaacgacggtgcaggagctctgcgtcaagtccgtcaaaccgggcgtcagccacttgcagatcagcttgtctgcagtaatcgcctggaccgcaccgccgttgagcggaacgatgataaggccattggtgtagatcggacgagaggtataactcaccttggaggcaagcggcgcagaggcaacctttttgcccgtggacgaatcgatcttaatgagctcgttctcggtcgcgatgtacacaaagccgttagcgatgacaggctcgctgcagttggcatactgctgaccagactcggccttccaatcgaaggcccacttaagaccggcggcctgcgcaggcgtcttggcatccgttacggtcgaaccgttgccactgttgccgtagccggcccactcggcatcccaatcaggagtcgtcgcgctcgggtccacgacaatcttgtcgggatcgggcatggccgaatcgtcggtggtataggcaagcgtaaccttatcgccgctcttgagcgtaatctgattggcgcagagtaaggagggctctccgttgatatacaggtgccaatatttattggtcgcagcatcccaggcatacggcttgtgatcgaacggcgagttgatggaattgaggaaccagtactcaccactctgggagccgttgtacgtaacgcccttggccttcaggaccgtctcaataaggttctgagccgtagagccctcgggcagggaaacattgcttgccgagccccagcgagtattgttgccgttgacatcgggaccgataacatcgacagacccaagaacctggccaggaagggcatcggcgtcagcaccatacataaaggtgacggcatcgccctcttggagctcataggcaccggcgccaacgtcggcgaacttgccatttacatagaagcgccaatagctattagtcgcagcatcccagccataggacttactatcgaacggcgaagtaatgccgttgaggaaccagccccaagacgattcgccagcatcgagagtaaggccggtctgctcaaggagatccttggcagtagagcccgccttgagactcgtctggcccgtcgaagcccaaacctgctgcttgccgtccttgtccttaccaaggacctggacggaagcatggacggaatcggacggcaacttatcgccccagccaccgtagaaccacgtaacggtatcgccagcatgaatggtgacattgtctgccgtgtagtcgctcgacttgccgttgatgaacagctgccaataggtcgaataatcttggggcgtacccagctcaacaccgttgtacttaaggctcagaatgaaggagccagcagcaacggcgtcgatgtcattcgcctcaagcgcgaccttcgtaaggtcaagtgcgctcgaaccggacgtcaccacatactgcgcgttatcgacccaagtctgagtcttgccctgggcatcgcgaccaatgacggtcacatttgcggcaacctagtccttaacgacaggggacgcgctaccagccgtataggcaaactcaaccttctgcccctgggtgagcttaacgctgctcgcgccaaccgaggaagacgcaccgtcgacgaacagctgccagaaggcataagtcgtcggatcgaaggcaagcgtacggccatcgctcggggatgtgatgcttttgaggtagaaaccgtatgccgtgttcggatcgtagtctgccttgaagcccgtcttctgctgcagcttaacgaaggcatccgcagccgtcgcgccctcgtcgagcttgagctgcgtgggtgccacccaggtctgagccttgccgtcggcatcggtgccgataatcgagaacgagacctcgacttgcttcttggcgacatcgccggtttctgtcgggttctctgtctgaacggcagccgcggcggcagatcctgcttggccagcggatgccgctgaagactgctcgctcgcggcagggctctcccccgtcgccgagccttcgtcgccagttgctgcctttgatgcggcggcactagctgcaggcgcgctcccagaatccgaaacctcggcgccgctctgctcagcggcaccgcccgcaagcgctgcgtcctcgcccggcgtcgtagcctgagccacagcctcggcaatgccctcggcgccctcggcccacagctgagccggcgtggtgctgaaggccatcgcgaaggccaggaatgccaccaggcagcgctttgccacgccgcgcgcgattacgccacggcgacgaagcgaggcacgctggcactcgtcctcaaacatatccatttgtctcctattgtctgtacttggagcgttgccttgaagctgccccacgtcatcgcgcatgttgcgcccgagttcccccatcggggtcccccttccctccagagccctatgcacaccggcggcatacgccgcagccgcatgcaagatgggaggcgatccgacttaaccttaacggctcaggcgcgccgtccgatctgcgacgcgaacatcccgagccaagaggaattacggttactggtacagccggggacttgcaccccgattcccccaaacgcgcaggaaaaccgcgcattcgtgcgtctccgcaccaccatctaggccatcgattaaaaccgtcaatatgctatcacgcaaaagggcctcgcacgcaggcgaagcccaaggtaaaagctattgtttgcgaaaggaaaatgcggtgacggtcgcagcctctagcgcttgccgccgtggctgttgagccagatattgcggcccagcataagcgccagcaccagcgcgctcacgtagcccataaagccaatgaccgggataccaaacacaaccggctcgatgcgcgcgtagtacaccaccgacgaaccgataaacaagccggcgataacaatagccatcgacatgcggtcgataattccacccagctgtcgcagcgccttatcgctgctcatgatctgcgtgttcaccttaagctggccgcgtgtgagcatgcgcgaagccaagcccagatactcggccgcctcgagcgagcccttcgccgcgcgataactgctcgctgcaaagtcgcggctcatctcgcgcatgcgggcgtaggtgctcttctcgtttttgatgtgcgtctggatgatctggatcatgttgacgttgggcatgtactcggtcaacaggccctcgagcgtcaccatgccgcgggcgaacatcgtcaccacgctcggcagctcaacgtcatttttgcgcgcgaggtttaacagcgaagtcaaaaactcgccgatatctaggtccttaaggtcaaggcccgcaaagtcagccacgataaagtccaaatcggacaaaaaggccgaatgatcgagctcagccgagtcgccacgcgtcacggcgaagcgcatgagcgaatccttgagcttgggcacgtcgccctcggccacggcgaaaatcatgtccttgacgataccgcggtcgtggctcgacatgcgtccgaccatacccaagtcgataaagtaaacgataccgtctttgaggatgatgtttcccgcatgcgggtcagcatggaaaaagccgtcatcaagcacctgcgtcgagtagtcctcgacgattgcggcaccgatcttttccaagtcatagccctcggccaccaagcgttcaggatcggcgatcgaaatgccgtcgacgtagtccataaccaccacgtgttcggtgcacaggtccagataggatttagggcacgtcacgccatgaacgctcttatggaactcgtagaagtcgttgaggtttttggcctcggccaaaaagttggtctcctcgcgaaacgaggtccacagctcctcgaccacgccgtgcaggtcaacgaattgatcggtgttgacgaacttggaaacgatacgcaccaccgagcggatgatatcgatgtcctgcgccataacctgctgcgcaccggggcgctgcaccttgacggccacgtcctcgcccgtcaccagacgagcgcggtgcacctgcgcgagcgacgcgctaccgagcgggttggggtcgattgcatcgaacatctcccccaggcgcaggccgtattcttcttccagacagctgagtacgacctcgtacggcaccggctccacgtcggagcgcagacgacgcagctcgtcgcaaaagcgctgcggcagaatctcggaccggttggccaaaatctgccccatcttgacgaacatggggccgagttcctcgagcaggcggcgcaaacgaaccggcgtgaggttatcccacacgcggtactttttgaccaggcgtacaatctgcccaatgcgttcgcgacgacccgccggcgtgagctggtattcctcgtccggcgccatcgcgtcgggctcctcgggcaccatatcgacggcgcgcggcttcttgcgagcgcccgagacggcggcgtcgacctcatcgacaaccgccgcctcgtcacccaagggatctagattgttgtaatcggtggtggaatctgccatctgcgctgctactcggcctcttcggtatccttcgcatcgtcgggctcaacggactcgacgggcaccgaggtcacgttgtcctcgaccgaatcgacgatgtcgcgcacatgggccaggaaggcagtgcgctcgggagcggtcatgacgcggacgcgggcaaggataagctcgtcaagcacgcgctgggccgcggtctcgccctgcatgcccagacgctcggtcaggtcggagatggtgccaccggcctgctcgaacatatcggacacgctgcgggcgatatcgggggtggcggtgtccttgcggacctgctcgcccttggtgttaaggtcgtcgaggaccttcttgccgccttcgacagcaacggcggcagcgccaaagccaacgttgatggcgccgttaacaagctgatcgagtttcataaccatggttgtctccaatcataaacaactgcattggcgttcttgtacccaagatcgagtgaaagcgacaaagcgttttagcgctattcgatcgacgggaaatccctacctcacgttgtcgttcatcgcgaaagagttcttcatggcgcagctcgtggtgtagagcaccttgcccagtagagcatcggtctccacacgaacacactcggcaaaggcctcattggcgcgtgcaagctcggcaggcacctcggcctcaggcagagcggctacggtagcatcgacgtcatggatctgcttgtggcccatgccaccgaccttctcctggtagtcctccacagcgcggccgcactcatggaaacggacgtcagccagggcgccgatcaggcggttggcccagtagaagttttcggacgtcacgcgagcctgcgtgtcggcatagtactcgggcatggtctcgacgttggcgtacagcggaaccagcgcgttaaacgagttggaaccaaaggccatccactgcacggcgcgatacgccggctgcgcataggggcgcagctgcagcacggcgagctggctgttgcggttgatgccgatggggcgataagcgccacgcgtggcgggcgtgcccttgctgccgtagcagtcgtactccgtgccctggtagtggctcgaaagcacgtacttaatgtcctcgatggtcaccttgcgctcgggcacgcggctccaggggatatcgtcgctctcgggcgtgtagtcggcgtcggggccatcccacacgtcactggggttgaggcagcgctgcatgtaccaggcgcgcggcgtgttgtagacatggtcgctgtcgctgtgcgagccaaaggcctcgcgcgggttaaagaccgcagccggaccgtcgccctcaacgcccagcgtcaggtccaaatgccactcggccatccaggagcgcaggtcggcggagcacatgtggtcggcctgggcgccctcggcgtcatccaggtcaaagctgtcgatacccagctggttgggcatggtcacataggcgtcgtcaggcacgcgctttgcgatccaatggtgaccgccgatggtctcgagccaccagatctcgtccacatcactaaaggcgatgccgttgttctcgtaggtgccgtagcgctcgagcaggtcgcccaggatacgaacgccgtcgcgggcggacttggcgtacggcaggaccagggtcaccatgtcctcctcgcccaggccaccgggctgtgccggaacgtatccatcctcgccttcgttgcccctagcgggcacgtagtccacaagcgggtcggcgccgcggacgcgctcgttggtggtgagcgtctcggttgcggacatgccaacattgagctcgttgaatccggcctcggcccaaataccgtgaccgggaacgacgtcggggacgctcgtgtagcgcatgggattgtcgggcaactcaacggtcaggtggctcaggacgctcgtgtagacacgcggctgctcgtcgggatgcaccacgcgcatgcgcttgggctcaaacaccccgttggacgagtcctcgttgcgggcgaccagcgtcgacccgtcgtagctcgcgttcttaccaaccaaaatcgttgtgcacggcatgcgcatcctccttgagcgaagaaatcaaacggcaacagtgtatcgcttcgacgcaaaaagggcgaaaccacggcctcggcagcccccgtggtcaaaaaatgccaaatatgagtactgtcaccaatttagtggcagcaaatttccctgtaacgagtgccgaaaatccccatttgcccaaaagcaagacaacgttattccccataagttcaataaaataggcttcctaacgataatggataccgttaggaagccaaaaagacgtaagacatatgtgactatcggtggcgcgcgcagacgtggtgtaagagtgtcctgaggtccgtcgctgcaagccaggggctcaaggccaccatcgactggtacgtggcaaacgagtcctggtggcgcccggccaaggaggccaccgaggcccgctaccgcgcacagggccagtaggaggggagagagacatggcagacatcgcattcgagaaggacctctccgtggcggagaccggcatcgagggcctcaaggtcgtcggcctcgccgtccacggcgactcgcgcggctggttcaaggagaactggcagcgcgccaagatgaccgaactcggcatccccgacctccgcgtcgtccagaacaacgtctcctacaacgagaagaggggcgtcacccgcggcatccacgccgagccctgggacaagttcatctccgtggcccgcggctcggtcttcggcgcctgggtggacctgcgcgagggcagcgagaccttcggcaaggtctacacctgcacgctcgacccgtccaaggccatctacgtcccgcgcggcgtgggcaactccttccaggcgctggaggacggcaccgcctacacctacctggtggacgcccactggtcgctggagctcaagaggacctacaccttcgtgaacctcgccgaccccgagctcgccatcgagtggccgatccctctcgacgaggccacggtctccgaggccgacctcaaccacccgtaccttaaggacgtcgtccccatggcgccgaagcgcaccctcgtcaccggctgcaacggccagctgggccgtgcggtccgcgcgctcgccgaggagcgcggcctcgccggcagcttcgactactgcgacatcgacaccttcgacatgtccgaccccgacgcctattccaagtacgactggtcgctctacggcaccgtcatcaactgcggcgcctacacggcggtcgacagggccgagacccccgagggccgcgtgaccgcctggaaggccaacgcgaccggcccggcccttctcgcacgcacctgctctgagcacggcatcaccctcgtccacgtgtccagcgactacgtcttcgacggcaccgccgaggtgcataccgaggacgagcccctcagcccgctgtccgtctacggccagaccaaggccgccggcgacatcgccgtggccgggtgcccgcgccactacatcatgcgcagctcctgggtcatcggcgaggggcacaacttcgtcaggaccatgaagggcctgtccgaccgcgtcgccgaccccgaggacgggctcacgcaggtcacggtcgtggacgaccagctgggccgccttaccttcacgcgcgacatggccgaggccatcttccgcgtgctggggacgcacgccccctacggcacctacgactgcaccggctccggcgccgtgaggtcgcctcgcgcccggtccactccgcgctcgacctttccaggctcgagtcggtcgggttccacatgcccgactgggaggaagagctgggggagtacctcaagacgctctagccgccgctattgaattgacgagagtaaatagccaccgttttttgacggtggctattcttgttggaggctatttgcgcagtggtgccaatagtattttgcgaaggatctacctctcgcttgacttggtggaggagcggccgggctgatcgttataggcgtatttgctgtacacgttgacctcccactgctttttttcgacctttgccacggaatccaggatgaatccggtcgcaaggctcagaccgcacaggaacataaacgaggcggcgagtatggcggtggggaagcgcgggacgaggccggtctgaaagtactcgataaagacaggaatgcccaaagccaggccgataatcgcgaataaaagcgcaaccagactgaagaacttcagcgggcggtagtccttgaacagcgtgccgatcatcgcaacgactttaatgccgtcgctcacggtattgagcttggactcggaaccttccggacggtcgcggtactcaatgggcacatctttgatgcgccagcggtggtcgacggcgtggatcgagagctcagtttcgatctggaagccctcggaaagcacggggaaggttttaacgaacgggcggctcatggcacggtagccggtcatgacatcatcgaagctgtagccatagatccacttgatcatcgcgcggaccagattgttgccaaagccgtggaaggcacgcttgttctcctcggcataggtgccgttggaaaggcggtcgcctacggtcatatcggccgtgccgttgaggatgggctcgcagagggctttggccgcctcggcggggtaggtgtcgtcgccgtcgaccatcaggtagcaatcggcgtcgatatcgcgaaacatctggcggcacacgttgccctttccctgacggggctcaaagcggaccgtggcgccgtgctcggtggcgatgcgtgaagtatcgtctgacgagttattgtcatagacatagaccgtcgcctgcggaagctcgcggtgaaagtcgtcgatgactttgccgatcgtgagcgcttcgttgtagcaagggatgatgacggcgatggattcagaattcacttaatgctccttatacattcaatcctagaaagtatagccgtttgggcctggcatcctaagatgtgggttagttctccagttttgttgcgcgaatcgtttgcatggccgtcgggtctatactgttcgtttgtcaacgattacgagtaaaggagttgcatccgtgtcggatcagacaaagcaacaagaaactcgcagtctgcctgcgacgtttgctaagaacgaatttgagaaggacgcgtttatccttcgtcagctggttaccaaggattttaagatcaagtatcgccgtagcgttctgggcgtcgcatggtcggtgctcaacccgctgctgatgatgatcgtcatggccatcgtgttctcgacgatttttggccagggccgcaatggctcaatgacgcccgagatgtacccgctgtacttgatcgtgggtaacatcacctttgccgtcatgtctgagtctactaaccaggccctgacgtcgatcgtgggcgctgcccctctgctcaagaaggttaaggtgcaccgctgggttttcccggtgcagaaggtgctcttctcgctggtcaactttgccttctcgctggtcgccgtcgccatcgtcatgctgtggttccgcgttatgccttcttggcacctgattctgttgccggtttgcctgctgctgcttatgtgcttctgcatgggcctgggcatgatgctctctgcccttacggtcttcttccgcgacgttatgcatctgtggagcgtcgtcattacggcgtggacttacattacgcccatcttctggacgactgactatattgcgcaaatgccgcatctcgtgcgtatcttgatgtatgcgaaccccatgttcaactacctgcagtttatgcgcgatatcttcctgttccagactacgccctcgcttatgacgtttggtatgtgcgtcgcttgggcggttcttgcgcttattattggctataccgtgttccataagtccgagcgcaaatttatcctctacatctaaggagtgctgtgatgactgaatctgttgttgattacagcgagcagcctctggctgtcgaggtcgacgacgtcaccatgatctttaacatggcgtccgagtcgctgaccaacctcaaggagtacttcattaagcttgccaagcacgagctgttctttgaggagtttagggcgcttaagcacatctcgtttgatattcatcgcggcgaggttgtgggtctggtcggcaccaatggctccggcaagtctacgatgctcaagattatcgctggcgttcttgagcctagcgagggcagcgttaaggtgcacggtaacatcgcgccgctgattgagcttggcgccggctttgaccccgagctgaccgcccgcgagaacatctatctgaacggcgccctgctcggctataccaaggagttcatcgacgccaactttgacggcattatcgagttcgctgagcttcagaactttgtcgatatgccgcttaagaacttctcttcgggcatggtggcgcgtatcgcctttgcaatcgcgacgattaccgagcccgatattctgatcgttgacgagacgctgtccgtcggtgatgtgttcttccagcaaaagtgtgaggcccgcatccagcactttatccagagcggcgacgtgacggttctgttcgtttcgcactctatggagcaggttgagcgcatctgccagcgtgccgtttggattgagaagggtgaccttcgcatggacggcccggtcgatgaggtctgcaaggcgtaccgcgagcagttcaactaggttataattacttgcgcctgacaggcttgtgcttgcttgggcgtgcggttatttgctccattagctcagttggatagagcaggggacttctaatcccaaggtcgacggttcgaatccgccatggagcaccatcgtttattaagcccagaccgcttgtggtctgggcttttttcatcttgtgtgttgctggagccgagcgcgagcaagccgctgctgtttgttggggttggcattttacttttcgagatgctctttcagcagctccaacgcgtgggcgtagcccttcaggccctctccggtgatggtggcgaagcaggccagacgggcgtagctcacctggcggaagtcttcgcgggtctcgactgcgctaatgtggacctccacagccgggatggcgacggctttgagcgcgtccaggatggccacgcttgtgtgcgtgtaggcggccgggttgatgacgatgccgtcgacctttccgtaagcctcctggatcttgtcgacgatgctgccctcgtggttagactggaagacctcgacctcgtcgaagccctgtgcggcacccgcttcctggcagatctgcactaagcgatcgtagttgtcgctgccgtagatgcctggctcgcgaatgccgagcatgttgaggttggggccgttaatgacgagtgctttcatggttgcttcctttgccattgaaaaaccaccacaaaggtgcctgccccctttgtggtggttttggttagagagcgggtgggagggtgtcgaggagggcatgggcggtgttggcggcgcagtcgcgtgagtcgatgatgtagtcggcccaggcgcggtagcgcggcatacgctgctcggccagcttgtcgatgccgtcgcgcgcggtgagcatcacgatttggctgttttggtgcagcagagggtagttctcgtcgcgcgtaaccacgccgccgccggtggagagcaccaagccgctgcgcttggagatgtcggccagcgctgccgtctcctgctcgcggaaggccgcctcgccgcacttgatgataaagtcggcgcagggcatgcccaggcgctcctcgagggcgcgatcgagatcgatgtgctcgcggcccgtgagctgggcgatctgctcgcccacacgggtcttgcccgagcccggcatgccgatcagcgcgatgttctgttcgcggcgtgacaggcgctccgttacgtccaggatcctctcgcgcggggtggctttgccggtatagcgctcgacagcttgtgccgcctgggcaacaagcataagcaggccgccgatgcaggggatgccgcggcgctcggcctcgagcatcaggcccgtgcgggcggggttgtagacaatgtcgatgacgccctcgagcgcatcgaggccttcgagcgtgcaaggcgcgtcggggcaatgggggaacatgccggcgggcgtgcagttgacgagtagggaggcgtcggactgctgcgcgatattgtcgtagttgacctcgctcgtgcgacccacgggtacgacgatggcgcccatgtctcccagcaccatacttgccgtggtgccggcgccgccggtggcaccgagcacgagggccttcttgccggcaacctcaacgcccaactcctcgaccaggcactggaaaccgaagtagtcagtattatcgccgtgcaggcggccgtcgggcaggcgcgtgatggtgttgacgttgcccatgcgctcggcgagcgggctcagctcgtccaggtattccatgacggcgcgcttgtaggggatggtcacgttggtgccctcccattcgtcgcccgtcataaaagcctcaagatcctcgggctcgcgctcaaaacgcacgtactcaagccccgccagctccttgtagatggtcggggtgtagctgtggcccagcacgcggcccagcacgccgtaggggcgggttgcggcggtatcggtcatctagagcacctccgtgtagctgccaaagtaggtgaagctctcgcatacgtcgtcgatcgaatcgagcaggtcgtcgagggccttgctgccaaagggacagtccaggtcaaagtagaacataaactcaaagtcgcgaccggggatggggcggctctcgagcttgatgaggttgatgttgagtgcgtagaagcgctcgagcacgcgatagagggcgcccggctcgttggccgtggtgatcatgagcgaggtacggttggcaccgggatagacgcgtggctcgcggctgatgacgacaaagcgcgtgtagttgttgtccgagtcctggatgttggactccagcacctccaggccatagagtgccgcgcagctgcgcgatgcgatggcggcaacatcggtgcggtcggaattggcgaccatctcggccgacatggcggtgttggggtacttggtggcgtgcaggtcgtgggactcgataaagcccgcacactgggcaatggcttggccgtggctgtaaacctcgcgcacgtcggcgagcttggtgccgggcttgacgagcagattgtggtcgatcttgaggcgcagcgagcgcacgatgtggaaatcgaactgggcgagcaggtcgtagacggcgttgaccgatccggcagttgagttttcgatgggcaacacgccaaactcgcagaagccgtcgcgcacagcgcgcataacgccttcgaaggtctcgaaaaacgcgatgtcgggcacgtcgaagagcttgcacgcggctatctggctataggcaccttctacgccctggcaggcaacggtggccgtttgagggaagggcgtgtcggaggctgcagccgtggcgtgggccttttgcgagacggtgatgcccttgagctcgttgatgtagcgctgctgctcggctttgctcatgctcatgaggagacggaacagggtgatggtctgcgcctcgtagcgctcgggcgcgcggctggcgaggttgttgagttttgagcgctcgcgggcggggtcaaagacggccttgcccatctcgatctttgatttggcgacctcggtggcaatgtccatacgctcgacaaagctgttgaggagcgtggtgtcgatgccatcgatggcctggcggatgtcagcaaggtccatagggacccctttcgtgaatcgttgtgcgggggtagttaatttgggacggggctattttagctaccctttgactgtcggcgaatcgatgggtgccagggcaaatatgaaccggtatatgggggtagctaaaatagccccgtcccaaattaactacccttggggtgggtggactaaagctgggcggcgtcctcgaggagggcgtcccaaatcgcgagggcagctgctgcttcggcaacggggacggctcgggggacgatgcagggatcgtgacgaccgtggaccgagagttgggcgttttccatggtgtccatgtctacggtctgctgctcgcggccaattgagggcgtcggctttacggccatacgccacatgacgggcgcgccggtggagatgccgcccaggatgccgccggcgttgttggactcgaccgcaatctcgccggtctcggcatcaacgcgatacgggtcgttgttctcgctgccgcgcatggcggccacggcaaagcccatgccaaactccacgccctttacggcgggaatgccaaacgcgatctgcgcgatgcggttctcgatgccgtcgaacatggggtcaccaatgcccgcgggaagcccatagatgccgcactccacgatgccgccgatgctgtcgagttcatcgcgcgcggccagaatttcctcgcgcatgcgaccggcagcggcggcgtcgatgcagggcagatcgttcgtaaggatcgccttgcggtcggccgcgcgatagaccatgtcgtccatgggcaggtcggagatgccgccgatctgcgcgacgtgcgccatgaccttgatgccacgggcctcgagcgcctgcagcgcgatgccgccggcgatgcataggggagccgttaggcggccggagaagtgcccaccgcccgcgacgtcgtgcatgttgtggtacttcaagcgcgcagggaagtccgcatgtcccggacggggcttgcggcgcagctcggagtaatccttggagcgcgtgttggtgttctcgataatcgcggcgaggggtgcgccggtggtatgtccatcaaccacaccggcgatgatatgcgcggcgtcggcctcgcgacgtttggtcgcggtctcgtcgcgaccgggggcgcgacggtcaaggaaggcctgcagctgctcctggtccacggcgatacctgccggaatgccatcgagcgagcagccgatagcgggggagtgcgactggccgaagatgcttaagtgcaagacgttgccaaaggtcgaggacatgctattcctcctcgagcgtgaccttgccgcccagtaggcggtagtggtcgaagaaatcgggataggatttgttgacggcctcggcgccgtggatcacgacctcgccggtggcgcggctcgcggcgatggcggccatcatggcgatgcggtggtcgttgtgcgaatcgacctcgccgccggtgaaggcatcgacacccttgatgatgaggtcatcgccggcaatgcgcacctgcgcgcccagcgcggtgagctcgcgggtggtggtgaccaggcggtcggattccttgatacgcagacgggcgcaatcgcggataaaggtgcggccctgtgccagcgatgccacggccgagatgacgggcaccaggtccggaatgtcgtgggcgctcatctcaaagccggcgagcttgtcggactgcacggtggcggcgttggtggagcgaacgatgcgggcaccaaagcgcgaaagcgcggcgagcacgttgcggtcgccctgtgcggagctcagcgacacgccctcgacggtgatggggtcggtgccgatggcgccggcgcacagccaaaaggcggcgttggaccagtctccctcgacggctacgctgccgggcgtgcggtacgatccgctgtttacgcggaagttcgtgacctcgggctggccgtccttggccggaatacgttcgacgttgacctcgacgccgaaggccttcatggcctggatcgtcaggttgatgtaggggcggctctcaatgaggccggtcacttgcacacaggagggctgggccagtagcggggccgccagcagcaggccggagatatactgcgagctcacgttgcccggaagcacaaaggtgcccgggcgcatgcggccgctcgtcttgagcggaaaaccgcccagaccctgtaggtcgcagccggcggcgataatctcgtccgagagcggggacagcgggcgggcgcctaagcgtccctgacccacaaaagttgcttctgcgcccagcgcgcaggcgacgggcaacataaagcgcagcgtggagccactctcgccgcagtcgagcgtgccgccggctagggccttgagcaggccaaattcaatgctcttcatggtggggtggacctggaagccgtcctcgacggtctcgatgcgagcacccagggccgtaaggcaacgcaccgtagcctcgatgtcggcgcaggtggtgttacaggcgacgtgtgtctcgccgttggcaagcgcagcgcagatgatgagacggtgcgccatcgacttggacgcgatggcgggaacggtgcccttaagcggggacggggtgatgcgggctagcatgcggatgcgtctcccttctggccgaggccctcggcaatgagttcgtggaaagtggaaagcggcgtgcggtcgatgctgcagcggccaatgccgtgcggaatcaccaggtcgatggtgtcgcccgcgcgcttcttgtcgtggagcgcctcggcaaagacggcatcggcatctaggtcgcagcgggtcttgaggccatggcgggcgcagagctcctcaatacgaccgggcagtgcagcatcgcaaatgccgtgcagggccgcggcgcgcgtgatgatgcccatgccgatcgacacgcagttgccgtgtccgagctcaaagtgctcgcaggcctcgacggcgtgtccggcgctgtgtccaaagttgagcagcttgcgctggttggtttcgtgctcgtcggcgacgaccacggcgcgcttgatgtcgatgttgcgggcgatgatgagtgctacgcgggccacatcgcggttgagcagctccagcgtgagcggggtcttttccagctcggcgaaaagctccgggtcggcgatcacggcgtgcttgacgacctcgccgcagccgtcggcgaactgctcgggcgtgagggtggccaggcaccccacgtcggcgataaccacattcggctgccaaaagacgccggccaggttcttgccggcagcaaggtcgatggcggtcttgccgcccaccgacgaatccaccatggcgagcaggctcgtcgggatctgcacaaacttgcagccgcgcatgtaggtggcggccacaaagcccgccacgtcgcccacgacgccgccaccgagtgccacgatcacgtcggagcgcgaaagctcgtgctcggccacaaactccaaaatggcaacataggtttcggcgcgcttatgggcctcaccggcctcgaaggtgcagatgctcacctcgtagccagacgcctccagactttgcttaacgggcatctggtagagcgggcccacgttggtgtccgtcacgatgacggccttggtgccgcctgcagtggcgcgcacgagcggtcccgcctgctccagcaaaaacgtgcctacatgcacctggtaggggcgtgcggtgtcgatatcgatggtaatcgccataagcttcggtcctttcgacctggcgtgataggtggtctagtgggaggcctcgtcgtcgagtgcgcgcttaatgcggtcgccctcggcaaggagattctccagatagcgctggtcgcggtccttaagggcgcggctgtaggcgccgagcgagtcgattagatggtcgatttcgaaggcgagcgcgtcggcgtcgtcgatcatgagctcggaccacatttgcgggttgaggtgcgccacgcgggtgagatcgcggtagctaccggccgaaaagccgtggtggacctgggcggtcgggctctttacgtaggcgtttgacaccacgtgcgctagctggctcgtgaaagcgatgacgcggtcgtgctcggcggcgctggtcacgctgaacttgccaaagcccaaggggcgcaccatctcgcgcacctggcccaaaagctccagcttgagcgcatcgtccaccgcgggcggcacgagcaccaggggggcgccctggaacaggtcggcgcgggagtgcgcatagcccgagtactgcgtgcccgccatggggtgcgcacccacaaagtaaaagccgtgctcgcgggcaagctcaaaggcgcgctcgcacacgatgcccttgacacccaccgtgtcgatcaccacgggacccatgatggcgtcggtgtcggtggcgtcggcgagcgcctgggcgtgcgcctcgagccactcgatgcatgcctcgggatagcaggcaaggacgatgatgtcgcattcgccgagtgtcttgtcgttgagctctccggcgacagtgcccatgctggcggccgtcatgacatcgtcatcggggtcccaggccagcacgcgaacgcccgtctgtgcatagccgcgggcaaagctaccgccgatgaggcccaggccgacgataccggcgcacttggggccgccctggttaacacgcgcgtttctcaccgtacccatgagctactccatggtctcttggcagacgacctcgcggatggctcggatgcggcgcatggtgtcgtcgaactgatcgggggtgagggcctgggcgccgtcggaccaggctcggctcggctcgtcgtggacctcgatctccaggccgttggcaccgcaggcggtcgcggcgagcgccatgggctcaacgtagcgggtgtagccggtggcgtggctggggtcggcgacgacgggcaggtgcgacaggtggtgcagcaccggcacggcgttgagnnnnnnnnnnnnnnnnnnnnnnnnnnnnnnnnnnnnnnnnnnnnnnnnnnnnnnnnnnnnnnnnnnnnnnnnnnggataacgttgtcgttgccctcgctcatgatgtactcggctgccataagcagctcgtcgatcgtgccggacataccgcgcttgagcagaatcggggtctgggtcttgccgacctccttgagcagggggaagttctgggcgttgcgggcgccgatctgcatgacgtcaatcttcttgtccaagaagacctgcacgtcgcgtggatccatgatctcggtgacgatcggcatgtcgagctcggcagacgcctcgcacagcaggtcgaggccggcggggcccatgccctggtaggcgtagggggaggtgcggggcttgtaggcaccgccgcgcagcatcgtggcaccggcggccttcacgcggcgggcgatgcggatgaggttctcgccctcgacggagcacgggccggcgatgacctggaactggtcgccgccgatcttgacgccgtggccgcagtcgatgacggagtcctcggggtggaatttacggttggcgcgcttgaacggctcggagacgcgctgcacgcgctcgacgacatccatggactcgagcaggaacgggtcgatcttggtcgtatcgcccaccaggccgatgatcgtctcgttctcgccgcgcgagacatcggtcttcagaccctttttctcaatccagctgacgatatggcttacggcctcgtcgctggcgctctgctttaaaattgcaatcatggtgtgcctctcacctcgatggataacttttgcaaaaacggcccgcatcgcgagccgtgtatatatggtgcatgagagtttatactatctgactcgcttttgccttctaaagtgggccgttgcggctcgtcttcctcggaattgcaaagctttttcttttattttgatagcccgtggtgcacttgggtataatgtcaaccgttggccctattagctcaggggattagagcgtctgcctccggagcagaaggccgttggttcgaatccaacatggggcaccatcgaacgtaagaccgtccgaacctcgcatggtccgggcggttttcttataccgacgcgacgtgatgggacgtggtatggcagcaacggatatcgagcgcggactctcaaccgccgaggtcgaggagcgtatcgccgccggtaaaaacaaccgcaacatggaactcaagaccaagtcggtcaaagagctcatcatcgagaacctctgcacgctgttcaatttgatcaacgtgatcttggctttcctggtcattttgaccggttcgtttaagaatctgacgttcctgttcgtggtgttcttgaacaccgctattggcgtcattcagtccatgcgttccaagaagatggtcgataagctcacgctgctgacctccaagaaggccatcgcggtgcgcgatggcgccgaggtggagctcgacctggaccagatcgtgctcgacgacatcatccgcctggggcgcggcgaccagattcccgctgacgccgtggtggtttcgggcgaggcgctcgtgaacgagagcctgctgacgggcgagagcgaccttattaagaaacagcccggttccgagctcatgagcggcagctttatcgactcgggcctgctgcgcgcccgcgtgatccatgtcggcgccgacaactacgtggccaaaattaataacgaggccaagtacgtcaaaaaggtcaattccgagatcatgaacgcgcttaacgccatcgtgcgctttgcgagcatcatcatgattccgcttggcctggctctgttcgcctcgagtgtaagtgggctgtgggatgccgcgggaaccccgggcgatagcgcgctttcgtggtgcttctccgagctgttggctggtcatgtgccttcgtcggcgctgctgtccacggtgggcgccctgctgggcatgatcccgcagggcctggtgctgctgacctcgtcggtgctcgccatcgccacggtgcgcctggcccgccgcaaggtgctggcgcagcagctctactgcatcgagacgctcgcgcgcgtcgacgtgctgtgcctggacaagacgggcaccatcacgtcgggtcgtatggaggtcgagggcacctacccgctgcctgttgagggtgttggctttggcgtggactcggaggaggcggctgttcccgtcgataccacagtgctcgattttgcgctggctaacgtcgcgcgtgcgacttcggccgatgccaacgagacctgccaggcgctgctcaactattacgccgatcgcccggtcgaggtgtctgagccgctgtcggtcattccgttctcgtcgtctaaaaaatggagtggcgcttcttttgcgcagggctcctatgtgatgggtgccgcgcagtttgtgctctctgatcgtgtgttttcgcaggtcgagaaccgtgtcgccgagcttgccgatacctgccgcgtgctcgtggtggcgcgcgtggacggctttacgcccgatggggatatggtgggcgaggccgagcccgtgggctttgtgaccatccgcgacgagattcgtacctcggcggccgagaccatcggctactttaacgagcagggcgtgaccctcaacgtgatcagtggcgacgacccgcgtacggtgtcgtcgatcgcgcgcgtggtgggcgtgccgggggcggacgcttatgtggacgccacgacgctcgatacaccggccaagcttgatgccgcagtggaccgctaccatgtctttggtcgtgtgaccccgcagcagaagcgcgagctcgtgcaggcgctcaagcgccgcgagcacaccgtggccatgacgggcgacggcgtcaacgacgtgctggcgctcaaggaggccgactgctccgtggccatggcggccggctccgatgccgcgcgtaacgtggccgagatcgtactcgtcgacaacgactttgcctcgatgcccgccgtggtggccgagggccgtcgctccatcaacaacctgcagcgttcggcctcactgttcctgaccaagacgctgttctcgatgggcctggcggcgctgtgtatcgcgctgccgccgtaccccttcgagcccatccagatgacgctcattaacttcttctgcatcggcgcgccgggctttgtgttgggcctggagcccaacaatgctcgtgtgaagggtgcgtttttgagcaacgtactcaagcgtgcactgccggcgtcgattgcggtcattttggctgcggcgctcgatatctttgtggcgcgcgtgtttggctttagccagctcgcgctgtctacgatgtgcctgcttacgtcgtgcgcggcgagcgtcagcctaatctggcgcatctcgcagcctctcacgcccttacgtgtggtgctctttgtgtttgtagtcgccggcatcctggtgggcgttatcggattcccggagctgctgtctattgccaacctgtcgatgggccagatggttatcttggctgttatcgtggtctttacctgctcggtgttctttaagctcgccacgatgatggattcgctcaagccgcgtcgtcgtcatgccgcaactggttttggccgcggtgtgcgcgtccgcctgggtcgcggtggcggcaaggtgagctcgacgggctcgacggccgaacgttttgccaagcgcgtcgccgccgacatggcgcagcgccgcgaagatcgcaccgctcgcgaggccgaggcccgcgcactcgagggcgtggcccaggcccagcccaagaaaaagaagagtaccggagctaagcgctctcgtgtgaccaagtccgcccaaggcatcaaagtctcgatgccaagcaaaaagaagaagtagctacgcgccctggcgatgttgaattggtgccttgttcctgtggggccgtggcgatgttatgctctaacctcgattgtttgaattgcttcgaaaagaggatgccgtgatctgcccgcattgccttaagactatcgaggacggcgcctcgttctgcccctactgcaacgcctatgtgggtccgggcgatggtcccgagcacaccgagttcgtgttctgtgagggctgcggtgcccgtctttctccgcatgatcgcacgtgcccaaaatgcggacgccctgctccgggtatcctctccgaggacgcggccgcatccgacctggcagcgggccgcacggcgggctttccgcgcctaacgcaagagcagatcgataccgaggtgcctcatgcgcccgcctcggctgccgcggttctttcggacgccgccgatcctaacgagacctgcgtgctgccggctttcgataaggatttcggtatccccaaggtcgatattcccacgcccgtttccctgcatgacgatgctcaaaaacccaagcgcaaggtgcatcccgacgaggacgcctatcacaagcacaagcgtcatatccccaagccgctcatcgtcatcgcggtccttgccgtcgtttgcggcggtgcctattggttcgtgacggccgatcccatgggtgtcatgcctgccttctacgaccagtttggccaggctgcgcagacgaccttccccacgcgccaaaagggcgaggcgactgaggacgataccaagcaggacgattctgccgaggtggtccaggaagaaaccgtgctcaccgatgatcagctctataccagactcgacggtctgtatcagaccatcgtgtcctacggtgatgaggaccagatcggcgaggtcatcgattcctttaacaacggctatctccgaacgccgctgtccacccgccaggagctgtcgcagagtgcctacgccctgcgcgaccagatcaaaaagacgcaagatgagcttaacaaccttaagtatcaggacgatacggtctatgcggacgacatcgcccacttaaagcagcttgccgagtggatgtacgagcgtgtcgacgtgatctgccagagctgggatatctcgctggccattcccgatggcgagtcgatgagttcccaccaaagcgagatcctggcgcccatcgcacagggcggcaacagcgcgctgaaccagtacgacgccaatgtgggctcctggaagccgcagcagcgttcccaaaattagttcgccatagtcggcataacctacgtgcgcaattgatgtaagcgcatgcttattgctacaattcgtacaaatatgctttaaacgcacgaggaaggaaccacatgtttggttttaagaaagagctctacacgcccgagtatcagcttgccggcgacgagtgcgccgttatcgagacgtcgaagggtaccatcaaggtcaagtttgacggcgagggcgctcccattcatgtcgcgaacttctgcgagctttccacgatgggcttctatgatggccttaagttccatcgctatgtgcccggttttgtcatccagggcggcgaccccaatacccgcgatatgtccggcgccgacgtcgccgctggtcttgagggccccgacggcatgcccggtaccggtggccccggctactgcatcaagggcgagtttgccaccaatccgcgcaacagccatgtcgatggtgcccttgccatggcacgctccatggaccccgattccgcgggttcgcagttctacttctgcctgggcgcccagcataacctcgattccggttacaccgtctttggtaccacggtcgagggtctcgatgtgatttcgcagctgcgtgccggcgacgagatcgtccatgtcgagatcgttcacgagtaaaggggacttccttgaatagccagctgatccaacagggccgcgccgcttaccgcgcgggtgatttttccgctgcagcccagatgcttggggcggcaaaaactcccgatgagattatgggcgaggccgatcaccttcgtggtaacgccttgatgcacctgggcatgtatgccgaggccgccgaggcctacaccgctgccctcaatgacggcacctacggcaagcgcggcgcgctgctcaccaaccgcggcaaggcactcgccgccgtgggcgactacacgacggccgcccaggcgttctctgctgctacgcaggatgcttcctatgccacgccgttcaaggcctatctgggcctgggcaatgcgctgttccagtcgggcgactatgccaacgcgggtactgcctttcgtcaggccgccatcgacggcgccaatccggctcctgccgccgcactcggcgagctcggtcgttgcttcattaagcttggccgtccggcggatgccgtggagacctaccgcacggctatcgactttgccggtccccgcgacgacacgcgtgcgctcaacgccggcatgggtcaggcgctttctgccgccggccgcccctccgacgcactcgacgcctttaacgccgctactgccgatggcatctaccagctcacctccgagcaggccgatgagcttgcccgcgtgcacgattcgcttgccgcgctgtctgcccagacggctatggccacggctccggcgcccgcgatggacgctcctgccgttgatccgctcgatcctacgggcgcgaccggccagtttatgcccgatccctcggacaccggcttctttacgctgtccgagtccgagatggtccagcaggaccgtcaggatcgtaagcaggccaaggtccgtcgtcgccatcgccacacgggcctcaaagtcttcatcgtgctgcttctgctcattttgatcgccgcgggcggtctgggctttgcctacacgcgcggctttggcttcccgtctcaggagtctgtcgttaccgatctgttccaggctgccggcgacggtgacaccgcaaaggccgagtcttgcctggcctcgagcctgtccgaggacgccaagtcgatgatcatctcctcgattccgcagggtgccaccgtgtccgtcgagggtatggatcagtccatgaccgagacgaccaccaaggttaaggcttcgctgtccaagggcggcgagcaggagtacaccgtcaaattcgtgcgctccgacaaccatatcggctgggccgtttcctcgctcgatatggatttctcggctgctgacaaccagtagtgaccttatgggatttagctttgcccggcgcttcaccgcaagtgaggtgccgggcttgcgctagtatgatgagctagtagttttccagcaatcatccaacacatcaggagttgcgttgttttctttgatggatatgttcttcggtagctatgcgggcgatcttgccatcgacctcggcaccgcaaatacgcttgtctccgtgcgtggcaagggcatcgtcattcgcgagccctctgttgtcgccatcgacaagaacgacgagcgcatcctcgcggtcggtatcgaggcaaagcgcatgctcggccgtacgcccggcaacatcgtggccgttcgtcccctgaaggacggcgtcatcgccgacttcgatgttaccgaggccatgctccgctactttatcgacaaggcgtctgagaagcgctatccgtggaccccgcgtccgcgcgttgtcgtctgcgttccctccggtgtcacgtctgtcgagaagcgtgccgtctttgaggctacgatccaagccggcgctcgccaggcctatctgatcgaagagcctatggccgccgctatcggcgccgacctgcccgtcgaggaacccaccggctccatggtcatcgacatcggtggcggtaccaccgaggttgccgttatcgctatgggcggcatcgtcgtctcgcagtccatccgtattgccggcgacgagttcgatcaggccatcctcacgcacgttcgcgatgcctacaaccttgccatcggcgagcgtacggcagaggacatcaagatcaaggtcggttccgccgtgccgctcaaggacgagctcgacgtcgaggtcaacggccgcgacgtgatcaccggtctgcccaagaccgtgcgcatcgagagcgaggagattcgtcgcgcgctcaacaagccgctcgacgagatggccaaggccgtcaaggacgccctcgatgccacgccgcccgatcttgcctcggaccttatgtactacggcattttgctgactggtggcggcgcgctgctgcgcggtctcgacgtgcgcctgcgcgatgagaccggtgtttcggtcaacgtcagccccacggcgctcgataacgtcgttaacggctgtgcccgcgtgctcgaggccaatgcgtttgatggcggcttcgtccagaccaatgcttaatttccaaagcgctcggggtcgtccacgtggtagccgaagaccgtggccctccccgactcggcgttctggacggcgcgcgtcaggtggcgcgaaagtccgttgccgtagaagatgttgtcgccgagcaccagggcgcacggctcgccgtcgatgaactcctcgccgatggtgaaggcctgggccaggccgtccgggctcggctgctcggcgtaggacaggttcacgccgtagcgcgagccgtccccgagcaggcgctcgaagttggggaggtccgtcggggtggagatgaccaggatgtcccggatgcccgccagcatgagggtggacagcgggtagtagatcatgggcttgtcgtagaccggcagcagctgcttggaggtcacgagcgtgagcgggtacaggcgtgtgccggacccgccggcgaggataatgcctttcatgtagtcctccgtgtcatttaactgatttagttacgacttatataataatctctatcggtcatatcaattaaaaatatatgagcgatacccattgaacaggccatctaattgcctcggcacggaaagagcgtcaggaacagtgaagatttacatcgcagcgcataagcactttgacattgatgcgcaagcgccgtatcagccgctctacgttgggtcaagctccattccaccagacaatcgtcaggctggatggctgtacgacgatcaaggcgataatatttcccagaaaaacaaacactactgcgagcttaccggcctctattggatatggaagaattctcctgagtcgatagttgggctcacgcattatcgaagggcgtttgagtcccccaatgactcaaagcagatgctcaaagactatgaaattgagaacattcttactcattatgactgtactgttgcagccaaagaaccctgcacaagctcaatcgggtgcaacttaatcactgttgctgagcagtatagaatgatccattcttcgacagatctgctacaggcaagggaaatcatcaggacgaaatgccctggctacttggatgcttttgataaagcaatttgcgaggagtgttctttttcgccatgcaatatgtttatttgcaaaaaggagctgatggaccgatattgtaaatggcttttcaaaatcgaaaaacaacttgagaagcgtattgactatataagtggtcgcgatagctatcaacaaaggatgcctggctttatctcagaacgactgtttaatgccttccttaaaaaggaaggcattaaatgctatgaatgccacatctttaacccaattaataaagaggccctcacgatcgatcaaagcacgtggcctcgaaggagaccgcaacttacatgctcgtgctctacgaatgccatatttaacggagtagactattcatcggtatttgattgttccttttatgtaaatcattacgaggatctattcgatagatataaagacgacccccttggagcgctggaacatttcatcgcaatcggcattaatgaaaatcgagttgcacatccacatttttctatcggctctcttctgaatggaaatccagatttaagaagtaggtgcagcgcaaatctcgaggcagcgcaaatgtatatagcaaatcctaaagaatatatgcatccaattggatatgaaaacattcatccgcaagacgagcaaagcaattcaactatggccacatggcatgaacgtcgaataacagcggcgcgtattcggtaccaagaaagaatcgagagactacctgtactggattaattcaatgcaagaataaacctgagatcaaagtgaaatagtgcaggcatcctcagtgcaacggaaaggtaaattgaaatgaaaattagcatggattgtatttgccgtggaagcggaaaggtgtacgttctcctaaagaatgttgagatagacgcatcaaatattcaggtgacagcagcgaagagcgagggaacgacaataccaagctctatctatccatacgagtcaaataaaaatcaatacgtcgtagttcttcccgaccttggaactggtgattgcgatattcagattaatgatttgagtgcgcgatgcgtctacgatgtcattaaaatcagctttagcacggcaaaatgggcgtcaagattaaactataaattaaagaatgatttgtcccattccattaggaactatgacgataagcacgacttggatgtagcaagcatgcgttttcacgagtttatcgaagatggagatgaggccattcttcgctgctcagtaaaacttcctcagcgcgaagacaacaaaatagccatcagctgcttcgatacctcgatgaatcgtattgagatcgagccgatcacaaccgatgacattacgatccccttgtggtttgctcccaataaaaaacgtcgcgaaattcaatactcggtccgaatcccaaatagcacaaataggcttatcttcacaatcgaagacgacaaccacccaagctttaacagcttcgctgttgtggacaacgaagagctcgataagctacgcattttaaccacatcgaaaatgaaacctatttcgattgatccatctgcatatccaaattggctcgagcaacacaaggcaagctcggcgatactcgaaaaacaatcgatggttaccttcaaggaaatgcctttgtttagcatcgtcgttcccctattcaacacacccgaaaatctgttcagggaaatggtggaatcggttcttatacagagctatgcaaactgggagcttgtgctagtcaatgcaagcccagataacagtgcgcttgcagatataatcgaagccgctaagattaaagacgctcgcattaaggtgatagagctagcaaacaatgccggcatttccaaaaacactcttgctgggacaaaagaagcaaatggagatttcatttgcttcttagaccacgacgatactctcgagccctcggcgctttatgaatatgcgcatgcaattaatgctgaaaacaatactgatctaatttactgcgacgaagacaaactgtttgtcaatggcagctatggcgatccgttctttaagccagatttaagcatcgatttgctgcgaagcgttaattatatttgccatttccttgcaatcagaaaaacgctattcgattctctcgggtacggcgacgaacagtacgatggagcccaagaccacgacttaacgcttaaggcaatcgaaaaagcacggcatgtggtgcacgtggctaaaatcctgtatcactggagaattagcgagaactcaactgcaggtgacccgaactcaaagctatatgcatgggatgctggcgtcaaagctgtacaggcccatttggacaggcttggaattgcagcgaaagtttaccgcggaaacgaccccttcacttataaagttgcctatgcagttccggaaagtcatccacttgtttcaattgttattccaacaaaggaccatcccacagttctcgatacgtgcattaagtcgatcatagaacgctcaacgtacgataactacgaaatcatcattatcgaaaacaacagcgagaaccaagaaacattcgagtactactcagaattggagaaaagctatcccgatacgattcgcatcgaatattgggatgcggaatttaatttctcaaaactgatgaactttggcgctagcaaagcaaagggcgattatcttctcttgttaaacaacgatacagaagttataaccccaaactggatcgaaaacatgctgggcatttgttcgcgaaaagaagttggcattgttggtgcaagacttttctacagcgataatactctgcaacatgcaggcgtcggcatcggagggattggagccggccacctcggaaaagactaccccagaggtaaatggggctacttcaatctatgcgatcgtacacaagatttaagtgccgtgaccgcagcatgcctcatgacaaagagagctgttttcgacgaagtcggcggctttagagaagaattggctgtcgcctttaatgatgttgactattgcctcaaagtgaggagtcacaattatttggttgtatatacacccgatactgagctgtatcattacgagtcgttatcacgaggctatgagatcagcgatgaaaagaaaatgaggttccatcgggaatactcattgctcaactacctatggccagagtactacgtgaaaggcgatccgtatataaacataaatatcgtcagtggaaatctgtattatcaaatataaaagtgtcatgacgcttaactcatgagcacgtaaagaatggagaatggggctgccggttaaccgacagccccattcttcctaataggttatttcatatagaacgaatccgtttgctgaacctaattgcgtaatccgcagttgatcagatgaaaactccgtcaaatccctactagacaaaacgtacttcacattaagctgtcttagattatcttcagtcaaattaactgtgaagagatcatcctgagtggaattaaaagacgtagacggagtgaatacatttgcaatgatatgagcatacctattgtatgcgtactcattctcgttattatcatcgatagaattccaacgcgccagatcaggataagcattggtcgagttaattacaggcgctccatacgcagcgcaaagattggcaactgtccaagaaccatcgacaacccatttaactgaataatcatccttgtcagcgaactgatcaacaagagacgccaactccgtttcggtaagcggagctgcaccaatttgtattggattgatacagcaaccaggaattacaccgaagcaaatagcaaatgcgacaaataaaccaatgcagtttttaccaaggataaatgcgctgaacaaaaggcaggaaactgcacaaagcaatatcagcatcaaaagatacaatttccttgcgacaagatacttggcggaaagaagaatataaatctggaatactgaacttaaacagattccaatcactagcaaaaccaacaaagaactaatttggctattagcctcttggaattctttggcttttttaacagatatcaagaaaagaagaagctctaagtacccaataggaaataaaagccgcagaacaggtacgttatacatcaaggtaattcgggataaaaatgacgggaagccaacgaaggcaaaaagaaggaaaaataactgaaggactagtagtgcaattaaatgccaatctcgctttttgatgatacaggacagagacgcaagagtcccaagagggaaaaagcagagaatggtggcaatttcacattcatttgaaaccaaaggcgtatcaaaagcataaaaaagagaaagcgcattcgaaaaaagttcgggaagcccgcttcctccggtttcaaagcgcgcgcccggataaaccgtattaacaacagatgccattgcttcagaggactggaaaaaagctaaaaatacaagtcctgccgaaaccagcaaacagaagatcgaagttaaagtgtcactaattgaccacgcaagcaccgaacggtactcgccagacttaaggattcgacaataatcaattgccctgaaaactcccatgagggcaaaaatgtagaaaaaaggaaccatccaagcgggatacatgagcattatgtaacaaccgcataaccatgcaatagcaacaatcgcaatgactctagtgctccttttacgagtaaagagcgtcttatctaataacaaaacaagggcttgaccgtaaagaaccacctcgcctgtaccccaccactgaatcagcggcgaaaaacaaagcaatattgaaaagagcaaactgagtggctttgatttaatcatgaggaaagcgcagtcaaaggaaaccaggaccataatgcatagcttcatggaccaagcaaacgctaaacccgattcaaaaccaaataccaaatagccccaaagcactggacgaaataacgaaattacactccagcaggcagcaccataaaccatccggacatctgttatatctcctcttaagatttccgaaattggcgcataatcattatgagactgagacaattgaaataaagtaccgactgaaaactcatcgcttcgaagagacctaggtataccccagatgggagtcccggcgttctcaggaagcataatgctccacatgccaagcgatgagccgctgactttaaacaccaccgcaagcattgcgacagaaataccgattatccatcgatatttatatataaaatcgcttttatactcgatcagcttgattgctgagaataaaaacgcaacggtcaatccaccgatgatgagaacagacataccgttattgagcagcgagctagcagttgtaacaccgatctttccgtagaagctacaaacatagttaacaaataaagataagtaaataagcgcaaacaaaaaagatagcgcaaaacaagcagcccgataaagatgaaaattatcgttatgcaaattattgcttcggtcttctgaggtaaggtacttattcatacgagttattaaactccatctttatctaaccctgctggttgcgcaaagtatcgttctcattttcaagaatcgcaatgcgttgagttaagtttttacaagccgtaacgagtctgctgatcgcaatactgagagatagagaaatcatcaataaaagtactactgcgacgagaaaggcgaaattcgaaggactgataaacccaatacaatctgaaattcgataaatcaactccggaaagcaaacgctaaataatgccaccacgcacaggcagagccatagtaacgagtactttaaaagaagctttcctttgccgactaaagaaacgacataaaagaatagaccactaaaaattacgccagcgcccacgcgaattatcatactcattggtgagccgcctttctataaacaaaacaggccatggaaattgcgagcgaaactttaatcatgtaataaattgatgaaaagccagaaatagatgacactccaccctgtctctcacgcataagcacgggaacctcaaccactgaaagaccggtttttaatgctgctgcaatagattcaggctcagggtaatcgtctggatagtccctacagaacaggtctatagcctttttaccgcacgcgcgaaatccagaagttggatctttaatcgtttttccggtaaataatctcaaccaaccagaaagccatcggatacctactctccttaaaaatgttgattgaaagccttctgtgggcacggcaaatctggaaccaatggctaaatcggcaccatcaataattggctcgattaagctcccaatataagaaggatcatgctgaccatcaccgtcaacctgaacatcaacgtcatagccttgcctgagcgcatatttatgaccggcttgaacggcaccaccaatgcctaaattttgcggaagatcaaggacattaaagtcgtactgacgacagatagatagcgtattatcggttgagccgtcattcacaacaacataatcatagccagcctcaacaaccgatgaaacagtctgaacaatattggcttgctcattataagcaggaatgattaccaacactcgcaacatgtcatccattaaaaccccaacgatccagattggacctaaattgaaaataaaacctgcttaattttatccaaacaaacctgtctcgaaaaatgctcacgataataattgaagccattagatcccaaagcatcaatagcgccttttttcattgaaccaatttttaccatgttgttagcaagcgcatttacatctgaaggatcggagacaaacccgcatctagcagaacgaaccgcattggccccttctccgcgcattacggcaagtattgcctttgaagaagccatacagcttgatatcttggctggaatagtaagctctaactcaggattatcggcaaatggagcaatcattgccgttgcaatatcggagtacatgggcacgacctcgggatccacgcgccccaaaaacaaaacagacttatcaagccccttgcttgaaacgagcttctgcagttctgccctagacatgccatcgccaagaattaacagcttcatctcgatagagttctctgaaactgcacgcgagaatgcttcaataaccgtatcaagcccttgggcgggggttatagaaccagcaaataggaagacgcattgatttttgaactgagatcttagttccgatgagactagcttttgctcgtaactttcctcgcaatgttgaggtattacgcctatcgaaacatccgaattcaaaggcttgactctatgaaacaggttatcagccaaagagtcgctcaaagcaatcagcttattgcaggccgcatactgcttgtcgcaaaaagatttggcaaaagacctcagaaaactgctttggacattcaagactgtgtaaaggttctcgggccaaatatccaagacataagttactagaggacatttatttcgccatgcagcaacccttgcaggaattaccatcaaaataggacttgtgttatagcaaaatacaacgtcatacttctttttgagcctcatagctctaaaagaagcagtaattggccagctaatatagttcagaaaaatgcgtatcgaagtattacccttacgacggatttcaccagatcgaaaaacggacgcaccgaaataatcgtctcggcggtgaccgaaataaccatatccatcagaccattcgcctgaaggataattagggatgccgcagagaacatctacgcttattccgtcttcaacaaatcccctcaccaagtcattaattcgaaaagattccggatagaaatgctgcgtaacaacaagcattttcttaccagcacatgagctagtcattaaacgctcttcctccacaccatcttgtccacgacgccggtgtagctctggatgatcttgaccaccttggtggacacggtctcgtcggcgtaatcgggcacgggcgcctcgggcagcgacccctccgcatcgagctcgacggcggtgtggacggcctggagcaggcccctctcggagatgccggcgagcgtgaagcaggccttgtccagcgcctcggggcgctcggtggaggtgcggatacacaccgctgggaacgggcggccgacgctcgcgaagaagctggactcctcgggcagggtgccggagtcggagaccacggcgaaggcgttcatctgcaggcagttgtagtcgtggaaccccataggctcgtgcatgcgcacgcgcgggtccagctggaagccggtggcctccaggcgcttgcgggagcgcgggtggcaggagtacaggatcggcatgtcgtatttctcggccagcgcgttgaccgcggtgaacaggctcgtgaagttcgcctcggtgtcgatgttctcctcgcggtgtgccgacagcagcatgtagcgcctgggctccagtccgagctcggagaggatatgggacccctcgatcttgtcaaggttggcgcgcagcacctcggccatgggcgagcccgtgacgtaggtgcgctcgggtgcgcagccggtgtccttgaggtagcggcgtgcgtgctcggagtaggccaggttgacgtcggagatcacgtcgacgatgcgtcggttggtctcctcgggcaggcactcgtccttgcagcggttgcccgcctccatgtggaagatggggatgtgcaggcgcttggccgcgatggcggacaggcagctgttggtgtcgccaaggatcaggagcgcgtcgggccgcacctggaccatcagcttgtaggaggccgcgatgatgttgccgacggtctcgcccaggtccgcgccaacggcgtccaggtagacgtccggatcgtccagcgacaggtcgcggaagaagatgccgttgagcgtgtagtcgtagttctggccggtgtgcgccagcaggcagtcgaagtggcggcggcacttcttgatgacctcggaaaggcgaatgacctcggggcgcgtgcccacgatgatcaggagcttcaggcggccgtcgtctttaaaacaaatattggaattcataggtttccttaaaacagagtctagtattttgccaacagtaatgaggcggcctgcacgtcaccacattcaacaagtttcgaatcgtccctgtgcaaagtctcagagcatccgccgacatcgtaacaaacgactggcagcccacaagcctcagcctcaagattgaccgtagggtagttatcctcgtatgttggattgaatagaacagaggcagaactataaagtgaggccaactctatctgagagtcggttcgtggaataccgacgatctctggcggcagcgcccgcatctgtttggcacttaaaccaacgagtacgatggaatacttggagcgatcaagcctgtcagcgagagtataaaagtctgataaccccttgcgttttgaccatggagacgcaacacctaaaataatatttctagaatcgagaccgtatttctctttaacactagatacttcgccattggatcgcggcctgaatatatcgaggtcaatcgtattatgtgcaacttctatcggatactttgacaaaaagcttgaagcaaccagttcggccaaccatttagaaggagtgacaattgtcaatcggtcggaaggcaacgaagtgaataacgaacgtttagcctcataattccatttgcatgaaccagaattgatagttggaggatatcccataagctgtggacatttcgtggtaccgcagccgcttttccattgattgcagtcagcatatgtgaaatacggacaatggccggtaaaagcccaacagtcatgcaaagtccatacaacacgacaatcagatatcgacaaccatttaaatagcctatcaatattcaaatagtaaccatgaatgttgtgcaagtgaaccacatcaggaccaaactcatcaaggcgatgaatcaacgcctcggtttgcctcactgaatgaaaaccaatcttcccgtcaaggaaagtaagtccaacgtcgagtataaaattagccgatgacccaaagcagtactcactggcactacttgctggccttcttctaccccagcaagcaagcgattcgcatccctgatctataagagcaaaatgctccttcatcataatgcgcccagtggatccatttggaacgctattaatgtgagcgtatctggtcaaaacctctagacttcctcgtagtaggtgtcggggttctcggggtcaaaaggctcgttggcccacatgaccgtcacgaggtcctcggtgtcggacaggttggtgatggagtgcgtgtagccgggaatcatctccacggcgcgcatgtccgagccagagacgacgtactcgtcgacggggaactggttgccctcggcgtcctcccccaccttcctcagcttgatgctcgcggtgccggagaccaccaggaacctctcccacttgctcatgtgccagtggttgcccttggtgatgccgggcttcgagacgttgatggagacctggccgcgctccggcgtgcgcaggaactcggtgaacgagccgcggtcatccacgttcggcttgaggccgtaggcgaagtgccccggctcgtagtaggacaggaacgtgctccagagcttcttggagaaggagccctccgccaggtcgggcacggaaagcgtctcgcggctgtcgcggaagcacccgagcaggtagacgatctcgcccagggacttcacgtcggtctgggggacgtagcagaagtcctccccctcgacgcgctcgaggccctcgtagccgcagcggtgttcctcccccagcagggcgcccagcatctcgtcgaccaggtcgtcgatgtagaggagctccagctcgaccgaggggtcgttcacggtgtaggggcggccgttggcgatggcgtcgcagaaggtcgccacggcggagttgtagcgaggtcggcaccacttgccgtagaggttcgggaagcggtagatgaggacaggagcgcccgtgcgctccgagtactcgcggaacaggccctcccccgcgagcttggactcgccgtagaccgagccctcgaagcggcccgacaggctcgcctgcgcggagctnnnnnnnnnnnnnnnnnnnnnnnnnnnnnncgtggcgctcgagggcgtcgagcagcgtggaggcgaacccgaagttgccctccatgaactcggactgctccttggggcggttgacgccggccaggttgaacacgaagtcggcgcgggagcagcagtcatcgagctccccgggcgtcgagtcgatgtcgtactccataatctcgagcgggagcaggcccgagtatttctcgcggcggtccttgccgtcccttatgttcttgagggcgcagcagaggttcctgccgacgaagcccctggcgccggtgacgagtatgcgcaccctactgcaccgcctcgtgctcgcggccctcgagcgccagctgcacgtactcggcggtcttgatcttggcgatggtgcccgccacgtcgagcctctcggtgttgtgggaggtataggactcgtcggcctgggtctccacctcgccgtccacgacgaacttgtcgtagttcaggtcgcgcgagtcgcaggcgacgcggtagtagccgcccatgtcctcggcgcgcaggcgctcctcgcgggtcatgagggtctcgaagagcttctcgccgtggcgggtgccgatgacctgggtgcccacgcggccgaagacctcctgcacggcctcggcgaggtcgccgatcgtggaggccggcgccttctggatgaacaggtcgccggggttggcgtgctcgaaggcgaactgcaccaggtccacggcctcgtccaggttcatgaggaagcgggtcatgttggggtcggtgacggtgagcggctcgcccttgcggatgcggtcgatgaacagcgggatgacgctgccgcgcgagcacatgacgttgccgtagcgggtgcagcagatggtggtgcggccggcgccgttgcgggcgttggcgtagatgatcgactccatcatggccttggacttgcccatggcgttgatggggtaggcggccttgtcggtggacaggcacacgacgcggtccacgccctcgtcgatggcggcatgcaggacgttgtccgtgccgattacgttggtgcgcacggcctccatggggaagaactcgcaggagggaacctgcttgagggcggcggcgtggaagatgtagtccacgccgtgcatggcgtcgcggacgctctgggcgtcgcggacgtcgccgatgaagaagcgcaccttggacgcgagctcgggggacctctcctgcaggcggtggcgcatgtcgtcctgcttcttctcgtcgcgggagaagatgcggatctcggctaggtcggtgtccatgaagtgtttgagcacggtgttgccgaacgagccggtgccgcccgtgatcatgagggtcttgtctttgaatacgctatcgcacatttcaagctccaataaacaaaattaaggtgaatgaaacttaaacaaatttgaagttgttgcttaacctactaatacgtgtcttatgctaaacgaaaagacgcctgctgggcataaattagaattaaaaagcgttaatacctgcgccagaactgataacccctccattggcgttaaagaagtcaattcaggtagatattaagcaccggccgcacacttttatatctaagtatttagcgaatctctactgcattattccgaataatgcagggaagcatcgcgacacacccgacaaaataagcaagcgaaattgcaatactcgttccgttaggtccaaacaagtgaatcattaagctggaaagagggacaacaacgattaaagcaactaaattaccaacaagattaccaaccatctttcttttaacaattgtcaggtcggaaaagaaaccgataaacgccgtaatcagagagctaattaccgcaccgtacagcaaaaaagaatactgatgaatttggtcaccgaaaagtagtcccaacaagtagtcgccgcagatgaaacaagcgaacaaaataagaatacacaagacaagggcgccaagaatgaccttcaccaacatggtattaaatgcttttttatcctccgactcactagcgctcgcaaaagcgccgagcaaaggggcataggcattagcagcacccgcctgaactattgccgcgggagaacacaccgaggaataaacacccaacattgatgcccccaatgcagcagcaagttcttgacgcgaaacagatgtaactgcagcgcaacaaaaaaccccaaccgtagcgggaagacacttataaaacagttcagacatcgccttgaacctaaaagaaggaacaatcgcatcgaaattcgaagcccaacgtacatcaacaaccattacagggagagacaccgcaatcattagaacgatgctcaatacaagagaatgtgagacatgcattccggcacaaaacgcgagaagtgacaaaatgcctctcagcagcatcgaaatgccacaataaatcatatttcctgctttttgatcaatgccgtggaacacatcgaccatcacttctattgacttatatatgcaatagaagtacacggggagaagggaagactgctgacaggtaaagaatgcataaggtaatacgaaaacaaaccccaacactattgtgattagacgaaaaccaatgtattcccccgaagaatactcacatgaaagatcggatacctgaaaggatcgaatcttatataaaccgattggaacaaatagattgctgattgtcattgccaaagacaaatcacctgcatagttaaaatccgatgaaagacgaactacggcaactgtcgttaaccactgacaagcaaggtatgcaatcgagccaacggtattccatgtgatgtttttctttaaattgtcagtcaaattaacccaatcgatttaaaactttcaatctactttttaaagcctaaccaataacctctttggcgattgcatcaatgctttcgccgtatccaacacccggaacggcccatttgccatttaaatcaacggttctcggagcacagccacgactgacatatttaaagcgagcatcaatacacggattaatcaatggctccgttgaaccatacgcctttagatgctgaacctgcgcccgcagtccctcacggacagatccgaaggtgtagcctgggttaccaggtccagtggcgccaaggcctccaaaattgcactgattaggctgaaccaaatttccaaacttcaaatatcccgtttctttcatcacctgcccatataaaacttcaggtgaaacaccctccgactgagcctcttcatatagaattttgcagaaatctatgatgttcgacgctcccctatccgtgtaaacggctgaagggaatccttttgggcccacggtctttgtgaaatgatcagcggcatctagataggttgaataggcggacgacataataaaaccttcgtatccagtcgcacttgcaccattacgcccctccttaatgccacaatttaaatagtggatgtaatagctcttcaggttctgcccgaaagccttcctcaggtccgcataacgatttcgatagccataaacgtcgaaggaatcgctcccgcgacggccctccgccatgccgcagctgacgaaatggcgcagcacggcagcatcgtcaacgaacctcagaccacccttgacggttgtaaaggcgctcaggacgtctccgttgttggaggtatagaagtcgaaatcgtaaacgggggaataatccgtaccgccctgcgaagcgacggcgcccgcgagggaagcgcaaccggtcgcgatcctgccctcagcgcgaccgctgctgaggtaatgaccatatagagcggtgaggttggcaccgaatgcgcgacgaaggtcggggtatctgttgtaatagctcagcacgtcgaaggactcgctcccgcgacggccctccgccatgccgcagctgacgaaatggcgcagcacggcagcatcgtcaacgaacctcagaccacccttgacggttgtaaaggcgctcaggacgtctccgttgttggaggtatagaagtcgaaatcgtaaacgggggaataatccgtaccgccctgcgaagcgacggcgcccgcgagggaagcgcaaccggtcgcgatcctgccctcagcgcgaccgctgctgaggtaatgactatatagagcggtgaggttggcaccgaatgcgcgacgaaggtcggggtatctgttgtaatagctcagcacgtcgaaggactcgctcccgcgacggccctccgccatgccgcagctgacgaaatggcgcagcacggcagcatcgtcaatcattacaacgccagcggggcttcgtttagaaaaagcgttgcgaatgtcttcgttattcgatagataaaacgaggggtcgtagacggaagaatagtcaacgccattgatagtcgtagcgtatccctcaatctttgagcatccggtcccatgccttccttctgcttttccagctgtgacgtaatgctcgtagtacttcactaaatcaaagccaaaggcagcccttaaatctggatactcattaaagtagctctgtacgtcaaaagaagcagagccgcgcctaccttcactcataccatagttaataaaatggtctagagctaattcactatttccagccgtagctttggcaacatcgggattattcgacaaatagtaattagcatcgaatacggaagagtaatcgagccaagttgacttaggaaattgcgcaatgatcgcatcggcatcggcctcgccaagacgcctgcaaccctcatcgctaaaataattcaatacgtcccccgcatcagaaataaagccatgctcaattagaatgccgggaataccttgttcgcgggcgcaacggatgaccgcaaactcatctccaacttccatttggaatacaccgcgatagctgagtcccatagaagcgaggttgttcatcactttattcgcaagctccacagaaacttgcgtgtaatcatattcattggcagtgggcgcatatacctcggcgccgtgagcaacaggcgaaccggaattgatatggaagctaacaaaggcctgcgcgccttgactcacgcatcgttggacacgataaaggtaatcatttcctgagtagccaccgctttgctcgcgagcaagaacgactttaaagccatacgcctcaagcttattcttacaagcagcaacgatcttccaagttagatccgcctcactctttccatttccctgcgcaccagggtcggtgccgccatggccagcatcgagggcaattatccgaacgttttttcgcgccgagcgcgcagcataggtagaaatgccgtccggtgaatcggcacactccaacgcctgcttgatcgattgggcctcaacggcattgccatcgccgtctgcatagtaaacggaagtgccttcgcaattagcagtgccgtcaacaaccgtaaaagaataatctctgtcagagagattaatctcatgttcagtaccatcgccctgcagaacataggttattgaagtaagaaagtatgtattgagttctagctccgagccaaatgtaaatgcagcagaattagcatcctgtgcggaagcgtcaacagccccctgaactccattggcgctcacatagttaagtgtcgcggaagcgatagtatcgctgtcattaggagtcgcaaacgcgacgacttggtcagtcccactgataaggttcgggtaggcaagatatatatattgaaaaggagaatcagccgattcggtttgcggctcagtcgaagaagcatctacaccgaaatcctcatcagctggctcgtcaacgtccgtcggcaacgactgctcgacatccatgtctccgtcggcaacgccctcgtcgcgtgaagctacaccatcgtctgcggacacagcatctgatgaaatatcctcagcttgcacgctattcgcagcataagcagcggctacaggactcatcaagggtgaaatcgttaaaagagcagctaaagaaaacgctgttgaggcacgcaatgcctttttcatatcgtatcccccatcacaaataatgatactaagggtagattatcttacaatctcccccgcatcggaagtccagttattcaaagcatgggaattgttctaaaagcagatggacacctgcccttataaaaagtagcaggcgtactcagcaagctttttttcgtctctaacagtttagataacaggtgatgattcggggaccggaaggttcccgaatgttatgctcttcccagccaaacaaagaatccgcccgagcgcccacccggatctttgtttggcgacaatccctccgggtgggcgctcgggcggatgggaaagatccatatggaaagagcgaaccccttcagggcgctcgtggcgggcctcaccgccgacgagttcctgctgctcagagaagccgtcggcgagaggcactgccgcaacgaggtcggggtcggcacgctcgccgtggccgccgcggcatactggccggacccggggtgcccggagtgcggcgccgagggcgcctgaagggacaggtccaccgcagcaggagtaccgaggtggcgctgccgctgctgcggcaggagattcaactccctcaccgggaccgtcctcgagcactgcagaaagccgctcctcgcctgagtctccttcatcaggctcatgcgccacaacgtccccgtcgagtgcgcggccgatctgtgcggcgtcaaccacaagaccgccttcgagtggcggcaccgtgcgctcaccacggcgtccggctgccgggaccgaatcatgatgcgcgacaccgtctgggttgacgagatctgcatcagcgacaccgacctctccaagggctacgggcaagccctcaagcgcggcctctcccgccaggagctctgcacctgcgtcaccatcgatatccacaagaaccccgtcgcggtcgtctgcggccacgggaagcccagttcggcgcgcgtgagggatgccatgggcggcaggatagcgccgggatcgctactgattcacgacctcgaatgggcccacgtcgtgtcccgccgctcgacgcgggacggcgcgaggcccctcttccaggtcttcgccgacgcccacgagaggcagtcggcggtgatcaccacgaacctggagttcagcaggtggggatcggcattcggcgacgaccagatgtccgccgtcatagactacatcgtccaccacggaaggctcgtccagttccgcagggagtcctgcaacgtgcgtcacgccctcatgcaggaggggtaaatgcctcaaaaagggcgcgcacgaccggagcgcgcccagctcaaatcccgatgctctttttactcaaatcctcttgacgaaacacgccagattcccggcgtcagctacgagaatacccgggccaatcaacggcagcacccgatcagcattaagaattgttagcgccggaataatttagccaaatatagtcggccgagattgaccaatcccggccgacccattttagccaacacgcccgcatctatgactttcctatcgcattcctacatcccctcgggctggatccccctcaccttcaccgcctgggggacggcctccaccgagtaggtgtcaagctccctgccgcggtagctcgggccccgcatcacgaacaccgacgccttgtcgaacagcctgtcgagggcgcagaggagcgtgtcgtcgcccgtgaagaactcatcccacccgctcggggcgatgttgctcgtgaggaccatcgcgttcggcccctccttctcgtagcgcctgtcgacgacatcgaagaacaggtcggtgcacggcctgtcgtagacgcatctccccacctcgtcaacgatgaggcacgacggcttgacgagcgaggagacgacccgcgaggtgtttccccgctggacggccttctggaacctgtccctgagctcggtcgcctttatgtagtaggtcttgagcccccgcatgcagcactcgcgcccgtaggcctgcgcgaggtgcgtcttccctatgccgccgggcccgacgaaggcgacgttgcggtgcgcgtagaggtcggccagcgacgggagcttgcccagcgcggccgcgtcccggccctggatcctggagaagtcgaagccctcgtgttagcgctactgtaaaaacaaccaatttcgccatcgcactttagccgattccgcccggaaagaaactgcaacgcgggggaggcgaccccaatggctttctcatatcgtctatcgagcgagctcgcaacgcttatctcgggccgatatgtcgaggtcaagatgcagcctctcacgtttagcgaatatcttgattttcgctcgattgatgcggtcgccgctgaagggcttggtgagagggtcgaacttgtttccaaaacgggcgatcgccttaattcaaataccgtgcttgagcagtacataacctatggcggcatgccgtttctggcccatgatgagccgagacgtgagctgtgccgcgactatatccgtagcctctaccagacgatcgtcgcgcgcgatatcctgtcgcgtgcgacgcgtaggggtcgcggagctatcaccaagcgcgatgttctcgagcggctctgtgcgtatctggcagacaacatctccaaccaaacctcggtcaacaaaatcgtagggacgctcaacgaatcggcgggcggtaagaccaacgcatcgacggtgtcggcatatattgacgctctggaagagacgtacctgtttaccaaagtaaaaaggtatgacatcaaggggcgggagcttcttaagacaggcggtaaatattacatagctgatacgggaattcgcagctatcttgacggatatagaggtagcgatagcggaaggatgctcgagaacgttatctacaaccagcttgtatttgaaggatacgaagtgttttgcggccatctgcgcgcgggggaaatcgactttgtcgcaatcggcgagggatcggaccgcaaatatatccaggttaccgagcggatcgatgccgaggcgacgagagaacgcgagctgcgaccgctcaagctaagcacgctaggaaaaattcctgattcgtatgagaagatcctgattgtcagggatggcgaccatccaacggacatcgatggcatcagaatcgtgggggcagtcgacttcttgttgagaaataagattacccgcggctaaacgcaaacagatccgtttcgatgcgacaaaggagcagtcctttttcgcattccgtgcgagccctcgtgccgtctgggggtataaggctaacaagtgtttatttgcgaggcctaaggggcgccccgtatggatatcgataactttgaatggtggtatagcgagggtgaggctccggacgaggggtgggacgagcctacgccgcgtgacgtgtcgagcgacgaggacgagaccggcaacgacgtcgccgccgactcggacgccgccctcgattccgtcgagcccctgaccttcgaacaagcttgggcccaggccgaggcagacgaggccaaggccgacgctacggccacgctcggcgagccagccgacatgtcgatctcgccggcaaagaccccgcagccgcgtcacaccatcgatcccgacagcacggcatccttcagtattctcgacgtgccctcgcagggtgcccaggcgcccgcgcccacacgtcgccccaatctgtctcgcgaggaagatgcaggacgtcgctctccgctcggccccatccttatcgccttcatggccggcgttatcgcatgctcggtaattggaaacgtctggagccatgttgagcaacagcgaaaagacgccgccaaggtcgagatgtctgtcgagcaatcgctcggccgcacgcgctcggtacatgtgtcggtcgaggtcaaggacggcgcgacgtgggacaccgcgcgcggcgacagccaaatgctcatccatatcgtggggcgcacgctcaaagggcagacgatcgacgagtatcaatacgtcaattccgctggtgacggcatcgagctcaagcccggcgactacgagctcaccgtcgatgaaccgcccgtcgccaccgacggcacgcgcttccgcgcctcaaagcgcatggtccccgtgaactttaactcacaggcgcccgacacggtcgacactacaccgcagggcgggttcgacctttacgtggatacccagtaggcactcgccgctcattccgctatggctactcaataatcgcctgccgtcccgtcccgccgccaagagtgggacaatagccctcgacactattgtttacttttggaggaagtagcatgtctaccgttactaccatcaagcgcggcggcctcaccgcggccatcgattccatgggcgcccagctcacgagccttgccctcaacggcaacgagtatctgtggcagggcgaccccgccttttggggcaagcacgcgcccatcctgttccccattgtgggctcgctgcgcaacaacacggcaacgtctgcggccggtacctgcgagatgccgcgccacggactcgcgcgcattgtcgagcacaagctggtcgaggtttcggaggacggctcctcggtaacgtacgagattaccgatacgcccgagtcgctcaaggcgttcccgttccactttaagctcaacatgacctatgccttgaccggcgacgccaccctcacgcagacctttgccgtcaccaacaccggcgacgtggacctgccgttctcggtgggcggccaccccgcatttaacgtgcccgcccccggtgccgaggacgaggcgttcgaggattacgagttggcgtttaccgaggcttggaccaacgaggctcccatcatcacgcccgacggtcttatgacgttcgagggcagctacaaggcgcccgataactcggacgtgctgcccatcacgcaccgcagcttcgataacgatgccatcatgttcaccgatactccgggctccacgctcacactgcgcggccgcaagtcgggccacggcgtcaagatcgactttgagggctttaagtacatcggcgtgtggtctgccgccaacgacgctccgtttgtggcgctcgagccctggaccggtcacaccaccatggacaccgaggacgacgtctttgagcacaaggtcaacaccatcaccttggctcccggcgagacggatgttcgcagctttagcgttaccttgctctagaggttccgccgctcggtcgatgctgcgcgtcgtccagagcgacaagttgtcattcaaaaggcaagacatagaccttctggtcatgccttgcctttttcatgccacttgttcgctctggacgtcgctcgccggcattgccaaaacatcggcgtccccaatggctaccgtgtgtctattaatttttcgagcttgtgctgcgctgctggtcgctggcgtatatcctgttaagtcgtcagcatacgattcaacagggaaggcagattatgcattctccccaacagtgcgatgcgcagcgccagccggtatgcagccgtcgcatctttttgggtagcgccctcgctgcgagcgcttccgtcgtcgccggcgcgcttgccggctgtcagcgcccgtcaacgctcaaggtggttcagcccacgacgggcggcggtcgcgacgacctgtccgattccgtgatcggcaaggataagatccgcattggcatggaggcggcctacgccccgtacaactggcaggtctccgaggccagcgagtacaccatccccatcgacaacgtgcagggtgcctatgccgatggctacgacgtgcagatcgccaagatcgtctgcaaggccctcggtggcgagcccgttgccgtcaagcagagtttctcgggccttatcgattcgctcaacaacggccagatcgacctcatcattgccggcatgagcgccacgcccgagcgcgaggagtccgtcggcttttccgacccgtacttcattggctactttggcctgttcgtaaaagagggctcgccctaccaaaatgcgaccaagctcagcgactttagcggcgctacggtcctcggccaaaaggacaccatgctcgataccgtcatcgacgaaatcccgggcgttgtgcacaagaacccggtcgattcggtccccacggtgttttcgaacctgctgcagggcacctgcgacgccgtgacctacaacaccgagaacgagaagggctatatggcccaaaacccgggcatcgtccccattcaatttgccgagggcgagggctttaagcaggaggtcacggcaaacgtcggctgccgcaagggctcggacaaactgcttaagctcatcgacaagacactcaagggcattagccaagaggagcgcgaccaaatgtgggacgcgtgcctcgaccgtcagccggcatagggaggcagcatgaaaaccatcaatcgcctggcctcctttatcaaggcagaccaccgttatgtatacctgggcacgagcgtcatcgcggcgctcggcctggcgtttagccagcgcaaccccacgccgatgagtttcttggcgcctacgggcgtgttccaagactgcctctgggcaatcctttgggcctggctcgtcgtgtcggcggcggcgctggtcaccaagctcatgcactggaacgactatcgcgaaaagtcgccgttcgcatccgagcgctgccgtcgtggcgcacgcctgggcagctacgtcgtggtcgccatcgcggcgatctttttcgtggaccgctgcgtcatgtcgtttatcgacctggtgcaggtgagcattgtctcggattccaaccccagcgactttttgtcgagcctggtctacatgacctacaagagcggtgacttcttcattcgcggtatcgagatcaccatcgcgcttgccaccttcggcaccgtcatcgcattcttcctggcgctgctctttgtgttcctgcgtattcagaccttcgaccgcgtggataacgacctggtgcgcttctttaagagtatcggccgcggctttgcgaccatctactccaccatcgtgcgcggcacgcccatgatggtccagggcctgctcatctattacgcgggcttcaccgttttgcgcggcatgggcttcgagaccgcccaggccaaccagatttggagcaccttcaccgccggcctcgtcaccatctcgctcaactccaccgcctacatgatggaggtcctgcgcggcggcatcgagtccatcgatcccggtcaggccgaggcggcgcgctcgctgggtctttcgcagtggcaggctatgcgcaaggtcgtgttcccccagggcattaaaaacgcgattccggcgctcaccaacgagctcatcatcaacatcaaggattcgtcggtgctctcggtcatcggcgtgtttgacctcatgtacgctaccaccaccgtcgccggcgtgtactaccgccagatggaggtctactgcgtggcactcgtggtctacctgatcttgacgctcgtggcgagccgcctgctcgaggcctttggcaaaaagctcggcgccgaggctccggtcacgctgcccagctccaactaggctcaagacgaggagaatcatcatggcagataccactaccaccggcgctgtggccgccgcacaaactaaagagtcgctcatccgcgtcgagggcctgcgcaagagcttcggctcgctcgaggtactcaagggtatcgacttgtccgtcaatcctggcgaggtcgtcaccattatcggcgcttcgggttcgggtaaatcgacctttctgcgctgcctcaatctgctcgagaccccggacgcgggccatatctggttccatggccaggacctcacggccgagcgctgcaacattaacaagctgcgtgaggacatcggcatggtgttccagggctttaacctgttcaacaacatggacgtgctcgacaactgtacgctcgcgcccgtcacgctcaaaaagatgggcaaggtcgaggctgaaaaaattgcgatggagcatctgacgagcgtgggactcgaaaagttcgcgcacgccgccgtgggtcgcctgtccggcggccaaaagcagcgcgtggccatcgcccgcgccctgtgcatgaacccgcagattatgctgttcgacgagccgacctccgcactcgaccccgagatcgtgggagaggtgctcgaggtcatgcgcaagctcgctgccgacggcatgaccatggtcgtcgtcacgcacgagatggcctttgcccgcacggtgtccgaccgcgtggtctttatggacaagggcgtggtgctcgaggacgccgctccggccgagctcttcggcaaccccaagcaccagcgcacccgcgagtttctctcgcgttatctcgaggacaaataaccgaccgcaaacgcttatgtggcagggccgctccggtggggcggccctcgtcatcacgatcgaaaggacgttatggccgaggtttggcgcttctttgcgcatgaggatgattttgccgatttggacaaggccggcgcatgcgagcgcctgagccgcgtgctgtcgtttccgaccatttcgagcatggatgccgaggcggtggactggcagccgttcgacgacctgcgcgcctatatgcagcaggcctggccgcacgtatttgcggcgggcgaggtcgaactcatcgaccactcgctgctggtgacgttttccggctccgaccccgcactcaagcccgttatgctcatgggtcacatggacgtggtccccgtggtgccgggcaccgaggacgattggacgcacgccccctttagcggacaggtggacgacgcctacatttggggtcgcggcgccgtcgacatgaaagatcaagttgcaggtattctcgaggcggttgagtatgcgctggcccacggctgggagcacgagcgcaccctgctgctggcttttggccaagacgaggaaaccacgcagttcggtgcgggtgccatcggccgcgtgctcgaggagcgcggtgttgagctcgagttcctgatcgacgagggcgactaccgcatcgttccgactgccgagtacagcgcgggcgagggctggcttatgcatgccgatctcgcggagaagggctacgccgatatcgtgttgaggacgcgtagcgagggcgggcattcctccaacccctacggtggcacttcgctcgaggtgctgagccgcgccatcgccgcaatctgcgatatcgaatggccgacgcgcgtcacggacctgcttgccgcacagctcgtcgagctggggctctacacggccgacgagatcgcctccaacaaggacgccatcgtgcgcgagtgcctcgccagcaagaagctctatccgctcgtgacctccacctgtgcaccgacccaaatcgagggcggtagcaccggtgctaacgtgatgccgcaggatatgtgggccaatatcaatttccgcatgctcgagggcacgagtgtggccgatgtcgtggcccgctgttgcgtcgccgtcgccgaggcggggctcgccgaccgcgtcgagatcgagctcggccctggcagctccgaaccctcgccgtctccgcgcatcggcggaccgggactcgaggccgtccgtgccatcgccgcccgctatttccgcgatccaaaggggacggaggaaaacggatcatcggcggcgggcggagctcctatcggcatcgttccctcgaccgtgattggcgcgaccgatgctgccaactaccagcgcatttgccccgagtgcattcgcttctcggcctttgtggtagacgatgacgagtgcgagcgcggtgtccacggcaccaacgagcgcatcacccgccgcgcctacctccagggcgtacgcttcctcatcgctctgcttcaaacgctctagaatgtgacaaagggactgagccgatttcatcggtaatgagacaaaaactgtcatagaaaaagactaagatatcttaagagacatatgctggggttggtattccttgaacgactgcgggcatgtgccagactgcctcgccccccggggagtgcccgggcaggtcgccgtgtgactggggaggaaattatgcaggagctcagagagatgacgtctcgactcgtgaatattgctaccgggggggggtgtctaagcagggaacttcctggtgaacatcggccgcgcgagcggtggtccgtcatgtcttatggccgccgtcgtgggctgcgcccggtttcgccatatgcgattgttctggccctcgccgtcgcgctgacggcgagtttcttcctgccgcttcgtgccgaggcggcgatctccgaccacacggttccgacgacctcgccctcggggacgacgatcaacctgtttgattactgggtgaatcccgatgaccatctgtcggtttccggcagcggcggcgtcaacgcaggccacaagttccagtttaacgacggcaagggtgatgggccgctcaaccaatggacgggcagcacgagcccgcggcccggcatcgtcaacaacacgctttcagacggctacccgaagctttccgaagccttgggcgacgagtccctccgctacctgttcgattcctctgcccagaccggcaagacgtcccattttggcgtgacgggcctcctcaaggttcagggcggctactacgtctatgacagctccgaaaactacgcagcctacaacgctgacaagaatgccttcgacatctatggcacctggggcattgacaaagtgggcgattcgtcccaccagggtcagttcttcccgttcgacgcggcagacaaggtgttcaaagaggaaaacggccagctcgtccaaaccggcatcaaggcagacaacaccggtgattcgcactacaacggcggcaaacccgtcaaccaccacttcggtctctcaatgtccacgcgattcgtgcagcccaagggcggcctgacgaacaataataatgacatgaccttcgagttcgccggcgatgatgacgtctgggtgttcatcgatgatgtcctcgtgggtgatatcggcggtattcacaaccgcgcgagtctgagcatcaactttcatacgggcaacattaaggtaaacgacaattacaacggcacgctgaagagcaagtaccagaaggcgggcaaggccggcgacacgagctgggaaggcaacaccttcgccgacgacaccaaccacaccctcaagttcttctacctggagcgcggcgccaccgactccaacatggagctcaagttcaacctcgtgacggtgcccgagtccgacatcataaagttcgaccaggacggcaagttcgtacagagcgccgagttcgcgctgtacaaaacagacgagaactttacagatacgaccaatgacaagaacgcgctcctcggctccggcaccacggacgaggccggccacctaacgctcacgaacgacgatgacaacggcgtcatcaacttcgacgatctctacaacaagaatcacggtaacaagtactacctcctgaaggagacgcgcgtgccggagggataccgctcgagtctcacggcgacaggtggcagcatgcagctcgagtacgtgcccgcgagcgctgagaacggcgcgggcggcgtcatcatcaaccgcggcggtatggatgcggacagcgtcgtgtggaagactggtgcgtttgccggcgcgaaggagaccatcaccgcaccggtgaacgtgtacaaggcgaatgatgacctgacgaagtccgacgagaccgtcaacctgaagtctggcatactgttcgctgtggtgctcaagcgcgataaaagcgcaaacgcagatatcaaaaatcagaacaattggtacgccgtgtcgggcgacccatcgacgggaatggggtacaccctcgccgagaagccgagcaaggccggcgctatcgaggcggcgaagaaggacctgcacgccttcacgctcaacacgagcggccagtaccaggtagagattcaaaatctgcccggtgacatctccaagtactactacctgctgagcggtgatgcccgcaaggatgccgagtacacggtggccatctaccacacaacggcgagttccatcgccaacgcgaatacggacaacacggtccacgtgttcagcgatgacctccccagcggcgagaagaatttccagcgacagttcgccacgcgcctgctcgtcacgaacatccagaaccgcctgttcgtgcagaagaccgataccgcgggtaagcccgttgagggggcgaagttcggcctgtacacggccgatcaggtgacaacagacgcaaacggcaaggtcgtgctcaagggcgagcagaccccctacgacaccctgacgacggggtcggtcggcaacccggtcccgctcgaaggtgcgggcatattcccgaatacgagcaaggagcacaagccgcttacgaaacgcacctactacctgaaggaaatctcagcgccgagcggtttcctgctcaacgacacgctcaccaaagtgattgtggacgattacggcgtccatgccgatgccggtacgcgcgatgacggcgtttcgacgtttgtgggcccgggcgcgctgatgaagagcctgggccagtttggcgcagagagcgacatcgacaacacgctcacgtggatcaagggtgtgcggcagacctcgaatggtgtgaccgatactgacggtaatctgtcgtggagcaatgtcgatcccgccggtgccggcgacacggtgcacctcaagtacggtgccaacggacgtgtctaccagtatgggcccaccgaggagggcaaaccctaccgcctggagaccgagacgggctggatacgtatgggtatcacccaggacgagcagcccaaggggaccaagtcgaaaggtgcccgtgccgatctgcgcgacatgaacaacctgaatgccctgtttacgggcgccacctgcgtgcgcgtggctaacaagcgcgaggcgagcctcgaggtgacgaagaaggttgacgtgcccgatggactgacgggcaataaggatgcggagttcaccttcaagttcaccgtgcccaaggggaagacgtataaggctgcagtcttcgagaaggcgggcgcggccgatgagaagcaggtcggcgatatgttcgacctgacgaacggacgcgagcagaccatcacggccggccagacgatccgcgtgtacggtctcgccgagggtgacaagtatacggttcaggagctgacccgcgcgggcaagatgccggccggcttcacgctgaccaagcgcgagcagggcggcaacgccctgggcggcgagggcgacagcatctccggcacgatcgcgaaacagaatgccgacggcacgttggccgaagccaacaagctggtgttcacaaacacctacagcgtaaagtcgccggtgacgctcaccaatgcgttctgggcgcagaaggtgctccagggccgtgactggaaagatggcgatagcttcaagatttacctgcgcgcggacaagggcacgccgatgcccgacggtgccgagaatgcacccgtgagtggtatgaagcaggttgtgaagactgttgagaacggggacaagttcgacttcggcgagattgagtacaccaagcccggcacctacacctatctcatcgccgaggccacgccgtctcaaaacgacgctagctggctgcccgggttcgggtattcaagcgcttcctaccgcgtcacggtgacggtgaaggatagcggcgacggcacgctgtcgcagccggcagtcaagatggagcagacctacaccgacgacggcgtgagccatgaggacagcccgatcgaggttgctgacaaaatcgccaagataacgaacacctataacaccgatgagaagaccatctccttccacgtgcagaagacgtatgtcgaccagtccggtgcaaatccgcttgtgaaggataagttcacgttccagctcgaggcactcggcgggatgaagaatgatgccgtgccgagtggcacccttaagttcggcgatcttgcctacagcgtcgatgccagcaaggtccccatgcctatggggtgcacgtccaccacgaccacggcgaagaacgatgacggcggtatcgccgcgttcccgcagatcacctatacgatgggcagcgagaacctcacttacgtgtacagggtgaccgaggtcaaggattccgatacatcgacgtccagtggcatgggctacgatgacgcggtgtactacgtgctggtgaagaaccagcaggttgataacgagtctgggacgggtaggtgcctgtcctccacggtcacgtattggaaggccgacggcacgcagctgacggacgccaacggatacattccgttcaagaacacctacacggtgacccaggcgacgtcggcgccaatcagggtgcagaagacgttcaccgggcgcgcgtgggagacgagcgatacgtttgatttcacactgacgccggcggatgacgccacgacgaaagcggttaaaaacaaggtcgttatccaaaagacgggcacgggcgaggacgttggggatattgctgctaagatttcgatctccggcgatggttcttccgtgacccgtaccgcagcctttggtgtgggcgacctggtgtttaccaagcctggcacgtacaaattcaaggtgaacgagaaggcgtcggagaacgtggacaagaccggcatcagctatgacggccatacgtccacggtgacctacacagtgaccgatatcgagaacggcacgcataccggtaagctgaccgcgacggttgcgtacgacaacaagcaggcgatgacggatgtcgaccgacaggtgacgggcgctgccgcgtttaccaacacctatacggcctccggtacctatgcgggcatcgatgtgaccaagactctggttggtaccccgctgaagaatggcatgttcccgttcaccatcgaggcgatgacgtataacggtacgacggccccggagccggctgataccgataagtcgttcaagaacaccgtgggcaaggatgacggtgacgatacgcagaccgccacgatgtccggcaagctgaagatgaacttcacgcagctgagctacaacaaggtgtatgtgtacaaggtgtctgaggcgcatggcgccaacgctggtggatacacgtatgacaccgagtaccccggtgacgcctacgtgctcattgcggtgacgccgaatccggacaacaaaggccagctctacaccgagacgaccatcgtgaagggcccggacgtgacggcgctcgttggcgagaacgacaacgttgatgcgctgacggccgaggcgattaagggcctcgataccacgaccaactacgtgaagacggtctcgagtcgcaatgcgaagcccgctacgcctaccgtcccgttcaagaacagttacaagtcagacgccagcgacgagctgaccccgcaggtgacgaagaagatctccggtgttgagagcacggagaaggcgttctcgttcacgctgaccgccacggaagagacacagcagaagatcgccgccggcgacttgggtgtgtcggacgacctggcgggcgacgcgcacgcggagtccaaggtcacgagtggcaagatcatcaaggacaagggccagacggtcgacttctcgaatatggcgttcaacaaggcgggcgagtacacgttcacgctcaccgaggtgcacaacgctgatgatgatcccgcggcggacggcgtgcagaacgccggctggacgatggacgattccacctacaccgtcacggtgaaggttgaggacaagaatgccaagctgactgtcacaggcgtgacggtagagaagggcggcgatgacaagagcgagacgcttgaggtcaagaacggcaaggtgaacctcgccaccttcaacaacacctacgacgcaaagggttccgtaaccctggcggcgaagaagcactttacaggcggcacccttgagaaccagcagttctcattccaggtgaaggagggcaataaggttgtcgccgaagaaaagaacgatgccaatggcaacatcaccttcccggccatttattacaccgaggccggtgagcacgactacaccatcaaggaggtcgaaggcgccgacccgactatcgtttacgatggcaagacggtgaaagtgcacgttagcgtcaccgataacaagaacggcacgctgagcgcggccgccacctacgacggcgagaaggccgtgccgaccttcaccaactcgaagccgacggccgacgccactatcgaggcgacgaagatcctcaagggcaaggacctgacggctggtgcgttcactttcggcctatatcaaggcgacacgactacggttgatcccatccagactgtccagaacgacaaggacggcaagattaagctcatcctcaccggtctgaccataggcgagtacgactacacgctcaaggaggtcgctgacagcgattcgaccatcacctacgatttcacggcggtgaaggtccacgtctcggtgaaggcggacggtgacaaggcaaaggcgactgtcacctatgacgacaagaatgatgccccgaccttcactaacaagtatcagcctgccgagaccttggctacactcacggcgaagaaatcgtacgtgaagtccgacaacacgcaggccacgctcaggggcggcgagttcaccttcgacctgtacgagggtgatctgacggctgagcagctgaagggcaagcagcccatccagaccgctaagaacggcgaggacggcaccgttaccttcccggccatcaactacaccaaggccggcgagtacaaatacactatcgtggagcagaagggcgacctgtcccacgtggtctacgacgatgcggttcaccacgccgtggtgaaggtcgtggacaacgccggccagttggaggcgagcgtcacctacgatgacggcaagacggtcgcccccaccttcacgaacacctacaccgcaaagggatccgtggagctgacggcgaccaagatcgttgcggtcgcgccgggcttcacgcacgacaccaagctgaagggcggcgaatacacgttcgagctgaaggacgccgacggcaaggtgctcggcaccacgacgaacaaggccgatggcacggtgaagttcacgcgcaagttcacgctctccaacctgggcggcgctgcgagcaaggacttcacctacaccatcgcggagaagccgggcacggagccgggcatggtctacgacacccatgcgctcatctacaaggtgacggtcgcggacgatggcaccggctcgctgacggccacaccgcaggtaacgagtggagacaagaccttcacgaacacgtaccacccgaaggagacctcggtaacgctcaaggcgacgaagcgcttcacgggtggcgagctcgcagggggcgacttcacgtttcagctgctcgacaaggatggcaacgtgatccagaccgtccagaatgacaaggacggcaaggtcgccttccaggcaatcagctacgacacgccgggcgatcacgactacaccatcaaggaggttgccggcaacgacccgaccgtcgtgtacgacacgaaggacgtgaaggtccacatcaaggtctccgatgagaagggcgagctaaaggcgaccgccacctacgacggcgaggccgacgttccgacctttaccaactcgaagccgacgacggacgttaccgtcgaggcgacgaagatcctcacgggcaaggacctgacggccgacgcgttcaccttcggcctgtacgaccaggccggcaacgaggtcgccaagggcaccaacgaccggggcggcaaggtcgagctggccgtcaagaacctgaacctgggcgagtacgactacacgctcaaggaggagaaagccggccagaccgtcgacggcgtggcctacgacgccaaggaagtcaaggtccacgtcaaggtagagcagaaccagggcgacaacaacaagacgaaggtgaccgtcacctatgacggtgccgctacggctcccaccttcaacaacacctacgacgcaaagggttccgtaaccctgacggcgaccaagaccatcaaggttgcggacggcttcgaccacacgacgaagcccgcggacggcgagttcaccttcgacctgaaggacgctgccggcaacgtgctcgacaccgcgaagaacgatgcaaacggcaaggtcagcttcacgcgcgagttccagctctccgacttggacggcgccgcgagcaaggacttcacctacaccatcgtggagcagccgggcgcggagccgggcatggtctatgacagccatcccctcacctatacggtgacggtcgcggacggcgggaacggagcactgaatgcgaaggcgatcgtgacgagcgcatccggctcggataccttcaccaacacctaccagccggccgcgaccggcctggccctcggtgcgcagaagagctatgtgaagaaggacgacaacacgccgatcgtccccaagtgcggcgagttcaccttcgatgtgtacgagggcaacctgacggctgagcagcttgccggggccaagcccgtccggaccgcgaccaacggcgcggacggaagtgttaacttcgacgccttctcctacgcgaagccgggcacgcacgagtacaccatcgtggagcggaagggtgatctggcctacgtgacctacgacgccgcggtgcaccatgccgtggtgacggttgcggacaatgccggcacgctgcaggcgagcgtcgcctacgacggcacgaatgtcacgaagcccagcttcaccaacacctatgaggcacaggcgacggactccggcgcgatcgccctcaccaagagcgttgacgtgcacgacggcagctatcagctaaaggcgggagacttcgccttcgagctggtggggtctgacggctcggtgatccagacccagaagaacgatgcgcacggcaaggttgccttcgacaagctgaccttcgaccatgcgggcacctttacctacacggtccgcgaggtgcagccgacgggggacgcgccgggcgtgccgggcgtgacctacaccggcaagacgtacaccctgacctacgtggtgaaggacaacaacgacggcaagctggtggtagagaactccacggtgaagccgagcgagggcaccgagaacggcgtcacccccaacaccatgacgtttgcgaacagctaccagccgggcgcgacctcctaccagatctccggcaccaaggtgcttgagaataccgattcggccaccatgcggacgcccgccgatggcgagttcacgttcgcgctgattgacgtggccaccgggcaggagatcgaccggaccacgaacgtgggtaacgcgtttaccttcaaggccatctcgtacaccgcgactggttcgcatgcgtaccaggtgaaggaggttgcgggccaagatggcaccatcacttacagcgatgcggtgttggatgtgacggtgagtgcgaccgacgacggcagcggccagctgaccgcgacggcgaacaagacggccgcggatctgaccttcaccaacacctacacgccgacggcaacgacggcgacgattaccggaacgaaggccctgaccggccgcgacctggccgagggtgagttcttcttcgacctgaaggacgccgacggtaacgtggtgcagacggtgcagaacggcgccgacggcacgttcggcttcgcgccgctgcagctggacaaggtggggacgtacgtctacaccgtgtccgagcgggcaggggcgacggcgaacggcgtcacctacgacacgacggtctttaccgcgacggtgacggtgacggagaatgcggagacgcacgcgctggaggcgcaggttgcctacagcaagggcggcaaggctgcggatgcggtggcgttcagcaacagttacgcgccggccgcgactgaggtgaagctgggggcctccaaggtgctgagcggcgaggacctgaaggaagggcagttctccttccagctgaaggatgccgacggcaaggtgctgcagaccgcaaagaacgcggcggacggcacggtgggcttcgaggcgatctcgtacgacaagcccggaacgtacgcctacagcatctccgaggtggacgacggtcagaagaacgtgacgtacgacgcggccgagcaccgggtaacggtgacggtgacggacgacggtgcgggccatctggtggcgacggtaacctatgacggcgccgtggcgccggtgttcaagaacacgtacacgccgccgaccaccccgccgacggagccgcccaccaatccgccgagcaagtcaccggtgccgaaggaggagaagccgggtctgccgtatacgggcgataccagcttgtcgccgatggccctgggtggcatcgcgggcggcgcggtggtgctgatcgccgcaggcgttatcctgcggcgccggaaccggtagctacggcggccgagaagggctttgattgagggcgggtggtcgcagggcgcggccgctcgccctttttggtgaaaggctatgttaacccgccgtttgcacgtccggctccagatggaactcgtactccggctccatcatcttcttccggatcttttcgtagcgcccgtcgtcgagctgctcgcgcatgagcgacgtcctgtccccgacgcgtgcggcctcgcgcagccatctgaaccacatcaggcagctgtggagcctgcgggtcgatacgcccttgaacctctcgaggaagtggccgagcgaaccctgcgcttcagcatcctctggaccgtgtcccgctcgtacccggtgagcctgccgtgggtcctcgggaccgccctcgcggcgcccttcccgccctttccggacatggcgtcctccgatctcccggggccggccgatccggccctcagggtatcggattcccaaatttatccgtatatgtgcggatgaatgcgggaggcgttcggatgaagttgtattcaaggaaagagactgaccctttgtcgcattccgtgcgggttatatgcaggtatgcctgcgcacgctatcatgtatgggttagaccgcaactatgtacctcatacgcgaagggatgcgcatgtatctgaagatcgacatgttctagctgggcttacccccgcagtggcgccgcgcgccccatcaactctgccgattttcgccttcacgcacataaaggagtcccgccatgcgcgacaagctcgaaaagatcattaaggcctacgaggagctcgagaagaagctttccgacccggccgtcgcctccgacatcaaggagttcacgcgtctcaacaaggagtacgcacaccagtccgacctcatcgctgcctcgcgcgagtacatcggcgcgctcgatgacatcgaggccgccaaggagatgctccgcgacaccagcgatgcggacgagaaggagatgctccagatggacatctccgagaacgaggaaaagcttccccagctcgaggaagacatcaagtacatgctcatcccgagcgaccccaacgacgacaagaacaccatcgtcgagattcgctccgccgccggtggcgacgaggcagccatcttcgccggcgacttgtacaagatgtaccagcgcttctgcgaatcgcgcggctggaagaccaccgtgctcgattccagccccagcgaggccggcggctttaagtccatcgagttcaaggtcgagggcgaccgcgtctactccgtcatgaagttcgagtccggcgtgcatcgcgtccagcgcgttcccaagaccgagtcccagggccgcattcagacctccacggctaccgtcgccgtacttcccgaggccgaggaaattgacgtccagatcaaccagtccgacctgcgcatcgacacctactgcgcctccggccctggcggtcagtgcgttaacactacctactccgccgtgcgcatcacccacttgcccaccaacaccgtggtgcagtcgcaggagcagcgctcccagattcagaaccgcgaggtctgcatgcagatgctgcgtgctcgtctgtacgagatggagctcgagaagcagcaggcagagcttggtgctgagcgccagagccagatcggccacggcaaccgttccgagaagatccgtacctacaaccagccccaggaccgcgtgaccgatcaccgcatcggtttcaactccacctacaacggcgtccttctgggcgatcagctcggcaccgtcatcgaggcgctcgccgccgccgagcgagccgagaagctggcgcaggccgtgtagtaggttccgccgttctaccgaacggcggaccggccgacgctgcgcgccgcccagagcgacaatttgtcattcaaaaggcaaggcatgaccagaaggtctatgccttgcctttttcattcaagactttagtccgctggccgcgcagcggccagctttaaaccacccgctacgaccgcaggaagcttggatacgcctaggcgcggtccaagaaatcgtccgcacccccgatgggctgctagaacccaaaaacaggaactatttcaccgcaactgatgaggggatgggttagcgaagcaggccggctacttcgccggctagggtgatggtgccggctgctacgaaggactcgcccgcggcatcgaaggcagcgagggcctcggacacgctcgggtatacgcccacgagcttatcggcatcaacgagggcggcgagctcctctgccggcagggcgcgatcggaatcggtctgggtcacgaccacgcgggggaacgccgggatcaacacgccgacgatacccgccacgtccttatcggccagcgcggcacacagcagcgtggggcgattctctacgcacggatcgatctcgtccagcgcgctcacaaagttctcgcagctctgagggttatggcaggcgtcgatcagcttgagcggatcggtgcccaacacatcaaatcgacccggcgtgggacagcccataagcgacacatcgagcttgtcatggtcgagctcgcggcccagatagccctcgcacagcataatcgcgcacgcggcattctgcggctgataggccggcttgaccatgctcgacgtatagatcgcacgcggcgtagtgcagctaaactcaaccgtatcgcccacatgagccggcactttagtcgtggtgtggctcaccacgaacggcacgacgccgcactcacggcaacgggcatccatcacgcgctgaacgctcgcctcgtgcgtaccctcacccaaaacaaccaagcgcccgggtttgataaccgcagccttctcacccgcaatggcctcgagcgtgtcgcccaaaatgcgtgtgtgatcgagcccaatgcccgtaatggcgacagccacgggatcggtcgcgctcgtggcatcccaacgcccgcccatgccaacctcgagcacggcaacatccaccgcggcctcggcaaacactacaagcgcggcagccgtcagcaggtcaaacggcgtgatggtataggcgcgctcccccgccgccacacgacgggcattcacgcgacgccccgcctcgacagctgccgaaacgccacgggcaaaggcctcgtcgctcactacgcgtccgtcaacctccatgcgctcgggatagcgaacaagctgcggcgacgtatacagcgcggtcttgagcccctcgccgcgaaggatagcagccgaaaaacgcgtagtcgaagtcttgccattggtgccggctacctgaatgcaatcaaaatactcatccggacgccccagctcatcgagcatatcgacaaccgtctcaagcagaggaccagcatccccagaaatccgccccgtatcggcagccagcccaacagcctcaccaaacgaaagcaactcaaacgagaacggcacagaatacgaccccgaacgcttaggcataaaccaaagtcccctcaacataaaaagaggcccgaatcaacaacgagcccctcccatacaaaatatcagccaaacaccgctttgcagcagaatcaaggccacaacccagtggcccttaccggcaggcagcaaacgccccgtaaccgctatgggagcggattggggctttgctcgatacaagttccgcacgagccgaaggccacttaatgtggccttcgtgcgagcaggactgtccgcagtagcgagcaaagccccaaaccgcgtcccccagtaacgcttacgagaagtcagcaacctgggcagtcagcgccgccaggatctccttgagctcagctgcacggtccctcttcttctggaccacggcaggcgcggccttagccacaaagccctcgttggccagcgtcttctcgcagccggcgagctccttctgggccgcggcgatctccttctccaggcgtgccttctcggccgaaaggtcgaccttgccctcgagcaccacaaagacctcgacgccgctgtcaacaacagcgatgctcgcagccggcttctcaacgtcggtacccataaccagcgaagcggtgttggccagcggctcaatcgtggagcgtaggctctcgagcttctcgatgtcctcggcaccagcgcgcacgacaacgtcaagctcggccttggggctcaagcgataacgcgaacgggtagcgcgggcggcagacacgacggtacggcacagctcaaacgcgcgctcggcgtcctcgtcaacatacttggcgtagtcggcgggctcgggccacttggcgagcatgagcgccacggcgcggtccacgttgcccacggcgtccagatcgagcacgctcgccggcatgttgtcccagatctcctcggtgacaaacggcatgagcgggtgcatcaggcgaatggaggtgtcaagcacaaaaatcaggttgcgctgagcctgcagacggccctcgcccttcaagcgggccttggtgacctcgacgtaccagtcgcagacctcgttccagaagaactgctgcacgccgcgggccatatcgccaaaggtgtagttctcaataccctcggtgaccatcttgacggccttggccaggcggctgaacatccaggcgtcggccggcgtctcaacgacgggctcgccgggcgtgtagccctccatgttcatgagcaggaagcggctggcgttccagatcttggtcacaaacgacttggcctgctcggtgcgcgagctgtcgataagcttcttggtcttcttatcgatgttcgcgtcgaacttaacgtcctggttgttggtgcacagcgtaagcaggttgtagcgcatggcgtcggcgccgtacatgccaatgaggtccatggggtcaacgccgttgcccttggacttggacatgcggctgccgtccttggcaaggatcgtcgggtagatgacgacgtccttaaacggcacctcgtccaggaagtacagcgagctcatgaccatgcgagcaacccacagcgcgatgatgtcgcgcgcggtgacgagcgctgtcgtggggtgatgtccctcgagcagctccggcttttgcggccagccctgcgtggcgaaagtccacagctgagagctgaaccaggtgtccaacacgttctcgtcctgatgcacgtgatgaccgccgcacttggggcacacgtcggtgtcctcggtaagggcgtcctcccagccgcagtcctcgcagtagaacacggggatgcggtggccccaccacagctggcggctgatgcaccagtccttgaggttctccatccaggtggtgtaggtctgcgtccagcgcgcagggtggaaggtgaccttgccggagttgacggcgtcgagcgccggccccttgagcttgtcgacggccacaaaccactgctcggaaagccacggctccagagcggagtcgcaacggtagcagtgcatgacggagtggtcgagctcctcgacatggtcgagcaggtcgtgctcctcgaaccacttgatgacggcttcgcggcactcgtcgcggttcatgccggtgaactcgtcgtagccctcgacgaccactgcgtgctcgtcgaagatgttgatctgcggcaggtcgtgggcctgacccatagcgtagtcgttggggtcgtgggccggggtgaccttgacaaagccggagccaaagttggcgtcgacatgccaatcctcaaagatggggatctcgcggtcgacgatggggagcttgacggtcttacccacaaaggcggccttctcggggtccttcggggagacggcaacgcccgtgtcgccgagcatggtctcggggcgcgtggtggcgacgacgatgtagtcctggccgttgaccggctcggtcagcgggtagcgcaggtgccacaggtggcccttctcgtccttatactcggcctcgtcgtccgagatggcggtggtgcagttggggcaccagttgacgatgcgcttgccgcggtagatcaggccgtcgtggtaccagtcgcagaacaccttgcgcacggcctgggcgtagtcctcgtccatggtgaagcgctcgttatcaaaatcaacggagcagcccatgcgcttgatctgctcgacgatgatgccgccgtactcgtgggtccaatcccagcaggcgtcgacaaacttatcgcgaccgatctccaggcggctgatgccctcgctcttgagcttcttgtcgaccttagtctgcgtggcgataccggcgtggtcggtaccgagcacccagcgcgtggacttgccgcgcatgcgggccatgcggatgatggcgtcctggatggagtcgtcggtggcgtgacccatgtggagcttgccggtcacgttgggaggcggaatggtgacggtgcagtcgcccacgccctcacggcgcttgtagtagccgccgtcgagccacttctgcaggatcgccggctcgttggtcgacggatcgtaattcttgggcatttcttccatatatctctcccttgcccgtcggcgtgtccgcctgcttggttttcgctcggtcaggtcctgggctcgcacgaagagcacatttagtgctcttcggctcgtgcggaatctacgaaaaccaagcaggcggacacgccttaggtatcgattacttcagtctgaaggtactaacttgacaacctcacagaatagcacaggcatacctgccgaaaagggacaggtttattttggtaggttttatcaggggaaacgacatttgcccatataaaaccgaccaaaataaacctgcccctaaatggcaggtcccgcggaggttgccgcgggacctggattcaagctatttacccgtagatgcgctggggctgctcttcgccctttacggaggcttcggtcacaacgaccttggaaacgccctcctcgctgggaaggtcgaacatcgtctgctgcagcacgtcctcgcagatggaacgcaggccgcgcgcgccggtcttgcgagcgagcgccatacgggcgatctcgtgcagggcggcgtcctcaaactcaagctcaacgtcctcgagctggaacatcttgcggtactgacgcaccacggcgttcttgggctcggtcaggatcgacaccaggtcgtcctcgtcgagcgcctgcgtctgggtgacgacgggcgtgcggcccacgaactcggggatcatgccaaaggcgttgaggtcctgcgggagcacctgacgcagcaggtcgttctcgtcgaccgaggtggggccggcgatctcagagttgaagcccacgcccttgttgcccacgcgatcggcaatgatcttgtccagacccacaaaggcaccaccgcagatgaacaggatgttggtcgtatcgatctgcagcagctcctgctggggatgcttgcggccgccggtgggcggaacgcttgccaccgtgccctcaagaattttaagcagtgcctgctgaacgccctcgcccgaaacatcgcgggtaatggagaggttctcggccttgcgggcgatcttgtcgatctcgtccacgtagatgatgcccacctgcgcgcgttcaatgtcaccatcggcggcgttgataagcttgagcaggatgttctccacgtcctcgcccacgtaaccggcctcggtgagcgcggtggcgtcggcgatggcaaacggcacctcgaggatgcgcgcgagcgtctgggcaagcagcgtcttaccggtaccggtgggaccgagcagcaaaatgttggacttggcgagctccacctcgtccatatcatcgtcgagctgcgagtccaaaccgtcgtcaaaggccgaaagcgcagcgccgccctcgatcacgcggcggtaatggttgtacacggcaaccgacatggcgcgcttggcgtcctcctggcccatgacataggccgaaagctcgtcatagatctcatgcggcgtcggcacatgcgtaatgacttggcgggcgtcgtcctcgagctcaaagccctcggcctcgggatccacggcgggctgggatgcagcctgactgtggtcgttgaggaagcccggcagcttgccgttgcgggcagcgtccataaagtccgaagccagcgactcctccagaatctcggaacaggcggcgacgcactcgtcacagataaagatgttggtcgggccctttacgaggcgacggacctggccctgctcttttccgcagaaggagcagcggatggggttgccgttctcgtcaaagttgtcctgcatgttaccggtcatcctaggcgtccttcgcggcgaggtcgcgcgaggtgacaatgcggtcgatcagaccgtagtcgagggcctcggcagccgtgaggtagttatcgcgctcggtatcggcctggaccttctcgatgggctgacccgatgcgtcggacagaatctgattgagctcgcgacgggtcttcttgatctcctcggccacaatctcgatctcggtctgctggccctgcgcaccgccgctgggctggtgaatcatgaccttggagtgcggcaggcagaagcgcttgcccttggcgccggccgaaagcagcacggctgccatggacgcggccataccgacgcaaatggtggagacctgcggcttaatgaagttcatggtgtccagaatcgccaggccggagtaaacctcgccgccgggcgaattgatgtagagcgagatatccttctcggcatcctggctctcaagatgcagcagctgggcaacgaccaggttggcgctgacggagttgatttcctcgcccaagaagatgatgcggtcgttgagcaggcgcgaatagatatcgtagctgcgctcgccgcgcggcgtctgctcgataacgtatggcacgagggcggaatcgaacttggcgatcatacgcatctccatttctcttacggaccaaattggttctagataaacgtacggtgcccgcatgctatgcattggctggcaccgtacgaagcaaccggataaccggtgtataactttaccccatcacgggcgcacgcatgcgctcgcgagcaaggtggcgagaattactcggcgtccttggcggtctcgtcgacctcggtcaccttggcgttctcgaccaggtggtcgacggccttggagcgacggatggactcgcggacggcaggcatacggccatcggcgataaactcggccttggaagcctcgacgtccttgacgccagccttctcgaactcggcgttgacgtcgtcctcggtgacctcgatcttgagctcacgggcgagggcgtcgagcgccagggactcgcgggcaacgtcgttggcctgcttgtgcaggtcgccgacgaactgctccatggtcaggccggaagccggcagccaggtgtcgagcgtcatgccgcgggcagcgaggttggacaggaagttctggccaagctcctcaaagacggactgctcgtagtcggcatccatctcgtcgagctgcagacgctcggcgagagcggagacgcaacggttctccttctcggccgggaggcgggaagccttgtcctgctcgatctcaatcttgatggcgtcgcgcatagcgtcaatgctgtcgaagccaaagtcggacttgacgagttcgtcggtgagctcgggggtgttgcggaccttgatgcccttgacggtgacctcgacggtgtgggtctcggcctcctcgccctcctcgacctcgtcggtccaggtgacggacttgacgtcgtcaacgttggcgccgatcagggcctcgttgaactccttggggttgctatcgctaccggcgatgagcatgcggccctcggcggcaaagttgtcggcgttctcgacggccttgaggtcgacggtcacatagtcgtcagcctcgacggcgcgaccctcgacatcctcgaaggtggcacggtagttgaggagcatctcaacctggttgttgatctcggactcggtgacctccgcgggaggcatctcgatctcgacggcgtcgaaggaggagagctcggcagcaggacgcagggagaactcgacggtgtaggtgtagtcctcgtgatccttggcgaggtcgagctccttgtagtcaccgttcttggtggggacgatgtccagctcgttgaggacggcgggctcgttggcggcgatcaggtcgttggtggcctgagcgagggtagcctcggcgccaagagcggagtcgatgaccggacggggggccttaccggcgcggaagcccgggaagcggtacttcttggcggtgtccttgtaggccttcttgatcgcggcgtcgacgtcggcggccgggatggtgaccgtagcggtgagcttggcgtccttgacgtcagaagcggtgatgttcaacacgttcctcctcatactgcccagcttatctgaggtgctggtacctttatgcaacaagcgtcgcgagggcataagccgacgcgggtgcgttggtgcgggcgaaaggactcgaaccttcacgggaatcccaccagaacctaaatctggcgcgtctaccaattccgccacgcccgcatgagcgcacagattaggaatgatagcagatacgaacgacaagcgcacgcacaccttttacaagctcacgacctcaccacgagtacgcatcggatcccccgccgccccaccgaagttgcggtggaatagggactgtttggggctccagtcctccaaaacagtccctattccaccgcaacttcggtaggactcggcagtctggcggtgctggccatgtgccggaaagcgtgtcccggtttggggcctcggaatgggacacgatttccgctatagccatcaaccggaaactgcaacccgttttgagcccctattccgggatgcactttccgccgagggcctcaaacggaaactgcagcccacaattcggtcgaaaagtgggctgcagtttcccagggctaggcaaagagcggcggatgcgtcgcctcgcctactcccccagcagcgctttctcgggcgtgatcggcagcgatcgaacctgatgtccggtggcgtgtgccacggccgaggccacggcggcgagcggcgtgttgatgacgacctcgccgatcgacttggcgccaaacgggcccgtcggctcgtagctcggctcaaaggccacgcgaatgctgccgatatccaggcgcgtgggtagcttgtagctcataaagttgccggtgcgcaggcgaccgcggtcgtcgtgctcgacgatctcgtagagcgcatggcctataccctgggcaatgccgccctcggcctggacgcgcgcgagcgcctcgttaataacggtgccgcagtccacagccgccgcgtagtccaccacggtcaccttgccggtggccttatcgacctcgacctcggcaatgccggccataaacggcggaggcgaaacgggcaggcaggcagaggcatgcgaggtgagcgcgtcgccgcccgcgatgttcttgacgcacaggttggcaaagtcgcgcagcgtgaggtagcggttctgctcacgcgcggcacgctcgtcggacaggcgcacatactgaccatcaaagaccacatcggcggcgtccacgtcccacatctgggcggccttggcgcagatcttctcgcgcagctcggtcgcggcgttcttggctgccagacccgtcacgtacgtgcccgagctcgcgtacgagccggcgtcgaacggcgaaacgtcggtgtccacgccgcgcaccacaatgagcgagctttcaacgcccagctcctcggcggcaatctgcgccaggatcgtgtcgacgcccataccgttatcggtggcgccggtgccgatggtaataaagccgtcctcttccaggcgcatgtcgatgccggcgatatccacgttggaaatgcccgagccctgcatggtgagcgcgcagcccagagcacgcacgcggtcgcccaggnnnnnnnnnnggtcgacggccagccgcttgtcgcgccaaccgatcatgtccatcgcgcgcagcaggcagcggtcgagcgcgcaggcgttgagcttctcgttgtagtactgcggcatgatctcgccctcgtgcaccatattcttaaggcgcaggtcggcgggatccatgtgcagcatgtcggcgagctcgttgacggcactctccacggcaaactggccctgggtggcaccgtagccgcgatacgcgccgccacggttggtattggtgtagacggcgtcccagctaaagcggctcgccttcacgtggttgtagatgggcaggctcttgtggcccgagaggccgatcgtcgtggtggcatgctcgccataggccccggcgttggacagcgtatgcagatcgatggccgtgatggtgccgtcgttcatggcgcccagcttaacggtcatctgcatctggtggcgcgagttgcccgcggtgatggtctcctcgcgggtgtagcagcaatagctcggacagccggtctgctgggtgacgaacgccacgaagatctcgcagcagcccgtctgcttggagccaaagccgccgccgatgcgcggcttaatgacctgcacctgcgactgcgggatgtcgagcgactgcgcgaccatgcggcgcacgtggaagggcacctgcgtggaggtggtcaccgagatgcggccgaacgcgtcggtcgtcgcgaaggcgcggaaggtctccatgggcgcggtctgcgtggcctggctggtgtaggtgcgctcaaagacgatgtcgctctgggcgaacgcctcgtccaagtcgccatagtcgctcatgccgctgcataccaagttgcgcggaacgtcgccgccctgcgggaacataaaggtcacgtcgccctcggggtggaccacgatgtcgttatcgagcgccttggtaaagtcgagcaggggctcgagcacctcatagtcgaccttgatgagcttgagcgccttgtcggcggcctcctcggtttcggcggcgacgatagccacctcttcgttttggtaacggacgagattctcgagaatcaggcggtcgtagggactcggctgcggatagctctggccggcgatggtaaagcggcgcttgggcacgtcctcgtaggtgtagacgcccaccacgccgggaaccttcagagcgcgcgacgtatcgattgagcggatattggcgcgggcataggggctgcgcttgagtttgacgatgagcgcaccggcgggcaccatatcaccggtgtagacgggacgaccctcgagcagggccttcgagtccttcttgggctgcttcttggtgatctgcttgtacgcgacaccgtcggagctcgtctcgttgacgggcagctcgggcatctcaaagcccacctgcacgccggactcgttgaggaagcgaacgatggcgcgcagctggctctcgtagccgctgcagcggcagaggttgccggcgagctggcgcgacagctcctcgcgcgtggcgacgaggctcgggtcctccttggcagcgcgggcaagcgccagcacgttcatgatgaggccgggggcgcaaaaaccgcactgctcagcgccttcggcagccatcgcacgggccagcgcctcagactcggctttgaggccctcgagcgtggtgatggtgtggccctcgacgcgagcggcgggaaccgagcagctcagcaccgggtcgccgtcgagccacaccgtgcacaggccgcagttggtggtttcgcaggcgcagcgcaccgacgcacaaccctgctcgcgcaacagtgcaaagagcatggtgtcgggggcaatctgaaccttgaccttacggccgttgagcgtaaaggaaagatcgatgagtttggcagccattagcgcacctcgctagaatcgacgccgggcacgcggcggcaggaatactcgtccgtggcaaacttggggatctgcacggtctcgagctcgcgggcaagcgcggccgaaagctcgatgccggcggcgcggcgcacggcctgcacggcaagcggggccgagatgcggcggcggtaggcggccgagccccacaggttggtgccgtagctcagggcgcgcacagaagcggccagagcgcgaagctcgtcctcggaaggctgctcggcagtaaggccgcatgcctcgccctgcagcagggtcgcgcgcagcgggcgggcgcccacggtgacatgccagctgttgttccaccaggcggcagtgacgtttaaggaggggaagtcggtcgcggccttgcgcacgacctcgtagctcgcacggtagtcgtgcttaacgactacgatgtgctcgatcacgtcgcgcacgtaacccatgtccacgaactcggcgagcggcacgcggccggcgcccgtcagctcaacataggaatcgagcgcgaggaaggcagtgagcacgtccgagaagccaaagcggccgtaaatgctgccgcccaccgtggcggtattgcgcaactgcacgcccacgatatcgtggacggcaaactcaaagacatggttgacaagcgcgttgagctcggcatgacgctcgagctggcgcagggtacacatggcaccgatgcgaaactcggtctcggtctcctcgatctgatcgagtccgcaggccgaaaggtcaatcgccgtcgcgacgcgacgcgagcccaggcgcatccaaatgccaccgcccacaatcttgttgttgcggttcttctgtaagagctcataggcttcggccgcatttccaacacggacgtaggtaccgaacttgagcacgttctcccccatctcttcacttgtccagtacttttaagtgtaccaaacgaggggccgcacaccgttttaggacaaaatccacccacccatccataacttgcggtgatatacggactgattagccgttctggggcgctaaacagtccgtatttcaccgcaagatatgaggagtcctccgggatagaaaaggctcccagccggatagctgggagcctcatcacatgctatgtcgcgcgaagatttagcagacgccctgggcgagcatagcgtcggcgaccttcaggaagccggcaatgttggcacccatgacgaagttgccctcctcgccgtactccttggcggtgtcgtccacgttgtggaacatgccgcgcatgagctgctcgagcttgccgtcgacctcctcgaaggtccaggacaggtgctcagcattctggctcatctccaggccggacacgagcacgccgccggcgttggcagccttaccaggcataaaggcgacgccgttctcctggaagtaggtcgtggcctcgatggtcgtgggcatgttcgctccctcgccgaccaccttgcagccgttggcgacgagcgcctgggcgtcctcgagcagcagcgtgttctcgcgagcgcaaggcagtgcgatatcgcagggcagctgccacacgccgcggccgtcgccctcgtgccacacggcgttaggcttctcgtcaacgtacatggcgagcgtaacgcccttgtcgtggccggagcgcttcttgttgtagacgtgctcgagcacggtgtagtcgatgccgtcgggatcctcgacccagccgtgggtgtcggagcaggccagcaccttgccgccgagctgggaaaccttctggacggcgtagatagcgacgttgccggagccgtgcacgacgacgttcttgccctcgaaggagtcgccgcggctcttgaggtactcgtccacaaagtaggccagaccgtagccggtggcctcggtacgggcgagcgagccgccaaaggagaggcccttgccggtgaggacgccggtccactcgttggtcaggcgcttgtactgaccaaacaggtaggcaacctcgcggccgccaacgcccaggtcgccggcaggaacgtcggtgttggggccgatgtggcgatagagctcggtcatgaaggactggcagaagtgcatgatctcgttgttggacttgcccttggggtcaaagtcggagccgcccttgccgccgcccatgggaagggtggtcaggctgttcttaaggatctgctccagacccaggaacttgagcatgcccagggtgaccgtcgggttaaaacgcaggccgcccttgtagggtccaatggcagagttgaactcgacacgataaccgcggttgacctgaaccttgccctggtcgtcgacccagggaacacggaacatgacgatgcgctcgggctcgacgaggcgctccagcagagcggcctcctcgtactcggggtgggcgtcgagcgccggctggatggtgccgaggatctcggtcgcggcctggatgaactcaggctgctcgggatagcgggccttgagctcttcgagaactttctgcgtgtagctcatgcttcctccaattgatggaaaagaaaagtgtcgttcgaggcgccccatgcgccgcgagctttatcgagtatggataatatcgcactgttgcggcaaagttacgcataagccgacgagcggatgtttcgttttgattacgatgcaggtagaagcgtttttgagtgcctgacgtgcaaaacccgtgtttcaaacctgtttcgtccacgtgttccaaaccaccacattggggacaggcacctttgtggtggtgttggtggttagaggacgagctggtggtagtcggcgggggttacgcggccctcggtggcggcgcggaaggcggcgagggcatcgcccgagaacggcatggcccagcacagtccgcagccggcggtgatggagccgggcagcggcatgatgcgcccaggaacaccggcggcaaggcacagctgttcgcattccatcacatcgaaggtgctgtcgaacgacacgatgattttgcgttcatggtcgagagcatcaccggacgggccttcgcggtgtgcatcgcgatacgccgcggcggccgcttcctcttccgcagtatgtccacagccaccgcaaccgcaggtacagggttcggacccgtcgcaagtgcaaggttctcccgtgtcgggacacaaatcgtgagacatggcaactccaatcgtctaggcgagtaactcggccgccgcaaactcctcgggcgtattgacgttctcgaagcagagcgtcgagcccgcggccttaacgatctgcggctcatccatataaccagcttgaacgcgattgatcaggcagcgaatgcgctggcggtcgcaggcgagcagctcttgggcggccggcgcacaagcgtcacggcgccagacggcgcaaagcggctcaatcccccgctcctcgcgcggcacgcacacgtcgagcgcctcggcctcaacacgatcggcaagcgcgccgataagttccggcgagacaaacggcatatcgcaggcgacgatcgccacgagcggcaatcgggccgcggccaacgagctcgcgatgccgcgcatggcaccggcgggaccgtcgacgtccatcaccacgcgggggcgcaggccatcaaacataagctcctcaagataggcaagctcactgggacgcgaagtcgtcacgaccaactcgccggcaacctgagccaggcggcacagcacgcgctcgatcaagggctcgccgcaaaacaacattcgtgccttgtcacagcccatgcgcgaggacatcccgcccgcttgaacgacgcaagaaagatcggcccgtcttacggtagtcatacggcaaaccacccccatcggcatgctcaaaacccggcacgcgaagccaaataccgtcgccgaaaaagcgggcggtacggcaaacctgtgcaaaaacaaaacagcgcctttgcggcacgcagcaagaccgcgagcacaaaagcgctggtagcgtatggcgggaacgtatgtgaatcgaacacatccaagacgttttgcacgcctcgcaacggttttgaggaccgcggagcccaccggagcccatccgttcccaagtgcggcggtattttaccaaaccgaaacggctccatcccaaaaagacgaacaagaagttgcggtggaatagttcctgtatttgctgccaaagcctccaaataggaactatttcaccgcaactgaggaggtgggagcgagtgaccggcctagcgcagggacctcaggccgccggcgtccttgtcgagcaccgtaaagcgcacggcatccaggtgctccaagatgctgatggcacgtttgcgcgacacacccagcgcctcgcgcagcacgctcgtggtggcagcaccgccggcttcggcgatgacggcggcgacgagctcgcgcgcgtgagcctcagcggcagcggacagggcaacgtcgcgctcgaccttaacgatcgagcggttgagcgaaagctcgcgcagggcacgcgtcatggcgtcgcggccgagctgcagctgttcgcccacctcgggaagcgccggtgcatcgaggccggcttcgtccagcaaggcaacgatacgttcgcaggcctcgcgcaccacacgcgccgcggcggcagcggagtgcgggtcgaatacctcggcaccctcggcggcgcacacgccacgcgagcagccctcggcaatcagagccgcggcaacgacttcatcggcggcaggccacgcagcatgggcgacggcgccgggcgtaaagcccgtctccttaggagacgctgtgtgcatggctgacagggtcgccgccagtgcgtccatcgcagcgtcgagcacagcggcattcgtatacagcgtaccgcccgagccggcaagctcgcgaacaacacctcgcgccaccaacccgtgcagtgcggcatcgacctcgccgacaccaagatccaaagcctcggcaacatcagccgtcgtaaccggcagcgtctgcagcgccagccaagcgcccacaccgcccgcgatatcgccggactcaagcgccgcatacagcgcacgctctccttcggcaagctcgcgcgagcgacggcagcgcgaaagcagcacgcgcccgccgccaataagcatcacgggcgaataggacagcaccacggcatggtccccggcgcgcagcggcagcgagttttccaagcgcacctgaacaatacgggtctcgcccaccgccatgggggcctcaccctccatgaacatgatgcgaccgacaacctcggctgtacccgccatcacgtgcacacgcgcacccgactcgagcacacgcggcttggctccctcgcgacccaaatacgtaaacgccatcataaatcgcatcgtctggccaaagcggcccgccacaccgagcatctcaccgcgatcgagcgcggcgacggcatcgcccaccaagttgagcgccacacgctgaccgggcaacgcccgcagcgtatcgccatgcacctgaatcccacgcacgcgacaggccgtacgcgacggcagcgcgacaagctcatcccccaccgcgacgggcgcatcgtgcagcgttcccgtcaccacggtaccggcgcccttgatcgtaaagcaacggtcgatgggcagacgcggtgcggcatcggtgagctcggcacgagcacggcaggcatcccagcaagcggcaacctgctcgtcgagcgcaaccagcaggttatcgattcccgcgccggtcttggacgacacgggcacaatcggcgcgccctcaaacacggtacccgacaaaaagtcatcgacatcgagctcggcaagctcggtcatctcggcgtcggccaggtcgcacatcgtcagcgcgaccaccatatgcgtaacgcccagcagctccagcacatgcacgtgctcgcgggtctgcggcatcacgccctcgacagccgaaaccacaagcaccgccacgtcgatgcccgtggcgccctgcaccatggcgcgcaagtaatgcgcgtggcccggcacgtcgaccaggccaacgatcttgccactcggcagtgccagctcgccaaagcccagctccacggtcataccgcgacggcgctcaacctccagacggtcgggattcttgccggtcaacgcctcgatcagtgccgacttaccatggtcaacgtggcccgccgtgccaacgataacgggacactctaccagcgcttgaacctcactcatcgagcaatcgccttctcaacgcacgcgacgagcgtcgatgccgccgtctcgatatcgcggtcgccaacgagcgtgcgcacgtcaaacaaaatgcgatcgtgcgaggttcgcgtgacgaccggcgtgtcgaagtcctggacaagcgagcgcttgagcgcgtcgactgtcaggcgcttgtcaacaagacgcacggccacgcacatcgtgggcagctcaacggtaggcagcgaaccgccaccgggcgtcgaggactcctcgacaatctccaactcaacggcgcacgggcaacccgccttatcgagcccggcggccatgcgatcgcggagcttgcgggcacgacgctccagatgagcctgcggaagcgtgagcatgttgagtaccggcacctcgcgatgggccacatccgccccgtccatgtaaatgcgcagtgtagcctcgagcgccgccagtgcaagcttacccggacgcagggcacgcataagcggatgcgacccgcaggcctggaccagatcgcgacgacccatgataatgcccgcctgcgcggcgccgagcagcttatcgcccgagcatgacacgatatcgagccccgccgcgaccgaagccggcgtggtttcttcgcctccgcgcaccaagatgtcgtcgggcaacagcgcgcccgacccctggtcctcgtagaacagcaggccatgcttgtgggccagggcggcaagctcccgagagcctacctcctcgtgaaagccctcgatgcgatagttggaaggatgaaccttgaggatcatggccgtatcgggtgtgatggcttgctcataatctgccaggtgcgtgcggttggtggcgccgacctcgacgagtttggcgcccgaagccgccatgacatcggggatgcggaagctgccgccgatctcgacaagctcgccgcggctgacgataacctctttgcccgcggcatgggtcgccagcaccagcagcaccgcggcggcgttgttgttgaccacgagcgcgtcctcggcaccggtgagtgagcggatgagctgcgcggcatgctccttgcgcgaccctcgcgagcaggtgtcgacgctgtactcgagcgtgctgtagccgcgcgcgacctcggccacggcctttgccgccgactccgcgagcggggcgcggcccaagttggtatggatgaccacacccgtggcgttgacggcagggcgcaggctcggcaacgcggagcggtgcgcacgccactcgatggccgaggcaaggtcgcgcttagagcgcggggcagcaccggcgcgaatggctgcgcgctcctcgtcgagctcggccgtcacggcggcatgcaccaccgcgtcgcaggtctcccccgccgccttcactaccggccactcggcaagcagctcgttgacggaaggaatggcgcgcaggcgggcgcgtacctcatcggacatgttctggctatcgctcatgtacggcctttcaaaagaaacgtggatcagtcgaatgcatcagctgagtcaattactcgctattatcctcgcgtgccgcgatcttttccacgcgaacggcgttttcctgggtgagcgcggcgcccgtcaacgggtcccaacgcaacggtgtatggtcgagcgggcccacgcccagggcttgagcgccaccggcatcggcgccaaacgaacgcccaccgggggcggccgaggtgaagatgcacgccggatgcagatagggcgtcgtctccacgcgcacgcgatcgcggcccatgtcgctcacaagctcgacgacctcgccatcggcgatacccatgcgagcggcggcatcggcattcatctgcacggcatccagatccgatccagcctcggcggcaccttgggccgcaagcctgcgcgaggtgtgcgactcaaagggacggttaccgctaatgaggcgaaacatccccggggcaggctccaccatgggagcgatccagttgggtacacgacccagaccggctcgttcccatacgtcgcttgccagcgcaattttgccgcgatccaagggaatcaccggctcgcccgtacgcgacggcaacgcaacacccgtgtcggcccagccgcgctccttgagctcgtccagattgatcccaaaaggcgccacctgggcagccgccagatcgtcagacgtaaactggaagtactcgcccatgccacacgcctgcgccagaccggcaaaaatctcccgaccgggacgcgtgtcgtcatgctgcacgggcagcacggcgttgcggtagaacacgcgcgcgtcgttgacgcccgccaccgttcccggcatgctgcatgccaagcagatgattagcggacgttccggtgccgaggcatgggagcagaaggtcgatcaggtgcgcatctataacggcgagaagtatgagcttgcccaagaagttgccgctggcggtatttgtgccgtgacgggtcttgcgcacgttcgcccaggggacgccctgggtgcggagcccgcgggcgatgcgcctgtcattgcgccggttctcacctatacggtgcttccgggcgaacacgatgtccacgcggtgttcaaagcactgacagagttagcggacgaagatcctatgctcggcgtaagctggaatactcatctggagcagattcacctgcagctgatgggcgccgtgcaactcgaggtcgtgcagcgggtgttggcagatcgttttggcctttcgattgcgtttgagcccggcggcattctctataaggagactatttcgcagccggtcgagggcgtgggccactttgagccgctgcgccactatgccgaggtacatctgcgtttggagccgttaccggcgggctcgggcgtgcaatttggcaccgtgacctcgactgacgagctcgacttgaactggcagcgtctggcgctcaccaacgccatggagcgcgatcacctgggcgtgctgactggctcgcccgtcaccgatgtgcgcattacgctcacgggcggccgtgcgcatgccaaacacaccgagggcggcgattttcgccaggccacgtaccgcgcgattcgccaggggttcatgcaggcgcgtgaggcgggcgcggcggtgctgttggagccgtggtaccactttgagctcgaggtgccgggggagtgtgtgggccgggcgctttcggatgctacgcgtatgggtgccgagtacgagccgccgacgatggcgggagaccgcgccaagctcatgggccgcgtgccggcatccgaagtgcaggattacgcgctggaggtggctgcctatacgagtggccgcgggcatctgtacctggagtttgccggccacgcgccctgtcatgatgctgagcgcgtaattgaggcggccgcctataagcccgaggccgatctgcccaatacgcccgactcggtcttctgctctcatggcgccggctacaccgtcaagtggcacgacgtccccgccacggcgcacgtaaaggtcgatcccgccacctttcgcccctggcgagcagcagacgccgagtttttcggccacatgtgacaaagggacagttcctttgtcacatgctattggtataactcggtacaagttggtataactattgccaaggtttgccaatccgaggaggccgacatgaatccaaatccctttaagcccacggctggcaagcggcctccgatactcatcggtcgcgagtcggtcatcgaagatttcgaggaagggctcgataacggcgccggagcgccgggcaggctcatactcattacgggaaaccgcggttgcggcaagacggttctcctgcgggagctgcaacgtctagccaatgagcgcggatgggcggttgtctccgattccgcttcgcttggcttatgcgaccgcttggccgatgcacttcgctcgaataaacccgttgtgacgtcaatggaactcagtccatcattcgggcgcatgtcggtcgaggcggcgcgtgcaaagggtgaaacgctgcgcgggctggtcaacgagcgccttaagaagctcgatccaggcaaaggcatgctgtttgcgattgacgaggcacaatcggcgtctatcgaggagctggcggcccttgccgttctctatcagcaggtgctcggagaccaggatgccacgggcttgtccgatagcgaccagcgcggtcttgcgctggtgtttgccggcttacccagtatggttgacgatctgctcgaagagccgagcgtgacgtttttgcggcgtgcccagcagcgtacgctgggggcgatttctttgcccaaggtgcgcgattcatatatccagacggtcaaaaacgctggtctttacgttgacgcggggacggcggatcttgcggcacacaagagcatggggcatccctatatggttcagctggtgggctattacatgtggcgctctgctgtccggcgtggctcgcaagtcatcgaaaggcacgatgtcgaggatggccatgcggatgccgtctccgagttctacgaagcggttgacgcgcctctatattacgggctgcgcagtccacagcgcctttttatcgaggccatggcggttgacgagggcaaaccgactcgcatggcggatatcattgagcgctgcgatcgcacccagagctgggcgagcaaatatcgcgcaagcctgattcgcgagcgtgtcatcgaggctgccggatacggcctcgtccgatttaccgtgcccatgctgggcgcgtacgttcgcgatcgagttttatggcatgagtagggtgataaaggtgacggaacagaagatgagcccgcaggctatcgaggtacgcggcgcgcgcgtccataacctcaaagacatcgatatcgatattccgctgggaaagctggtgggtattgccggcgtatcgggttcgggcaagagttcgctggcactgggggttctttatgccgagggttcgcgccgctacttggaagcgctcagcacctatactcgacgtcgcctgacgcaggccgaacacgcccaggtggatgaggtattgcacgtaccggcggcgctcgcattgcatcagcgccccagcgtgccgggcgtgcgctcgacctttggtaccatgaccgagctcaacaacagcctgcgcctgctctttagccgttgcgcccatcacgtgtgtccgcactgcggggcgcgcgtggagccgagccttaacgtggctgcgggcctgtcgctcacgtgccctgcatgcggtcgcgagttctacgcgccgagcgccgaggaccttgcctttaacagcggcggtgcctgtcccacctgcggcggcaccggtgtcatgcgcgaggtggacgaagcgagcctggtgcccgatgagtcaaagactatcaacgagggcgcggtgcttccctggggtacgctcatgtgggatctgatgaagcaagtggctggcgagatgggcgtgcgcaccgatgtgccgtttaaccagctcacgcctgaagaacgcgacatcgtgttccacggcccggcggttaagaagcacattctctacgttcccaaaaacggcgagggtgccacgccgctcgacttcacctattacaacgccgtctataccgtcgagaatgcgctcgccaaggttaaggacgacaagggcctcaaacgcgttgcgcgctttttgcgcgagggagcatgccgcgattgcggcggcacgcgtctctccgaggctgcgcgccagccccaggtgtgcggtatcaatctggcgcaggccgcggccatgacgcttggcgatgcggttgagtgggtgcgcggggtgcccgcatccttgccgcccgagatgcggcccatggcgacggatatctgcgattcgtttttgagcgtggcccgtcgtctggtcgacctgggtctcgattacctttcactcgaccgcgctggtgccacgctctccacgggtgagcgccagcgcgttcagctcgcccgcgtggtgcgcaaccgatcgacgggcgtgctctatgtgctggacgagccttcgatcggcttacatcccgccaatgtcgacggcttggtgggcgtgatgcgcgatctggtggatgacggcaacaccgtggttgttgtcgaccacgatacgcgcgtactggcggaagccgactatctggtcgagatgggccccgttgccggagcaggcggcggcagtgtaatcgccgctggtacggtagacgaggtcgagcaatcgcagggcagccgtatcgcgccgtttttgcgcgccgagctcaagcgcttgcgtccgcaggtgactgacgacgaaatgttcgaccagggacatatccgcatggcaaccgatgccatccataccgtcaagccgctcgaggttgatatcccgcgcggccgccttgtcgcggtaacgggcgtttcgggttcgggtaagacgacgctcgtgctcgagacgctcattcctgcacttaaggcgcaggcagctggcgagcgcttgccggggcacgtgcgttgggtcgatgccgagggcattggccgcgcaaatctgattgacgctacgcccatcggcgccaacgtacgctcgacggtagcgacctatgccgacattcatgacgagctgcgccgcgccttcgcccgtacgcccgaggctaaggcagccggctacaaggcgggcgcctttagctacaacaccggcgccttgcgctgccctacgtgtgacggcacgggctcgatatcgctcgacgtgcagtttttgcccgacgtcgagatcatctgcccggcatgccgtggttcgcgctacgccgaggccgcctcgcatatccatcgcgagggcaaggacgggagcttgcttacgttgccgcagctcatggacatgagtgtggacgaggccctcgacgccacggtgggactcaagaaagtccaggcgcgcttgcagaccttgcatgacctaggcttgggctatctcacgctcggtgagcccacgccggcgctctcgggcggcgaggcacaacgccttaagctcgcgagcgagatgggccgcgtgcaggacgatgccgtgttcgtattcgacgagcccacgatcggactacatccgctcgatgttcaggtgttgctgagtgtgttcgacggccttgtttccaagggcgccacggttatcgtgatcgaacacgatctcgaccttatccgtaacgccgattatgtgatcgacatgggcccgggcggtggcgacgccggcgggcaaatcgtctgcgccggcacgccggcggatatcgctgcctgtcccaagagcgttactggccgctacctatagacaatgaggcaaagggacagtccctttgcctcattgatgcctatttcacgcactgagcggagagatagtcgcggaagaatggcaattcaaatgcgacgagccctcgtcctcgctccccgatgatgccggcgtctatcatgcggcgtcggtagcgggagacctgctgcggcgaacgcctaaggcgctcgacaaggtcagcggtggtggactcttcctcgtcatcgagcatggcgatgaggaatcgcttgtcctctgcagtgagttcccgataggttgccgcgaggattcggttgtccatctcgtcgcgcgcgattttgattcccaggtcaaagtcgcgtgacgagatctccttcgaatcgcttgtgagatcccaggcacggtagcctacgagttgcaataggaagggaaaaccagagatcgagcgaacggctctatcgattccctcagcatctgccaagcgatcgttttcctggatcgtgcgaatcaaggcctcgcgtacgtcatagtcggcaatgcgacccagatgatattgttgggcgcggcgaaggaacgagaccgtcttgtggttcagcaacgtcgagacgttgttgggaagtcccgccatgagcagggcgacgcgtttcccatcggtcacaaagtgctgatacgtcgctgcgagctgaatcatctcgtcgagtgtcgggtccacctcgtcaaccgtgacgagcagaccggtgcccgcctcgttgagctggtcgatgatgtcgctcatgcgataacgccaggttgaggcatcgtggacacgattgacctcgatgctgccgagcggtgcaattccgaggccggtgacttcgaagtggttggacgggtcgatgagatgggctgcggcgcgtttcgccccgaactcgagttcctcaagcattcccgggagcgcggtcgtctttacggctatccagccgtgggattccgcccttgtcgcgagcgacgacatgagagcggttttaccggttccacgcgcgcctgagaagatcgaggtcaattctgggcgcctgcgctggctcaagaaggcacggtccaaatcccgaataatctgttgtctgccagcgagatgggcgggaacctcaccaaaactgggggtaaacgggttctcgagatattccacaaggctctcctttcacaccgccgtttaacttcattttactttagttaattctgattaaaagtgaggctctttatctagagcatcaattaggcgtgtgcgccatcggcgcggcgcttgaatgtgacaaagggacagttcctttgtcacattcccggaaagcctgtttggcgcagggcttcgtagaggacgatggcggcgctgttggagaggttgagtgcgctgatgcggtagtcgtccggattgacgaagttgccgcagatgtcctgccgaaggatggcttcgtggccgtcctcggtatgcccgagcgattcctcgtgggcttcccaggcctcggcgttatcgagcgagtcgcaatcgcgcagcatagggatgcgctcgcagcgctcgggcgccgcggcgagcagcggctcgggaatgcccgagctctcgctgccaaagaccaagtagtcgccgtcgcggtaggtgctctgcgcataggtgcggcgtgcctttttggtcagcagatgcaggcgttcgtcggcaggggagaggccattgcgcgcaaggaaatcctcccagctggcataggtggtcacgtccaagttttgccagtagcccaggccggcgcgacgtgccgttttgtcgtcgagcgagaagcccagcggctccaccagatgcaggcgggcgccggtaaccacgcaggtgcggccgatattgcccgtattggccggaatctcgggcgcatacagcacaatgttgaacatgaatctccttggctcagaacgaaaaaccaccacaaaggggacaggcaccttcgtggtggtttggcggttacgtagcggaaaaatgtccgcttggataaacctaggcgcggtgccagtcggtcaggcaggcatcgagggaggcgatgagcgcatccttgtccatgtgacggccgatgatgcacaggctcgtcatgcggtcgcccgtctcgtcgtcccaaatctgcatgatctcggggttctcgtcgatgatcttctgcttctcgccctcgggcgccgagtcgacaaacaggccgttctccatcaggcgcatctggtggccggcctgctcgaacatgtagcacatgtccggatcgccggtctgccacagcgggcccttgacgcgaatgacctcgtcgggccactcctgctcaacaaaatcggtgaacttttgcaggtcaaacggcttgcggcgcgagtacacaaaggtctcgatgtcgtactcgagcacctcggggtcgtcgtgctcctcgggatgttccatggcctcgatccaggcggcggagttgtaggcgcgcataaagtcgaagcggtcggtgtcgagcagctcctccatggggacctcgccgttttgggcctcgacgatcacggcgtctttctgcaggctgcgcacgatggccttaagctcggcgatctgctcagggctcacggtatcggtcttgttgaggatcagcgtggagcagaactcgatctgctggatgagcagactctcgatgtcgtcctcgtcgatatcctctgccagcaggtcgcgaccgccgttgaactcgtcgtacatgcgggcgcagtcgaccacggccacgatgttgtcgagcgcgagcttgggctcgcctcccaccttggcctcgtcgcagaagctcgagatggtgtaggcgatggggatgggctcgcaaatgcccgaggcctcgatgatgatgtaatcgaagttgcccgaatcggcgatgccctgcagctggttggccaggtcgtccgaaagcgtgcagcagatgcagccgttggtgagcgggatgaggtcatcggtctcggaaaggccgccgtcggcgataaggctggcgtcgacgttgatctcgccgatatcgttgacgatcacggcggcgcggatgccgccgtcgttagcgaggatgtggttgagcagcgtggtcttgccggcaccgaggtatccggtaagcatgatgatcttcacgggtttgttgggcatgtgccctcctttgttagacatggcttacagttgaatcttatgccaaacgcctgctcttatacccacgcgccggcaaataacacaagctactcccaggctccccatacatcggggcaataaccgacggtggcctttttgccgttgcgcacgatgggctcggctagaacctgctggttctcgagcagcttgtcgaagcgctgactgggggtgagatgctgaatgagcgcgagcgtctcctcgtccttggctttggggttgagcagcttgtcgataccgccgaccgcctgcatcacgctcgtgagctcgcccttgctcatctccttttccttaaggtcgataaactgcaccttaatgcggcgctctttaaaataacgctgtgccttcttggtatcgaaggacttcttggtgccgaagatttgcacgttcatagtatgttccgccgttctacctgatgaagttggtcgttgctcgatctgcctcgggtgcgttgataccggcggcctgtccggcctcgatgcaacgtagaagccaagccatgttcttaccgatgtttcgcatggtggcaaggccctcggcatccccatcggcgtcgccgggcacgcggccaaacacgttgttccagtaggtggaagcaactacgggcatctgcttaatggtgaagtacttgttgagcacatcgaaggtggtcgacgtgccgccgcgacgggcgacggcgaccgcggcgccgggtttgtgctcaaaggcatgcccgccggcatagaatgcgcggtcgagagccgagaggatgcgtccgctgggatgcgcatagtagacgggcgagccaaagacaaagccgtctgcctgctcggcggcagcgatgagctcgttcaccacgtcatcgtcaaaggtgcagcgaccgccaagcttgccgcactgaccgcagccgatgcagtcgcgaatgggcttggcgcccagctgaaacacctcggtatcaatgccttccgcattgagttgctcggcgatctcggcgagtgcgcgggcggtgttgccgtttgccttggggctgccattgaccaaaagaaccttcatcataaactccctctgcttttggtgacttctgctgagaattatctcacgttgcgtgcgatgacgtcggcatggtgcgggcgatgtttatcccgcaacgttcttaagggcgttcatgcctaaggccatctaggggcattgcggtacggcatggggaatgcattgggaaacgttcgataaatgcttataaacacgtttttgacggcatacgttgacagatatacttgttgagttcaaaagcatgggaacggagatggttgcatgacacagccggagacatcacacacggtggggcttgcgctcgagggaggcggctaccgcggtatgtatacggcgggcgtgctcgacgtttggatggggcacggtttgacctgcgaccatatggtgggtgtctcggcgggtgcggcgtttggctacaactttaaatcgcgccagatcggccgcgccattcgctataacaaggcctattgtgccgataagcgctatgcgggtgtagcaagctggctgcggaccggcgatatgttcaatgccgattttgcctatcacgaggtgcctatcgagcgcgatcccatcgacctggagacatatcgcgcctgtcccatgcggtttacgtgcgtgtgtaccgatatcgagacgggcaaggctgtctaccacgacctgccctatggcgatgagcgcgatatcgagtggatccgggcgtcgtcggctattcccgtggcgacgcgtcctgttgtcattgagggacacaaatatctggatggtggcgtggctgattctattcccagtgcatggctgtttgcgcagggctacgaccgcaacgtggtggtgctgacgcaaccggcgggctttgtaaagcagcccaacagcgttatgcccatgctgcggcgcgtgttccgtcactacccggagtttgtcgcggcgcttgagcatcggcatgaggtctacaatgccacgctcgatgacctggcgcgtcgcgaggctgccggcgaggtctttatggtgcggccgagcgaatcggtgaaggtgccgtcgctgtgccgcgaaccggatgagctcgagcgcatctatcagatcggtcgtcgagatgcggaggcgactttgccggcgttgaaagcgtatctggcggggtaagggtcgcatgcggaaagcgcatcccggaatggaggctcaaactgggatgcgctttccattgctgaagatatgaggctgcgaatcagctgctcggcctagacttacgcctgctgccaggtgtcgacgagctccttggccgcggcgtaggggtcatcggcgctgcagacggcgctcaccacgaaaaagccgtcgacgccggtggccttgagctgtggcaggtcggccgtcttgacgccgccgcccaccacgatgggcacggggcttgccgcgtggagggcggccaggtcctcaaagctcttggtgatgatagagccgtcggccgcgcgtccgcagtcgcgcttggtctcggtctcgtggagtgggccgatgcccaggtagtcgactaggctcatgtcggcggtcttgacgtactcgagcatctcctcgcaacgggcggaaaggcccacgatggcgttgggccccagcagcttgcgacagacctcgacgggaatgtcgctctggcccacgtgcacgccgtcgacagcaataccctgctcgcgcgcggcgagtacgcagtccaggcggtcgtcgatcagcagggcaacctgaccggttttgccggcctgtgcgattgcctgcgcggcgtcgcccgtcagcgcaatgatctcgcgggcgcttgccaccttggagcgcacctggatgcaggtaaagccggcgtcgagcgcctgggccaccacatcgcccacgggacgcccgagcgtgttttcggggccgagtaccagataggccgagatatcaaggttgtcgcggatgctcatcgtgcttcctcctgctttttgatctgcgcttccatgcgttcgagcttgccggtcatggtgtcggtaaatccgggtcgaatatcggctttgagcacgacttcggtgcggatgcccttgctcgccaacacaaaggttgcgtcgcgcacgacctgcatgacctcgtcccagtcgccctcgatctcggtgaacatggaggtggtgcggttgggcaggccgctctcgcgaatgacacgcacgacctcggcgacctcggcggatagctcatcgccggtgccgcacggggcgatggccacggcgacgagcgtgttcatgccggcattggttgcgggctcggacatggcctatgcctcctcgagctcgagtcggttatcggcgatgtcttgggcggttgcgcggtagagctcgtcgataaaggcgaccttaaagcttgccggggcgtcggcgacagcggcggcacgcgtgccggccacgttgtagacggcggtgccgcagacggctgccgtaaacgggtcggcggcgcaggcgtacacggccagcacgccgccctgcgagcagccgcagccggtgatcttggacatgagcgggctgccgccgtgagacttggccaccgtcgtgccgtcggtgatcaggtcgacttcgcccgagaccacaacggcgccaccggtgtggcgagcgagcgccacggcggcaccacgggcggcgtcgaccgtgtcggtggtatcgacaccgcgcacgcggctcagatcggccgcctcgccctcaagaccccacaggccggcgagcgcgataatctcggaggcgttgccgcgcacgatggcgggcttgtactgcttgagctcgttgaccagctgggtgcgcaggctaccgatacccaggcccaccggatcgagcacccagggcttaccggcgtcgtgtgccgccttggccgcgcggggaatcgtttgctcgtaaatggggaagagcgtgcccatgttgagatagatggcgccgccgccggcaacgagtgcctcgccctcgtcgggcagatagaccatggcggccgatccgcccacggcgagctgcgcgttggcgacaaagtcgatcgtcaccgtgttggtgatggaaccggccatcggattggtagcgcgaatctcctccacggccttgaccatatgttgcttaagctgttccgaatcaatcactgcacatgcctccttggcatagaaaaggggcgctgtgcatagacagcgcccctgtaaaggcggcatgctccctacgccagcattaactgacaggttcaaaggattgggcccattgccctctcagccttgtggtttgcaccgccggcactcccgcatcgaatctgttgttccctatactagcgcacctgccaaaaagggacaggtttattttggcaggtaacaactgggactttgcgttttcccagatgaaacctgccgaaataaacctgtccctttttggcaggtcggtacaatagatgggattaagaatgaccgaggggaccttatgatcaaacttgtgctgaccgatatggacgatacactgattccagccgggcatgacggcgccagcgactacgccattgagggtattcatgccatgcaggcggcgggtttgcactttgggccggtttcgggtcgtcagccgtccgcgatgggctggatgttccgcaatcgctccgagtgcttctcgaccggtgcgttttgcaacggccaggtgatgtttgtcgatggcgaagtagtcgcttcgcgcgcaatcgataacgatgtccttatgcgcttagccgattattttgaacaggagaccgacgatacgtatttgaaggtctaccgtctgggtgatgacttttggaataacgatgcctattgcgtgacaagcgatcccgagcgtgtgcgtcgcgccatgaagtcaggcggcaacgcgtggctcaagggcgaagaggctccctgtcgtcctgtcgttgacgatgccccggtatacaaggcgaatatctggagtgcccgttcgcgcgaggagctcgccgagctgcgcgagcgtgttgccgctgaggtgccggagctctcactcgtgtttcccaacaaccgcgtgcgcctgttcgacgttcttccgaccggctgggacaagggctgcgctgcgctggagctggcgcgcgctttgggcctgacgcccgacgaggtggccgtatttggcgattccgataacgatttgcccatgatcgatgccgttcctaactccgttgcagtcgccaatgccaacgaggccgtcacggctgccgcacgctggcatattggcgctgcggcagatgatgcggttgccggggctctgcatcagattgccgcctgcgccgcgacgggggagatgccgtcgtttatgagccaaatggacacggcgggttttgacgtcacgaacgtctagggagaaagccatgaagctccagcaactcagatatgtcgtcaaagttgccgaatgcggcagcatcaccgaggcctcgcgccggctctttgtgtcgcagccttcgattaccgcgtcgatccgcgatctcgaaaacgagatgggtgtgcatatctttgagcgcaccaacaagggtgtcattgtgtccgaggaaggcgagaccttcttggggtacgcgcgccaggtgctcgaccaggccgacctgctcgagggcaagtacaaaggtacgtccgagcaggtgccgcactttagtgtgagctgccagcattattcctttgccgttaatgcgtttgtcgatgtgatccgcgagttcgatgccgcgcgctacgactttaccctgcgcgaggagcagacccacgagattatcgaggatgtcgcgcatatgaaaagcgagctgggcatcctgtatctgtcggagcacaatcgcgaggtcatcgagcgcatgctggtggccaacgagctcgtgttcgaagggctcttctgcgccacgccgcatgtcttcgtctgcgccgaccatccgctggcgggccgctccagcgtgacgctcgaggatctggaagactacccgttcctgtcctacgagcagggcagctataactcgttttattattccgaggagctgacctcgacctttgagcgtcgcaagaatatccgcgtgcgtgaccgtgcgacgctgttcaatttggccatgggcctcaacggctacacggtatgctcgggcgtgatcagccacgagctcaacggccccggcattatctcgattccgctcgacgtggacgagtacatggagatcggcattattacgcgcaagaacacgacgctcacgcgctacggtcgggcctatatcgacgcgattcgtcagcatatctaggctgctgtgctccgcacggttcaagtctctttatgacagtccagactgatataggaagcatctatatcaaactgttataaacgtatattttacgatggccatatgagcgctcatactctgtcccagtaaagcaaccaatgcaaagggagatatctatgagcacttcgattcaaccgaacgcgccgtttcgcgccgatatcgtcggcagttttcttcgtccgcaggctgtaaaggatgcccgtgccgcctatgtcgcgggtaaacttgacgcttccggccttaaggccgtcgaggacgatgctattcgcgatttggtggcaaagcagaaggccgccggcctgcaggtcatcaccgatggcgagtttcgccgcagctactggcacctcgattttatgtgggggctgaacggcgtcgagcgtcgcacctcgcgtacgggatatatgttccacgacgaggagaccacggccgataccgccgtggtgactggctccatcagcggcgagaaccaccccttcgtcgagcactttaagtttgtcaaggcacttgagggcgaggaccacgttgcacgccagaccatcccggcgcctatccagacgttctctgaggtcacgctcgaccgctgcgatggccagcaggagagcctgcgcgctgtctataagaccgatgaggaacttgccgacgccatcgcagccgcttatcgtacggtgatcgccgacctgtacgctgcaggctgccgcaacatccagtttgatgactgcacctggggcatctattgcgataccgactttgtgtccaagaccggcatgagcccggttgatctgcaaaaggtgagtgagctgggcgtggcgctcaacaacgccgctatcgagggcaagcccgacgacctggtcattaacacgcatgtgtgccgcggtaactaccactctacctatgccttcgagggtggctatgaccccatcgcgccatacctgttcgcaaacgaggatgttgacgcattttacctggagttcgatacgccgcgcgccggcggttttgagccgttgaggtacgttgcccctggcaagaaggtcgtgttgggcctggtgaccaccaaggccgctgagcttgaggacgaggatgccatcgtcgagcgtattcacgaggctgcaaagtatgttccgctcgagaacctgtatctgtctccgcagtgcggctttgccagctgcgagattggcaacaagctgaccgaggacgagcaatgggcaaagatcgcgctggtcaagcgtattgccgagcgcgtttggaaatagcggtaacgttcgcaggtgacggcgcgtgcgagacatggcgcatcgcgtacaatggttcggatcgtatcgttcgggcaggtaatccgctatgctcgagcgcccttccattttgaaaggactctcatgtcccagtcctcgacgcccgccgccagcgatgccatctacgacgcatcgtcgctcggccgcccgcgcatgtttttgctcggtctgcagcacctgtttgccatgtttggcgccaccgtgctggtgcccgtgctcaccggtctctcggtttcggcaacgcttttgtttgccggtttgggcacgctgctgttccacttcctgtcgcgcggtaaggtgccggcatttttgggctcatcgtttgcctttattgccggttatgccgcaatcgcgcccaacggcgagaccgagcttttgccctacgcttgtctgggcgttgcttgcgccggcctgctttatccggtgcttgcggcgctcttccgcgcctttggcgccaagcgtgtcatgcgtttcttcccgccggtggtgactggccccatcgtcatttcgatcggtctgatcctggcgagctccgctattgctaactgccagaccaactggcttgtggctgtcattggcgttgccgttatcgtcatctgcaacatctggggccgtggcatggtcaagatcgtgccgattttgctgggcgttgtggtgagctatgccgttgcggctgcgctcggcgaggttgatttctcgggcgttgccgccgctccgtgggtcggtctgcccatcgtgtgggacaacaccgtgtttgcactctttgggccgcagttcgataacggtcttgccacgacggccatcatcaccatcatgccgctggccttcgcgaccatgatcgagcatatcggcgatatctctgctatcggttcgacttgcgagcgcaactacattgccgatcccggtctgcatcgcacgctgctcggcgacggccttgccacgattctggcttcgctctttggcgctccggccaacactacgtatggcgagaacaccggcgtgctcgccctgacgcgcgtgttcgacccgcgcgtaattcgaattgccgcgtgttgcgccatcgtgctttcgttctgccccaagttcgccgcggtcatcgccgccatgccggcatgcgttatcggcggtgtgtcgctcgtgctctacggcatgatcagcgctgtgggcgtccgcaacctcatcgagaaccaggtcgatttccagaacaaccgcaacgtgctggttgccgcgctggtgctcgtgctttcgctcggcatcgcgtacagcaccgccggcgccatcgtgttggagctgggcggcgtgaccatttcgctgtccggcattgccgtgggctcactggtgggcatcgtgctcaacgccatcctgccgggtaacgactttgagtttgatgtctccgagcttgaggaggctgctgagtagcagctgcgttcagctaaaacaagatatggtgcccatgcgtatatgcgtgtgggcaccatttttaatgcgtcagtatccagtggatgccgcgggccatgcgtaagtcggtttgggcaaagtgattgccggggttgagctccagcgttgttggaatgccgcgctcgacgagcaacgcttccatcgcgcgtgtgtcgtcgagtacatgccgcatcatgcggttgggcgtcttggtttcctttttgccgagtgacaggtagacggcttgcgggctgccggcaaaaggggccgtgctggcacggtcgacaaagtcgggaaaccatagcgaccccgatgcgctcgcggcgcggtcaaaggcgtcggtttgccagagggaccagagtgcgaagaggcccgcgagcgagtagccggcaatgccgcgccaggtgggcggctgaggaagcgacgactcgacctgggggattatctgattcagcagctcatcaagaaaatcggcagcttggccgccgaaaggctcggcatcgcgtacggtcccgtcgcatgcccaggggctcagctcgcgattccaatcgagcccgccaatggtgacgagggcgaaaggcggacagtcgagctctcggcaacacttataaacctcgctgccgtcgcccacgaccacaggaaggtagatgacaggcgcgctttccgtatgattcgaataaacggttatctgcttttgatgcgcttccatgacgggcttctctcagtgttgtgatatcggcagccccaattgtcgcacgccagcgtatgccggttgggctagaccaaagacaatctcgtgcatcccctgcggacgcatatggaaaacgccaccgccggaggggagctcggcggtggcgttgttaaacggtgctggggctcggggccttcgcgggagctgccatgtgcgcagaggcgtctaagaacgcttacggctcgccatggtgcctgcggcgatagcggctgttcccgcaaggacggttgccacgatggccgcacccgaggtgtcgccggttgccgcgagcacgccggtagtcttggctttcgtggttgaagccgcaacggccttggtcggctttgagccctcaggcttggggttctgcttggactccgcgggcttgctttctgcgggcttggtctcgtcgggcttggggtcttccggcttggctacctcgggaggtgcgatggtcgtacttttggcgactgctttgatatagagggagtcgaccgtggcgtcgcccgtgccgatggcttggcctgcctcgtagatgccgtcacggagcttgcgatagtcaatgaccttgccgccttcgggcgtctggatggcggcgttctcaatcttgatggtgccgattgtcttgccgtcagcgctcatggcacgggcaaagattgccgctgtatctccttcggccgttaccttgctgcggatgatcgagatgactgcgggtgtgacgccctcgctggtctgggcgatgatgccgatgttctcgccttggggttcgcgcctcgtctcgccatcttggttttcgctgtaggggatggggccgtcgccgttctcgacatagcgggctatggccttgacaacggagtcgctgatgtagatgtggccgcccttctcgttgggtcgatcgtttctggtggagaatgcagccgaaacctcgccttccgcaaacgcgtccacggtggagccgttcttgacgacgatgtcgtcctggtaggtgaagagggcgttggcgccaccgtatctgcctttacttgcacggaccgtcacgtttgcatgatcgagggtgatgcccttgtgggcatagacgccatattcaacaccgtttacgttgagggaggcgtttgtggctgcgaggctgcccttggcctcgacggcagcgtcttcctcggagcttgccttgacctggctgccgtccgagatgttgatattgtcgccgctccaaagggcctcaccatcggctgagcttgcctcgaccgtcccgccacccttgatggtgaggttcttgtcggctccaatacccttgtccttggtagccctggcggtgacggctccgctgtcgtcaatcgtgatattgccgtttgccctgatgccatccgatgcacccgtggcgttgacgttgcccgaacctttgatagcgagatcacctccggcattgatggcatcaaacccagtgctcgtggcgttgacggatccggctccgtcgatgttgatattacccgtggtgaggatagcgtcctcagtagatgtcacgctgagcgtgccgccctcgtcgccttggatattgagctcggcattctcgttagtgccatgagaaacgttgatgctttcgatccattcggcagtgacgatgttggttcccgagtaattcacgttgagcttgcctgcggcctggatctcgccgccgttatagttgttgagcttcaagtcgtcggcgccgtcccacgaccaggtaccggcctcgtcgctcgccgcggtgttgtacttgttgccgccgaccttgacccattccgctgcgagcgagacgctcggcatgagcagcgagctcaccgtgagcgcgcaggccagcgcgcccttgaagttgaacgtcagattgtccaaatgcggcccgcgcagcgtcgagcagttacggcgtttggtaaaacgccgtaactaacgtgctccgtactgctcgtagtaggcgtcgatggcggtcttgagctcgtcatcgatgacaaccttgccgtcgatctcgtggttgtagagggtctcgacgacctcggccatggagacgatgctcgcgacggggaaaccgtacttggcctcgatctccttctgcgcggtggtcacaccgcccttgccgacctccatgcggttgagggacacgatcaggcccttgatctcgacatcggcagcagccttgaccttgggataggtctcgtcgatggacttgccgctggtggtaacgtcctcgaccatgaccacgcggtcgccgtcctggggctcatagcccagcaggttgcccttgtcggcgccgtggtccttggcctccttgcggtcgcagcagtacttgacctccttgccgtacagctcgtggtaggcaatggcggtcacgacggccaggggaatgcccttgtaggccggcccaaacagcacgtcaaagtcgtcgccaaagttatcgtggatggcctgggcgtaatactcgcccagcttcttgagctgatagcccgtcacgtagacgccggcgttcataaagaacggggactgacggccgctcttgagcgtaaagctgccgaacttaagaacgtcggactcaaccatgaacttgatgaactcttgcttgtaagcctccatgcgggctcctctcgtaatcgcgtacgtgccttccagtttagcgcaggcagggcgtcgatgcgggtgcgctttgaggccacggcattctgtaaaggctttgtcaggggcaatggttttccgaacaatggggttgacacgataaaccccctcgtcaagaatacgggcggattaaaagggatacgagatacccaaagcgcgctgcgcccgtccttaaggaggtgtgccatggaaggcagtcatagtcgaaaaacctgcatgtcgccctcggcacgccgcgaggattccgtattcgcataagcgccactaaccaatcgtcaaaaccaccacaaaggtgcctgtcccctttgtggtggttcgcgagcttgacgtgagcgacatctaggtttttgaagcaaatacgacacgtacgctaactcccttcaacaaggaggaccctatgctgatgctcaaaaccgccacggtactcgaagccatctccaagcgccgccgcacggcgcgccctgccgctcacaccggcctgtccaagaacaccatattcgccgccacccatagcgccgaggacaccctcgtgctgctcgacacaaccgctaacgggctcggtgccgagcaggcaaccaagcgcctggacgcctccggccccaacaccatcgaggcgccgaccaagacactcgcccgccgcatcgccgacgcgttcatcgaccccttcgccggcatcctcgccgcgctcgcgctggtctcgctctacatcgacgtgctcgccgtgcccgagccccagcgcgacccctccacggtcatcgttatcggcatcatgctgctggtatcgggcggcatgaagtttatccaggaagcccgcagcggcaatgccgccgaggccctcaaggacctggtctccaacacctgctgtgccctgcgcgacggcgagcgcatcgagatccccttcgacgagctcgtccccggcgatgtggtccgcctctctgccggcgatatggttccggcagatgcccgtatcatcactgcgcgcgatctgtttgtgatcgagtccgcgctcaccggcgagagcgaggccgtcgagaagaccaccgccgtcactatcgtcgagggtgccgacggctccgcactgccgctctctgcctgcaagaacatcgtctttaccggcacctccgtgcaaaacggcaccgccatggcgcttgtcgttgccaccggctcggacacctacctgggcggcatcgccaagatgctcaacgggcgcggcgaaaagagcgcgtttgaccgcggcgtctcgagcgtctccatgttgctcgtacgcctcatgctcgttatggcgccggccgtctttgccatcaacgccgccaccaagggtaacgtcatcgacgcgctgctattcgccacgagcgtggccgtgggcatcacgccgcaaatgcttcccgtcatcgtgaccacgagcctatcgcagggcgccaaggacctcgcccgtcgccaggttatcgtcaaggagctgccggcgattcaaaaccttggcgcgatggacgtcctgtgctgcgacaagaccggcaccctcaccgaagaccgcatcgtgctcgagcgctatctcagcaccgacggcaacgaagacgcacgcgtgctgcgccatgcatttttgaatagcttcttccaaaccggcctcaaaaaccttatcgacctggccgtaatcgaccgtgccgatgtgacgccctcgaccgtcgtgcccgattctatgctgggccagagtctgcgcgaccgctataccaaggtcgacgaggttcccttcgatttctcgcgccgtctcctgagcgtagttgtcgccgacgcccaaggcaaaacccagatggttaccaagggcgctgccgaggaaatgctcgagatctgctcctttgtcgagatcgatggcatcgctcagccgctcaccgacgagaagctcgcccagattcgcaagcagatcgccggacttaacgccgagggcctacgcgtaattgccgtggcgcagaagaccaatccgcgctgcgtgggcgagtttggcatcgccgacgagtgcgacatggtgctgatgggctttttggccttcctcgatccgcctaaagcaagtgccgcgggcgccgtcgccaccctcgaggccaagggcgtggcgatcaaggtcctaaccggcgacaacgaccgcgtcgccgccaccgtctgcgagcagatcggtatcgatgcgagcaacgtcttgctcggctccgagatcgatgcgctcgatgacgccgaacttgccgagcgcgccgagaaaacccacctcttcgccaagctctcgccgctgcagaaggcgcgcctggtacgtgtcatgcgcgagatgctcggccacaccgtgggctttatgggcgacggcatcaacgacgccgccgccatgcgtgcgagcgattgcggcatctcggtcgattcggccgtcgatattgccaaggaatccgccgatatcatcttgcttcagaaggacctgggcgtgctcgagcgcggcatcatcgaaggccgccgcacttacggcaacctgctcaagtacctcaagaccacggtgagctccaactttggcaatgtgctgtccgtgaccgtcgcgagcctgttcttgccgtttttgcccatgagcgccctgcagctggtgctgctgtcgctggtctacgagatcgtgtgcatcgcactgccgtgggacaccgtcgatggcgcctggactgcccgcccgcgtgcctgggacgccgcgtccatcaagggctttatgctcgagctgggccccgtgagctcgctgtttgacatcgtgaccttcgccgcgctcttctttgtcgtgtgccccgccgccgtggacgcaagctggtccgagcttgccgccgcgggcgacgtcgcgggtatggcgacctttgctgcgctcttccagagcggctggtttgtcgagtccatgtggtcgcagacactcgtggtccacatgctgcgctccccgcatctgccgagcccgcgcgaccacgccgcgcccgcattgtgcgttcttaccgtgctgggcctagcgctcgtcacctggctgccggcaagccccatcgccgatgcactgggcctcatgccgctgccgacgagctttttcgcgctgctcgtcggcatcgtcaccgcctatatcgcgctcacccagctggcaaagcgccgctacattgcacgccacggcgagctgctgtagcacggtgagccgccacagtagacagcccaagggcaaaaccaccacaaaggtgcctgtcccctttgtggtggttttggtgcgctatgaggcgttagtcaggcggctccagagttcgtcaatatcgatttggtcgccgccgctcagataaccggtgtgaataaaagactcactatagatatagatgtcatgcgcgctgtcgccatcatcttcggtgttgtaggccgaaatcacgtaacggctgccgtcgagcgccttgaccagccaatacacggaatcgtcgattgcgcacttctcctgcactatcgccgcatcgccgattgcgccggtgagcgcacgatcgcccgtcgtatagccacccaccgagagcaaaatcgccacgctatcgtctccgccgcccggctcaagttcctcgtactcggactccggaagcggtatcgcgctgttcgcaagttcgtccacatcatccgaaatcttagaaaaggtaaaggcgaaaagccccgcgtcatcggcggcaccgtagcccacgctctcgccttgccactcatagttttgatgcttgagcaggcgcaccaggtcggcgccgtccaagttgatcgcagcatagaccgtcacgttggcgttgtcgtctacacaggcggcgtccgccgtggtcgccttcttggcaccgcccgcgccgcccaatccgcccgagcagccagccagcacacaagtcagcacgcccgcgcctgccacaaaggctgcacggctcatcgtcacttcattcatcatgttcgttcctcgctatggtattggccacgtcgcacctagccgagcgcgcgtccagtcttttcctgccaaaattcgtctatcgtcggagcaccgccgccctgggtaaacgtaccggtcttgatagcctcctcggtaatgagatccaagcggtagtcaccgttttccatcgggctcgccatggcgacgtgccgcgccatgttggaaccgtatacgcacgcgatccatgagcccgaagtaatctgcgcccggtcctcgaccggcacggaaaagcccgcgataacatcctcgcagctcgaatagcccgaaagttgcagcgtgaacatcacggtgcttccggtgccgcccttgtcgagctttccgatttcgtcctcgccgagccattcggtcgcgccgtccttgctgatattgcagacgctgagcacgtgtcccgcctcgtcctcgtacatctcgagcgcgtcttgccaggtatagccctgctgcgtgacaaactcctgcaactgccagcccttaagctcgaggagtgccgcgatgctgatgttgcggtgcgcatcccagcaatcatccgaccacgtatcgaacgcatccgccgagccgctgtccgcgcccgaatcgctgtccgcgtcgccggaatcgcccgacgtcgcacccgcgtccatcttgtcctttaccgggcggtcgtcgttaaaacccgtcgcatcctgcgtccgctgtccgccgcaccccacaagcgtcagcagcgccgttcccgccgccgcgacaaatgccgtgcgcgaaagtaccgtctccctcatcgttgttcctttcccgttctttatcacaatgccgagaaacacgcccggcatcgattcacacacaagccgtctcacgctattggcgaggcagctccgtccagccaaaaccaggctcaaagccatcgcgcgtgccgatgacatcgcccgaaccgttgacccaggcctggtcggccatcaccgagacctcgacatcggtgccgtcgggcctggtgtaatggttaaccccgcgaatggcatcggaatacgaggccgcacccgtgcctacgcccgcgctagagaaactggctgcgctggcagccatgttcgcggcgtgctgacgatcgctgcgatcgaaccatgcctgctggtagctgtcgaacgccgcctgctgcgaggcatgcatctgctgccaggctgcaaactgctgttgctgctgggcaatgttcatctgcgtgcgttggcgctgttcgagcaccatctgttgcttttgagcggacgcctcacgtgcaatagccgggttaagccgcaaggtcgacgccattgaggcaagcgccgtagaggccgcctcgtccaggcgaccttctggcgcaaccagacagaagctgtccctgatacgccactgcagcaggtcggccgcgcccagctcgaacgacgctccgtccgggcaaccgcctcgacccgtgggctgtccttgcgcgacgccctgtcccgccgctgccgccgcctggcgctcgcgcaggcgtttgcccaaaacgccgccgatcagtccgctcgaaaggcctgcgcccagcagcgcctcggccccagcggcaatgcctttacccttagagcctgcgacgccgccgatcgaggccacatagccctcgactttggccgccaccgcgagctcggtgggcactggagcgcccgtgagccgatatcgacgcatgcggcactcatagatcacattgctcggctccatcgaaaagccctgaatcgcaaagtcgtttaccgcctcgcgctttacgcgggcacgctcgcgctcgatatcgagcgccgcgttcgatgggtacggctgcccggccacaacctccgcccgtgcgcccagctgtgccgcgcaggcctgagccagctcgtcgcaagctgcctccacgtgcataaacgccttgcgctcggtttgcgtggggatacgcttggcaacggcgcccgcatccacgtagcagagctcggagcggtacataatccgctcacccatcggacccgctgccgtcacgccaaccgaaatcgggcagtcgaaactgccgctgcgctcaagatgcgcctcttcgatttgccaaccccgcggcagcgctacctgcgcgagcgcctgcccgccagaggcatcgcatgcggcatgaagctcaaggtcaacagcgcgaggagcgtccgccgaggttgtgtcgccagacggtgacgcggcctcggcactctgcgtcggcacagccacgctcggctcgcggccttcgctcgcgccatcatcggcagtagcgtcattcacagaccccgtggcatccgagccgcatgcaacgccctcaagtcggacgccgcaccccgggcaaaatcgcaccggcacgccggcgacccgaggcagctgcgccccacacgccgggcagaatctcaagtcactcatcccgtacatccctaatttcgttagctgtttttgatcgcggcaagctgccgccataactcatcggcaccgttaagtcggtacgccgtcttatcgagcacgatattcttgccttcgagctctaccgattgctccgaaccgtctgcatagacaaagacgagcgttcggccggcatcgctcatccgctcatccaccgcatcccccacggtgcagccatcgagcgcggcaaaagccgatgcgaccagttcggaatcgtcggtctcatagaccgtccgcgcctccccgtcctcgacaagcttgaccgccaccggaacggcagcgcaatcgttgagcgacacttgcgcggcagtctttccttgagcgccatggtcgccggcaacgtaaactcgcataagtgtcaccgccgcggcaaagaccaccacggcgataagcgcgcccgcagttttattagacgcgcaaccccgagacgccataggtgcaccccctccgttctgctccgctcagcatcacattcatatgcctttgagcaccaaaacggcaggtgacaaatgtctcatattcatatttttgcaggtaaaaaaccaccacaaaggtgcctgtcccctttgtggtggttagctagtcttggggtgtccaggaccagaagaagttgatgagggctacgcgcgaggaggcaccggtctttttgttgatcgaagcgatgtggcgatagagcgtggagcgcgaaaggaagagtgccgccgccacgtcctgcacgctgccgtccgaaacgaccagcgcctccagaacatcgcgctcgcgcttggtaagcccaaaggcggcaacgaagccatcgagccgatcgtcaaacgaaagctccggcgcctccaggggcaccgtgtcggcctggccgggctcacagctcacgccaagatcgtcggtggcaagcgccagcccgccgtgcgtcgcctcgccctcaccgtcttgtccaaactgtcccaacagcgaaatcgcgatgccgacaaacagcacgagcacgacgctcactgccgccagcacgttttgactcgagacaatcgccaccgccggagccgtcacgagtatcgagcaaacgttgttgataacacggcccatgcacggccatagatacgcccagcgggcatacatcgaaatcgcggcgaacttcgcggtgaagaacaccacgaaaaagcccgtgccaaggtaaaagataatcgtggcggcaagcgtgttgccaccgttgccatcggtgataagcacaaagaacgagagcgtggacagcatggcggcgcacgtcatgatgatattcatatacgaacgcccacgcaggtcatacaggacgccggcggcaagggcgctcacaaccagcagcaagcgcggccagtcgcccagatcgatagcgccagcggcatgcgaggtcgtaaggccggcattgagggccgcgaacacgccggtgaggcaagcggtcgccaccgtcagacgtaccacggcaccctgaaaggccgcctttgcctcggggtcatcgtgccacctggcgccacgctccgacgcatcgaccgatagctcggcaatctcgaactcggacgcaggctcatcacgcaatttagcgcggcgggcaccgtgaagcagccccaccagcgcaatcgcacaggcaatgagaacagacttctggggaatgcccgcaggcatcaccatatggttgagcacctgcaccaaaatgcccgcagcataggaaaccgccacggcgcgcgccaggcagggcgtctgcgcaaaacgccgcgcaagattggcatgggcggtcgatccgcaatagcccagcgcacagcacgccaccaggccgccggcaattagcacctcaaaccgcactgccataatcatcagcagcaacgccgataccaacagcacgcctgtaatatcgctcgtcgcatcgatcgtctggggacggcgatagtacagaaatgggcgcacgaaaaagccaatcacgctcgcgccaacgacgatactctcgtagataacgacctcactcgatggcacgaactcggctatgcgcacatcaaagagatactcgcacgtcaaaaacgtgaagaagaacagcgccaggcatataatctcccgaatgccccgacgcaaatatgcggttgtgtctcccatgcccctcatggttaacccccggccgctcaattgtctggaattctattttaataaagaaccaatctcgatatcagagtcagactcgaaatgctgctaattcggccccagtcgtccacatcacgccgcgattttgagccgcatggaccagaagggacgcgcgcgatctctagctcggccaggagtgtctccaactaccactcatttaagtacgtccccaatgagtggccgaagagtgtcccccgcgactagtcgtttaagtacgtccccaatgactagtcaaaaatgggccatgtgtcccagttgtggagactccttgagccgtctgggtatcgcgaaggatcgcgcactcccccatcatcaaaagtgacacacgctaccagttgatgggaggcagccatgggcttctttgacaagatgttcgagaagaaagagtgcgcgatttgcggtaccgagctgggacttctaggtaagacaaaaatcaatgaaggctacctgtgcaaagagtgcgccggcaagctctccccctactttcacggctatcgctccagcaccgcggacgatatccgtgagcaactcgcctaccgcgaggccaacgccgagcgcctgtcttcgttcaaccccacgcgcacgctttctgccgggcgcaccaatattatgctcgatgaggacgcgggcctgctgatcatcacttcgcagagccgctggcgcgacgccaatcccgacatcatcgagttctcgcaggtactcggctgcgatatggatatcgacgagcagcgcaccgagatctatcgcgagaccaaggacggcgagcgcgagagctacaacccgccgcgctatgacctggattacgactttaacctgaccattcacgtcaacacgccgtactttaccgagatcaacctgcgcgtgaacgactccaccatcgatcagcgcggctccatcgaataccgcgaggccaagcgccaggcaaccgaggtccgcgacgcgctggtgcagctgcgccaggagacgcgcgacagcgtcgtggccgccaaggcccccaagaccgcggtgacctgccccttctgcggagccaccaccattcccgatgccagtgggcgctgcgaatactgcggcggcgccatcggcgcatagcctccggcagcgaaaggaccgatcatggccttcgagagcgttaactatcagtgccctgcctgcggtggccccttgcattttgccagtgccgagcaaaagctcgtctgcgactactgcgattcgcgttttgaagtcgaagaagtcgaggccctctatcgcgagcgccaggacaaggcagatgccaaagccgatgccgcagccgcggcccccaagcctgctgtcgacgatgccgtgcaggagctggctcaaaacgccggctacatctgctcgtcgtgcggcgccgagctcgtgtccgacggcaccgtcgccgtcaccacctgcccgtactgcggcaactccgccgtggcacccggccagctctcgggcgacttctcacccgacctggtgatcccatttaagctcgggcgcgacgatgtcatggccgcgctcaaagaccactacaagggtaaaatcctgctgcccaagagctttgtcaccggcaaccacatcgacgaggtccaaggcgtttacgtgccgttttggctctacggcgcccgcgttgacggcgaagtgtactttgacgcgaccaacgagaccgtgaccgaggaatccgaccgcaccgtcacaaccaccgaccactacgacgcctaccgtaagggcaatatctcgtttgagcgcgtgcccgtcgacggatcgtccaagatgcccgacggccacatggacgccatcgagccgtttgactacgacgcgctgcgcccgttctcggtcgcctatatgcccggctacatcgccaaccgctatgacgaggattgcgaaacctgcaaggcgcgcgccgagcgccgcatggaggagagcacgatctcggccctgcgcgagaccgtcgtcgacgagtacgacgacgccacggtcgaaagcaagcagctcgactacacctgggaagaaaacgattatgctctgttccccgtgtggatgctctctacctcgtggaacggcaagagttacctgtttgctatgaacggccaaaccggccgcatggtcggcgagcttccctgctccaagcccaagctcgctatcgcctcggtgctgttctttgcgatcggatttgtcctttcccagattctctttatgggcgagaacgccttcgatccggattacctcacctttgatgtcgagggcatcctcatcaacatcgtcgcgccgctgatcatcgtgatcatcgcagacgtgctgctggtaggccagctcaagacggccaacgaggccacccacgccgactgctactgcggcgagctcgacctgaccgagaagcacgacaccttcagccacaccgagaccaccgttgtcatgaaggacaacaaggacgattagccattctgaccaataccacccggcctttgacgagaaaggaagatcaccatgggactcttgaaagctggattgggtgctgccggcggcgtcatggccgaccagtggaaggaatttatctattgcgaatcgatgcccgctgacgtcttggcctgcaagggcagcaagcgcaccggcggccgcagctccaacacgcgcggcgaggacaacgtcatctccaacggctccgtcatcgccgtcaacgacggccagggcatgctcgtggtgcaaaacggcaagatcatcgaggttgcgctggagcctggcgagtttgtctttgacaccggcagcgagccgagtgtcttcagcggcaacctgggcgactccatcaaggagaccttcgccaatatcggcagccgctttacctttggcggcgacgcgggcaaggaccagcgcgtctacttcatcaacacaaaagagatcatcggcaacaagtacggcaccgcctctcccgtgcccttccgcgtagtcgacaacaatatcggtctggatgtcgacatctccgttcgctgcaacggcgagtattcgtaccgtatcaccaacccgctgctgttctacaccaacgtgtgcggcaacgtgaccgacagctacacgcgcgataagatcgacagccagcttaaatccgagctgctcaccgccctgcagcccgcctttgccaagatctcggagatgggcatccgctacagcgccatccccggccacaccaccgagctcgcccgcgcgctcaacgaggtcctctctgccgattggcgtgacctgcgcggcgtcgagatcgtgagctttggcgtcaactccatcgccgcctcgcaagaggacgagcagatgatcaaagacctgcagaaggccgcggtcatgcgcgatcccaccatggcagccgctaatatcgccagcgcccagagcgatgcgatgcgcgccgcggcggccaaccccaacggcgcgatggcaggctttatgggcatgggcatggcaggtggcatgggcggcatgaacgctagccagctgttcgccgccggtcaggcacagcagcaggccgccccgcagccagctccggcacccgcccccgcaccggctcctgccgctgcccccgcggccggcgcatggacctgcagctgcggtgccatcaataccggcaagttctgctccgagtgcggtagtcccgcacccgccccggcaccggccaagtggttctgccccaactgcggcagcgaaaacggtggcaagttctgcagcaactgcggaacgcccaggccctaacccctctatctggtaattggcggggaggtccgccacccccgcatttgcttctatgggctttcacacaagaaggaggacaccatgaagacaacgttcaaaaagtccgtactcgcatttctgacatgcgccctggcgctcgcctttgccctgacgggctgcagcggcggcggcaaagaccccaaggccaacttcgtcggcagctggcagtactcgggtggaaccttggatggcgaagagctcaccgatgagtacatggatatgctcgaagagtggggcgtcaactgcatcctgatcctcgatgaggacggcacaggcaccctcgacctgttccttgaggttgtcgaccttaagtgggaggccaaggacgccaccaccgcaaccgtcaccgccgaagatgaatcgcacgatctgaagctcaaggacgacaagctcgtcctggaggtggacggcgacaagtttatcttcaccaagtccgacaaggacctgtccggtacggtgaagaaggatcgcgaggcggccgagaaggaagatgagatcgatgaggccgtcgaagacgacgatgtccagagcgtcgaaatctcccccgccgtcaccgtcgccgatgacgatctgtgcaccatcaccatcaccgagaagttcaaggacgactggggcgacatcggctttgtcgtcaacatcaccaacaagagcgacaaggacctgaccttctacgctccttccggcaagaccaacgtcaacggcaccatgaaggaaccctggttctcggctcacctgatgcccggcaccaacgccaccgaggaattcacgttctcgaacggcgagcttgacagccttgacgacctggtcaatacgaccatcggcatcgacgcctacctaaccgattcctacgaggacgtcgcctcttacagcgcaaccatcgcgtaacggcagacaccgatagccgcggattggcggacacatccgcgcacaccaggcggggccgcaggagttgatcctgcggccccgccgctttatgccgatgcgtaacgagcgctagcgctccatgttgggaacgatgctgccctccgttactgcgcgcacggccaagcgcatgatgttgtcgtagccggtcttattgagaatctccgagatgcggcgtttgatggtgccctcgctcataaacagctcggccgcgatctcgcggcggcttttaccctcgcaggcaaggcgcaagatcgacagctcgacatcgtcgagggccgccgtgcccgagaagatgctctcgggcggcttgggaaacgtgcagtaacccgccagcgtggagcgcatcacggcgaatagctcgtcgataccgacgttcttgtacacaaagctgtcgacgcccgcctcgcgcgcctggtccacaaaggtgatttcgggcatacccgtcatgataatgacgcggcactcgggcagttgttctttgatgcgcgccgccgccacgatgccgttggaatcatgctcggtgcatacgtccatcagtatcatgtccgggcgctccttaagcacaacgtccaaggcatccgaggcgtcggcgatcgcggcaacaaccgtcatgtcgggctggtcaccgacggagcgcgcgaggctctcgcgcagaatggcctggtcttcgactataaggacgcgaatcatgagcttctcctttggaccgtggcgctggaggcgagcgggatggacaccgtaagcgtaaagggcggggcggtgtggacttccaggctgccgcccagattctgtgcgacatgcctcatacctgggatacccgttccctcgcgatacgatacgggtgcaggcgcgccgtcgttagaaacggccattcgcgcaacagcgccgtcttccgtcccctcctgccacaggcgcacatggacctgatgggcctgtgcatgcttggtggcattggtcgaggcttcgcggataatctgcaaaaatgctgcggcgacacgcgcgtcgtttggcagctcgccctccacatcgatctgcacgctcaccaggccaaaggcatggacgatatcgcccaattgctctgccggttcggtgtcgcccccgctgcgcagatcggcagcgattgagcgcagcaacggatcaatctgctcgagtgactcgtcgtccaggcgcccctcctccagataacgatggaggatggacaggcgctgcccgatcacgtcgtgcacgcgagcgcgcatacgcagataggccgcattgtcagcaacttttttgacttcttcgatctgggcttggagctcttggcccgcaagctcaagcaggtggttggcttgcgctaggcgatcatgggcatgcgcatactctgttacatccagaccgataatgcgctcgaagaggcggcccgaaaccataacgtcatcgtgcacgaacaagcgaatctcggcgggagaaacctcgaccacaacgcgcgcctcaccaaagcggtccagattaatccgcacacggttcctgctgctttcgggcatttgcatgctgagtttgcgcaggtcgttccatgtaccgctcatatcgcctaggtcggtgggcatatgaagctccaccaggtttttgcgcatgcagcggttcatgagcagcggacggcccctcgggtccagatacaggatgcccacgggaatcacgttgatggtctcgatcgtcgagaacatggtgatatcctcctggcggttacggacgtccatcaagagcgccgcgatggaacggaacaggaagaacgctccctctgtgataaggacaacggtccacgccgagcccatggcaaaaaccaccggcggtgtaacggtgacaacaagcagcagctcgaccagcatgacggggcgacgatagcgcaccataagcaccacgccgtaggcaaagatcacggcattgagccacaacgctccgcccattgccctggcgcaaacgtcaagcggcgccaccagatatgagccagacgacgcgaacaagatgagcgccgaaataactaggtgaagcacaaggctcgcctcgtaggcacaaatcaccttacggttataggacgagcggcgcgatgcgatgagcgggacgtggatcgtctgcagagacgcagccagggcaaagacaacatcgagcgcaacgatttggggaagaatgagcgaaatctgcatcgtcactcacccgccctcggcatcaagacgatcatgcgcagctggccgggctcgccctcaaggcggtatgccacgttgcgcccttgcagagcgctttcgagctcttgcgcagcgggcgtctgcgaaagatcttcatcatcgttggaaaaaagcgtggcgcgcagctcgacactgcatcggtcatggtcgcccaagtgatacataagcgccggatggtcggtggtgtaggcaaaaaacgcaaagtcatacacgcagtcgtacagggcgcttaccgtactggcgtgcatcgggcgccgtatggcgataatcgaggcgcaatcgatatcgatggtgcgcaggtcgcttgcgagctcgttggcgatgagctgaatgcggtcgcgatcaaaaccgctctccccgtgttgtgccaacgtgagcgatcccttgcgcttgcaataggcgacgagcatcttggcgcgctgcagcatgcggtaacgctcgtgtgaagacgcttcgtcggtcaacggcggcagcgaactcagcaggtcgtacatcccttcgagcgcgcgggcaagcgcctggtccacgtcttggaccagcaaggtctcggcctcttgatctgccaaatgcgtcttaaggtcgtagtcggcggcgagcagctcgttttgacgctgcaactccatgcgacgatgtgccagctcacggttaagctcgttgagctccgacacgtcttgggcaagcagggccgatccgcccagcagtgggaaggcacggtacatcacatcgggatcggacgccacggcaaaggcatgggcgcggccgtgctcctgggtccgcaactcctcgcgcacgcctaccggcgttggctttgacaccggcgtggcatagacctcctgcaggtcgcgcgttagaactttgaggtcaagcggcaaggtgtcgaagatgccggcgatgtcgtgatacgacggaacgacaccgcaatcgagacagatttccatcgccaccacgcacaggacgcaatagacgagcgaaaagttgagcctccatgcccagggcacgcgcagagcatatgagatggcaaagaaagcgccgcccagcagcacgagcgccgccgtgcccgagaaacgttggatgcgaaaggacgaggaccgaccaaccaggataaaaaaggccacgaagtcaaaggccgtccacacgaggacggcgaaataaccccagccgtacgtgtaatcgttgctccaggtgtcgcttgtacggtcaaagcggaagacctgctggtgaaaatcgttggtgagcacaaatccgataagcaggatggccacaatccacagcgcagcgcagtagcggcgacccaggcggtgttgctccaggcccgcaaggcgcagaccacacaactggtagagcagtggaatgagcgtcatgggcacgtagtacaggtaccacagcacggtggcatagaacggcgtgaacgacttgtacttgagaatgacttcgatcatccacagggcgcagatggtggcgacggcaacaaggcggcggcgcagcacatagtccaaacagcgcagatagaccgatacgccccagatcgaaaatgcaattgcggcaacaagcaacggcagagagctcgaatggacgagcgcatccacgacctcttctgacacctcgctataggcgggcacggcgttagaaagtttggggtcgaaggcgaacagcgccggcaagactgccaaaagcatgaggaacatcgcggtgatgacaccggcgatagcaaagacgcggtggcggtacacctgatgtgttatgccaacaaggaatcgcggcatggcgaagagcctgccgcccctgggatccgccacgggtgcggatcgggcggccgcgttgccgatatgtcgctcgcgggtacccatagtgcttttagtgtaccgacagatgggtcgaaaaagcgggccgcatgtcccaaaatccgcagacggcaaggcgcccggcagcctcccccgtctggcacttcccgatatccgcccgccccaaaccaccgcaaaggagacaggcacctttgtggtggtttggggcgatgcgctagtccacggtgatgtcgagatttttgccgatgaggccaacgtagccgccttcggctgccttggggctgtcagcatggcagaggacccacttgtcggccttccagtagcagtagctgtcgccggccgcaggcatgtcggccgcggcctcggggcgcgggccgttggtgccggcgggcagcgccaccatcacctggaagccaccgtcgtcgaccatgcacggcgtgtagtggagcgtggtgttgaagacttcgacgaccgtacccgccggcacgcgaaacgccttgacgcacgcggtgtcgagcttgccgtcctcgatctcccagcgatgcgccacgagcaggataaagtcgcgagcgcccaagttgaattcgctcgcgcggtgatactccaggcagttgagtcgtgtattgtggccgttgcaccagccgagctggaagggacggccaccaaacatgagaaagccaagcttgtcggcatccttgacgtcctcgagctccggcgcacttgcaacgtacttgctgccctcgggaatgggcgtggcagagagcgcctcgagcacgggcgacgtaagctcggacggaacgttatcccaaacgttgccataggacttgaactcgggatcagagacagagtagatatgcatgttcgctcctgttcgtttgtgtgacagtatgaacattctagaacaatctcattctgttttgagcactcggtataaaaaagcgctccgcaaagagtgaactgcctcccatttcttggacacgagaaatgggaggctttttatgcgtgtcgcgacacgcataaaaagcctcccatttctcgtgtccaagaaatgggaggcagttcagtatggagcggttttgccctttatatatcgagcgcctcggccatcgcggccgtagtgattgccgtggttccacagcaactgcccaccattgcggcaccggcatgtctccattcgatgcatgcgcgcgcgaaagcttcggggttctcgtgccatacggggccatcctgagtctggaccggatcgcctacgttgggacgcaccgtgacgggagtagtcgccgatgcaaccatcctgggcaccgccgcgttcgcggccgcaagcgaacagcaattaacaccaaccgagtttgcgccgtgtttttcggcgtacaaaacggccgcctcgatgttgaggccatcgcccaacaggtcgcctttatcgtcaacgacaaaactcaccagaacaggcatgccgtcggcggcatctcgggcgccggcaagcatgggctgcaaattacggatagacgtcaccgtctcgatcagcagaccgtcaacgccggcattgagcaaggcgtgcgcctgttcgcgcgcaatgcctcggatttcacgatactcggcagagtcctcggcaaaccactcaataccgatcgggcccatcgagcccagcagcagttgcgggtgcgcctggcgagcatcgtcgacggccccgcgattgacctccgccacggacggcgcaatctggtcgtgcttgagggcatagcttgatgcctgaaaggtgttggtaatgagcacctgcgcgccggcagcgacatacaagcgatggatacgagaaacggtctgcggctctgccagattccaaaacgccggtggaatgtcggcggcatcgtactcactcaacagaacactgcccatggggccctgcgccaacaaggtctcgctcgacaagcggcgcgcaagttcctcggcaccaaagcggttgtaataactcgtatccatatatatcccgctattcctcgacgctgattccctgcttttcgagataggcgagccagcggttcatcgtgtcctcggaaagcgcatgctccatcatgcaggcctcggaatcggctcgctcaaattcgacaccgagctcctgaaccaaaaacgtgcggatgaggcgatgacggtaccagatagccgtaccaacctcgcggccgcgatcggtcaggactaccttgccgtagtgcgattgctcgacaagttcggatgccttgagcgccgaaaccgctttattgaccgatgccttggagacgccaaggcgctgcgcgatgtcgaccgatcgaacgccgttggtttccccctcttcgctttcaatgcgaaccatgcactccaagtagtcttcgttcgccaccgtcagatgtagttcgcgcgagctatttgtcgtatccatgatcttccgtcccttctgcattcaatggctgattctaccccatccaagcgtcgcggtatgccgtggcataccgtgctagagttcttgttgcacacgacgaccaagattggagcggtctttatggaaaacaccaccacgaaccccgatgtcctcgagcgctttttgcgctacgtccagatcaacacgcagtccgaggatgcaaactgcgaccaggtaccctcgagcgccgttcagtttgaccttgccaacgtgctggctgaagagctgcgcgagcttggtgcggaagatgcccacgtgaccgagcacgcctatgtctgcgcgcatatccccgcaagtgcgggcgctgaggataagcccgccctgggcctgatcgcccatctcgacaccaccgaagttgcaccgggcgccggcgtgaagccgcacatcgtacaccacgaaggcggcgacctggtctgcggcacggttgacggtaagcccgttgccatgagcaccgccaagcttcccgccctgaatgacctcgcgggtgaggacctggtctgcagcgatggcaccacgctgctgggcgcggacgacaaggcaggcgtcgccgagatcatgtcgcttgtcgcgcgtatcgctcaggacccttctctgccccatcctgcactcggcatttgcttctgccctgacgaggaaatcggccacggagccgagctgttggatatcgatacctttggctgcaagtacgcctacacggtcgacggcggccccatcggcgagctggagtgggagtgctttaacgccgccgaggcgaccgtccgctttgagggccagtccatccacccgggcgacgctaagggccgtatggtcaacgcaggcaatctgttctgcgacttcaacgcgttgctcccctacgtgcagcgcccggagtatacggaaggctacgagggcttttatcaccttgagggtgtatctgcgaccgtcgatcacgccacagcgcgctatatcatccgcgaccatgacgccgccaagttccagcagaaactcgaccttattgatgccgccgcctcgatgctcaaccagcgtctgggtgaggagcgcgtgacagtcgagattaagcagcagtatcgaaatatggccgagatcgttcgtgactatcccgagcttattgatgttgccaaggaagcctaccttgcctgcggcgttgagccccaagtgctgccgattcgcggcggcaccgacggcgcccagctgtcgttccgcggtctgccctgccccaacctttccaccggcggctattgctaccacggcgtcaacgagttcgtcccggttagttcgctcgtcaagatgaccgacgtgctccaggagctcgtcgcccgctttgcatagggaactcgaacaatccaggtaagcaaaaccgccccgtcctcaaaaccgagaacggggcggtttttggtgcaaggggagtagtcagcaccgcaggttgagccaacgtcagcgagcgacgtccaaggcgaacaagttggcatgaaaaaggcagggcattgaccttctggtcatgtcctgccttttgaatgacaaattgtcgccttgggcggcgcgcagcgtcgagccgttacggcgtttggtaaaacgccgtaacttagtagttggcttcgtagccgttgccgtcgccggtgggctcttcgtagtagtccgaatcgctcgaatcgcttgagtcatcggaatcgtcagagctgaccgatgaggttgcggtaccgtttgcgtagtcgtcagacgtgttgttgttcaggtcgccgatcgtagagctggaaccgtcggaaagacccatggtgttgggacccttgggatccttgccggcatcgacacgctccatcatttccttgagctcgtcctcgtagacaaagacgtagctcacaccgtcgatcatggtgctgtcgtcggcatacgagggcaggttggccgagtagatgccgtcgacatccataccgcgcatggcattgaccgtagccacgatatcctgaacgctcatatcggtcacgagcatatcggacagcgaattaaccaggccaaagatcttcgtggcatcgaagttattgagaatctggttggcaagggcgccaagcacctgacgctggtggcgcatgcgcgtgtagtcgccgtcggcatagatgtagcggcagcgggcataggtaagggcggtggcgccgtccatatgctgctgaccagcggtaatcttaatatccaggtgctcggggtcgtcaacatcatcggttgcgttaatgtcgataccgccaaccgaatcaatcagcgcctgcataccgtcgaagctgacctcggcatagtgggaaatctgaacaccgcacagctcgttgaccgcctcgaccatggcctcggcgccgccaacggtatggcaggcgttgatcttcatggtctcgcccttgtactcgaccttggtgtcgcgcggaacggaaatgagcgtcgcctgcttttgcgtggggtcgatgcgtgccaggataatcgagtcggcacgatacgtatcctcgcccggacggccgtcggtgccaagaagcagcacgtagaacggatcctttgcctcatcggtgtcaaccagaacccgacgcagattgtcggtaatgacattagaatcgccgagcttgcccataatggtggcaaaccacaggccggcagcggtagtggcactcagcagcacgccaagcacgacaatgagcgcgacgtgacgaatcgtgtggctacgacgacgttggcgagcgcgctcggaatagcgagccacgttatcgcgactgtagatcttggcctgcgcaccagttgagggtcttcgggtggcggtatccgcgaggggctttttattaaacataggcaacctgtattagtagatgacgggatcggggacggtagcatgctcgacatgcgcgccgagcgcctgcagcttttcgacaaactgctcgtagccgcgcttgatgtgatgaatggccgaaacctcggtcgtcccgtcggcgatcaagcccgctacgacgagggccgctccgccacgcagatcgggcgaggtaacctgtgcacccgagaagcccttgacgccatgaatcatggcgtgatggctctcgatacgaatgtcggcacccatgcgcaccagctcagaggcaaacataaagcgattctcgaagatgttttcggtaataacggaactgccatcggcaagggcggagagtaccataatctgcgcctgcatgtcggtcgggaaaccggggaacggaagcgtctggatatcgaccggcttgatacgctcggcacggttcacatggacgccgtcgtcggtacgctcgcagtcgatacccatgagctccatcttcttgagcaccatgcccaagtgaatggggcaaaagcccatgacatcgacaccgcgatcgtcggccatcaacgcaccggcaacgataaaggtaccggcctcgatgcggtcgcccactacgcgatgggtaacaggatgcagttcttccacgccctcgatggtcacgacgggcgtacccgcgccgacaatcttggcgcccatctcgttgagcatgttggcgagatcgacgatctcgggctcgcgggcggcattgtcgataaccgtggtgccctgcgcgcgcacggatgccatgatgaggttctcggtcgcaccgacgctggcgaactcgagcgtgacggtggtaccgcgcagaccttggggcgcattagcgttgatgtagccgtgggcggtatcgaactcaacgcccagggcctcaagaccaagaatgtgcatatcgatcttgcgagcacccaggttgcagccgcccggcatggcgatcttggcgcgatggaagcgacccagcaggggtcccatcacggcggtggaagcacgcatcttggcaacgagctcgtagggggcctcccaagaatcgacctgagaggtatcaatctcgagcgtgtgctcgtcaaggacatcgattgtggcgcccatacccttgagcaccttgcccatcacgtggacatcggaaatatcgggcacgttctgcagcgtcgtcttgcccggcgccagaagcgttgccgccatgagtttgagcgcggagttcttggcgcccgaaacgggcacagagcctccgatggcgtggccaccctcaacgcggataatatccaaggtctaccctttcaaaaagcatgcccgggatggctgggccatcccgggcatgatgtgttcgcaaatggtcgaacgctaaatcgtttgactattgggcaagcttgagcttacaccatgcgatttcattatagaggtaggcgcggcgtgcatcatcctccgacaaattacccagcttctcttcaaaaccttgaatatcagctttaagcttgtcggcatcgacggtcgccaaatcgcaagcgcgctcggcgagaacggtcacgacatcgtccgcaacctgggcatagccgccggccacggcaaacgtgtggtcgacagtgcccatggccttatcggaaacgcgaacgtaaccgcggtcgatcgtgcagatctcgctggagtgagcaggcagaacgccaaactcgccatccgtggacggaatcgacacaaacgcagcgtcgccctcataggcgcagctcacggggcacacgatgcggatacgcataacctacttctcccccatcttgcgggcgcgctcgcgcacgtcctcaatcgtggaagcatagcggaaagcctgctcgggcaggtcatcggccttgccgtcgacaatctcggcgaaggagcggacggtatcctcgacgcggacgtagacaccggggttgccggtgaacttctcggcgacgtggaaggactgcgagaggaactgctggatcttacgggcacggttgaccgtaaggcgctgctcctcggacagctcgtccatacccaggatggcgatgatgtcctgaaggtcggagtactcctgcaggagctcctggaccttgacggcgacacggtagtgctcctcgccgacgatcgagggatcgagagcgtcggaggaagacgcgagcgggtcgatagccgggaacaggccgagcgacgaaatactacgcgaaagaaccgtggtggcatcgaggtgcgtaaacgtcgtggcaggcgccgggtcggtcaggtcgtctgcggggacgtagacagcctggacggaggtaatggagcccgtcttggtcgaggtaatgcgctcctggaggtcgcccatctcggttgccagcgtgggctggtaaccaacggcggacggcatacggcccagcagtgcggaaacctcggaacctgcctgggagaagcggaagatgttgtcaatgaacagcaggacgtcctggccacgatcacggaaatactcagcggtggtaaggccggccagaccgatgcgcagacgcgctccgggcggctcgttcatctgaccatagaccaagcaggtcttgtcgataacgccagactcgctcatctcgaggaacaggtcggtgccctcgcgggtacgctcgccgacgccggtgaacaccgaggtgccgccgtgctcctgggcgaggttgttgatgagctcctgaatcagaacggtcttgccgacgccggcgccgccgaacaggcctgtcttgccgccacggatgtagggctcgagcaggtcgacggccttgatgccggtctcgaagatctcggtcttggtggtgagctcgtcgaaacggggcgctgcatggtggatggggtagaactcctccacctcgggcatgggcttgccgtcgacgggcttgcccatgacattccaaatgcggccgagcgtcttggggccgaccggcatcttcatgggctcaccggtatcggtggcgatgaggccgcgctgcaggccgtcggtcgaggacatggcgaccgtgcggacgacgccgcccggaagctggctctcgacctcgaggatcgtgctcagatgaccgatcggggtctcggcctcgaccgtgagcgcgttgtagatcgggggcaccgcgccgtcaaacttgacgtcgacgacagggccgatgatacgaacgatgcgaccatcaccggcagtcgtcttcttggtggcttcctcgaccgcaagctttacggtgttattagccattactgttcctccaatgctgaggctccgccgacgatctcgttaatctcggtcgtgatcgaagcctgacgcacgcgactatacgtgcgggtaagggtcgagatgatcgcggtggcgttttccgtcgcggagtgcatggccttgcggcgtgcaccctgctcggcagccgccgaatcgatcagggcctggtagatgaccgtcaggatatacgacggtacaagcttgccgagaacatgctcgggagagggcacgaactcgaacgtggacgagatgcgcttaggggcgtcggtctcgttcttacgcggaccgtgggccatagcgatcatctcgggatcgagcggcagcaagtgctcgacgcgaagctcctgatccacgcggttcttggcgtggtggtagacaagctcgacacggtcaagctcaccggcacgatacgcatcgcagatatgagaggaaatcatgcgagcctgattgaaatcgggctcggaggaattgccctcaaagtgcatgatgacgttcgcgcggtcgcggaaatacgtggccggcttgcgtccgcacgcaatgatctcgcactcgatgctattgttcgcccaagaagcggcgagcttttcggccgtgcgctccaccgtcgtattgaaaccgccggcaaggccgcggtccgaagcaatgacgacaatcaggccgcgctttaccgtctcatgcctctgcagcatggggtcggtacccgagcaggaggcgtcgccggcaaccgtcaacatgacgtcggtcagcgcctccttatagggctcggcctgcttggagcgatcgagggcacgacgaatcttggccgtagagaccatttccatcgtgcgcgtgatctgcttggtcgtggtaaccgaggagattcgcttcttaatgtcgcgaaggttggccatagggcttagttctcctctgatccagtcgtatcggcatggtgctttgccatgaactgctgcttaaagtcgccgatgacgcgcaggagctcagccttggtgtcatcgtcgatcttcttggcgcgaaccttgtcgagcaacgagccaaaaccgttgtccatgtactcgatgagctcggcacggaagggaagcacgtcggcgatctcgagatcgtcgaggaagccctcgttgccggcaaacagcgtaacgatctgctcggaaacctcaaacggcttgtagcgcggctgcttaaggagctcggtcatgcgagcgccgtgggtaagctgcttctgcgtagcctcgtcaaggtcggagccgaactgcgtaaagccggcgagctcctgatatgaagcgaggtccaggcgaaggttgccggcaacctgcttcatggccttggtctgagcgtcaccaccgacgcgggacacggagatacccacgtcgactgccgggcgctggccctggaagaagagctcggactgcaggtaaatctgaccatcggtaatggaaatgacgtttgtcggaatgtaggccgaaacgtcgccatcctgggtctcgataatcggcagggccgtcatggagccgtaaccgttcttcttggacatcttgacggcacgctcgagcagacgagagtgcaggtagaagatgtcgccaggataggcctcgcgtccgggcggacgatgcagcgtcagcgacatctgacggtaagccacggcctgcttggacaggtcatcgtagatgacaagcacgtgaccgccggggttggtctcgctggcgggcttaccgtcctcgccgttgtacatgaagaactcgccgatagcggcaccggccataggcgcgatgtactgcataggggcagaatcagcagcggttgccgaaacgatgatggtgtagtcgagcgcaccgtgctgagcgagggtctcgcggatgttagcaaccgtggaggccttctggccgatggcgacatagatgcagaccatgcccttgccgcgctgattgaggatagcgtcgatggcaatggcggtcttaccggtcttacggtcgccgatgataagctcgcgctggccgcggccgataggcaccatggagtcgatagccaataggccggtctggaccggctcgcacaccggggtacggtcgatgacgccgggggccttgaactcgatgggacgacggtgcgtggcgacaatgtcacccaaaccgtcgatgggctggccgagcggattgacgacgcggccgagcattgcacggctcacgggaatatccataatgcggccagtggtgcggcactcgtcgccttccttgatggagtcgacggcaccaaacagaacggcgccgacctcgtcacggtcaaggttctgggcgaggccgaatacggtctcaccggtatcggagctcttgaactccagaagctcgcctgccatggcactcttgaggccggagacgcgcgcgatgccgtcgcctacctcgtcgaccgttgaaacctcatgcgtatcgaccgtcgcggagaggctcgtgagctgctcctgcagtttcttggcgatatcctgggcattgagggtttcggacattaggcttcacctccgtacgaattagcagagtttgcgagggtctcctgcgcgatgcgcagctgcgtcttgacggagatgtcacgacgctcgccgcgggcctcgagcaccaggccgcccacgatagacgggtcgacctgctcgataaggaataccttgcggccgaagtcctgctcgcatttcttagtgatggtttgacgcagctcgtcgtcgagcgggatcgccgtggtgacggtcacgcccactacatcctcgtcttcctcggcaacatacttaaaggcagctgccaccttgggaagaaggtcgagctggtcgcgcttggacatggtgtcgagcacggcgatgatctcggggctggcagaagccaagcgctcgaccatctcgaggtcctcgaacacatggttctcggccttggcggcttccaaaagggaacgcgcgtaggtctcgagcaccttgtcctgatagcggctagtcggcattcaggctacctgcttcctggatgtagcgctcgatgagcttcttctgctcggcatcgtcctcgagtgcctcgcccacgatcttggtggcgacggcaacggacaggtcggcgatggagctcgcggcaccggcgtagatggacttgcgctcgtcctcgacggtcgtatgggccttggcgatgatctcctcggcctccttgtgagcagcctcgatgatacgggcgcgctcggactcggcgtccttacgggcctcgagaacgatgtcggcagcctgacgacgggcgtcggtgacgatcgagtcggactcagcgcgcttggcgatagcctcctgcttggtcttctcggcctcgtcgaggctctcctcgatcttcttgccgcgctcctccatggttttcatgatgcccggcagggcgaccttggccagcacgatccagatgatcaggaaggcgataagtgccgggatgaactccgccatcttagggatgaggatgtccgcaccggcagcgccgtcctcggcgaacgcggaaaccggcatgagcagcgcggccgcggacgcggagagtgcgatcgcgctcttctgggatgaaagattcatacttgacgctccgtgctatttaacgatcagcgcgacaacgaagccgatcagagccagagcctcgccgaaggcggagcccatgatgaagacggtgaacacgcggccctggacctcaggctgacgggccatagcacccgtagcacccagagcagacaggccgatagcaagaccagcgccgataacaccgagaccgtaaccgataactcccacgattcctcctttgtcgtgcgtgtcttatttcacgcaggataaccttatttataactgccgggctccatgggtacgggcaccagcggtttaacgaattgccttacctttaaggcgcgaacggaagactactcctcctccgcaacctcctctgcctcggagacatacacggcggtaaggaccgtgaagacataagcctggatggcgccgactacaagctcgatcgcatagatcaggatgaggatggcaagccaggccagcgaaggcagggcgccgacggcgtgagccgcggaaacctgctgaagcagcggctgcatgaacatgctcgccatgatggcgaacgagcccatgaccacgtgtcctgcgaacatgttgcagaacagacggacggcaagcgtgatgaggcgcaggaaggtcgagaaaagctcgacgacccacacaagcacgttcatcgggaagctcacgccctgcggggcgaggctcttgatgtagccgatcacgccgtgagccttgcatccgtagtagatgaagtacacgaaggcgaagatggcgagcgcggcggtggagccgattgcgccggtgccgggcttcattcccggaatcaggccaatcatgttattgatcaggatgaacaggaaaagcgagcacaggaacgggaagtgcttcttccagttctcacccacgacgcccttgccgatatcgttctcgacgtactcgatgatgtactcgaaaccgttgacgaagaagcccttgggaaccagggtctgcttcttcttgaacacggccaggacgatcaggagcacgatcgtggagacgatcagccaaaacgagtactgcgtgatgccgcagctcagatcgcccacgacaggggtggagctgaactcgctgaccagatgattaatctcatcaggcagcttttcaaaaatttccacgacttacctttcgacctcatgaggatctcgcagcaccttggcgacgcgaaccgcgcaggcggccataaaggccacgaagccgatcgcctcgcccaggaggaacatgcgaaacgcctctccgaacaacgcaaacacaaccaaggtaaagacgagcagggcgattgccgagaccgccaggctcaccatacccttgagcatgtccgcattctgtttatcgtcaagaaccggcttgagcgtaaaaacaaagggaagaaaggcgaccgcgcccgcgatggcgcctgcaacgatagcgagcagatcggctatctgaaacactggcgtcctcactttctttttttaacgcttcccagaacagttcccgccaaacattggtgactattgtacgagccaatcgctaaagtacaaccgaaaaagcatcggttaatacgcacctgttcgttttcttaagaccttctttatgccgcaggtaggtaatacgtttttctcgaacccctctgggctaaacgtccgttaacaggagtgcgcgcggtcgccttttgttcgaccgcgcgcaccgtttcttcgtatttgcagccgcggccgtcttagcccagcgactagagcgtgccgaagatgcggtcgccggcgtcgccgaggccgggaacgatgtaggcggcctcgttgagatggtcgtcgatagcgcaggtatagatatgcacgtcgggatccttctcggtcagtgacttgaggccctcgggggccgcgacgatgcacagcatgcgaatgtccttgacgccgcgctcgcgcagatagctgatggccatctcggccgagccgcccgtggcgagcatagggtcgacgaccagacagatacgctggtcgatatccttgggcatcttgcagtaatactcgtgaggttcatgggtaacctcgtcgcgctccatgccgatgtggcccacgcgagcggagggcaccaggtcgaggataccgtcgaccatgccaaggcccgcacgcaggatgggcacgatggcgagtttcttgccggcaagctgtttgaacgtggcagtagtgatgggggtctcgacctcgacgtcttccataggcaggtcgcgcatggcctcgtagccgtcaaaaagcgcgagttcgcgcacgagctgacggaactggttggtgccggtgtttttgtcgcgcaggatcgacagcttgtgctggacgagcggatgatcgacaagcgtcacacgggacgcatcgtaggtgacggtcatgggttgattgcccctttcgttgcagccgcaaaacggccttgctgacaaggcgcgcagcaatgttgccgccgcacgccatgcataagtttagcggtttgttgtatcgagcagcccatcgcagccctactgtgcggtactgagcgagcgcttgactgcatcacgccagcccgcaaggttttgctcgcgacgctcggcggacatatggggaaggaaggtcctaacgatctgggcattttgctccagctcttcaaggtcttcccaatagccgacggcaagacccgccaagtacgcggcaccgattgccgtggtctccaccgtctcgcattgcagcacggggatatccagcaggtcggcctggaattgcatgatgaactcgttgcgcgaggcaccgccatcgacagacaggcgctcaatcgaaagccccacgtcctgctccatggcgcgcagcacgtcgtagctctgatatgccatggattcgcaggcggcacgtacgatggtcgcacggctcgaggcgccggtcagaccgcacacgataccgcgggcatgcgggtcccaccagggagcacccaaacctgcaaaggcgggaacgaagtagcagccctcgttgtcgctaatcgaagcggcgagttgtgccgactcgctcacactcgagatgatgcccatgttgttgcgaagccagttcatcgttgaaccggcggcaaaaatagagccctcgagcgcatagctgactttgccgtccgcagcgataccgatggtggagaccaggccattcttggattcgacgatctcgtcaccggtgttcatgagcataaagcagcccgtgccataggtgtttttggtctggccgggatagaagcagcagtggccgaacagcgatgcctgctggtcgcccgccacgcccatgatgggcggcatgttggtcatgatgtcgctcgcgacgcggccgtagtcgcccgagctccagcgaacctcgggcatcatggaacgtggaacgtcaaagagcgccagcaggtcgtcgtcccaatcgagcgtatggatattaaagagtgccgtgcggctggcattggtgtagtcggtggcaaagacctggccgccggtgaggttgtagatgagccaggtgtcgatggtgccaaacatgaggtcgcccgccgccgcgctctcgcgtgcgccgtcgacgttgtcgagaatccactgcaccttggaggccgagaaatacgggtcaagcgtaagtcccgtgcgggagcgcaccagctcctcgcaaccctgttcaaccaacgcgtcgatcgccggcgcggtacgacggcactgccatacgatggcgttatagatgggctggccgctcacgcggtcccagaccaccgtggtctcgcgctggttggagatgccgatggcggcgatgcgatcggaatggatgccgctcttaaactgaacctccatcatcacgccgatctggctggcaagcacctccgtgggatcctgctccacccagccggggcgcgggaagctggttttgacgctacgacgcgcctgggcaacgatgcagccgtattcgtcgacaatggccgcgagtaccgaggtagtgccgcagtcgagcgccatgatgtaggaaccgccaaagttaaacgaggcatcttccatgcccaggctgcccagattcaacgacatcgcttacacctttctattgcatcgggtcggacaggacccgttcgatctctgatgcgggaagtgcgccttggcgcaggatctggagcccgccgcgctggaacgacacgatggtcgaggcgtcgcgacacggggtctcgccggcgtcgacggcaacatcgaccccctccaggatgcgaccttcgacggcggcaaagcttgccggcgagggcgcgccgtgtgtgttggcgctcgtgcaggcaaggggactgccgcaggcgcggatgagcgcttggaccacgggagaggccgaagcgcgcagggccacggtgtcgtcggcagcacgcataaaggtcggcacgcagggagccgccttgaccacgatagtcagggctcccggccagcatcgtcgcgcaagtacgcgggcatcttccgggatatccacgccatagcggtcgagcgcctcgacgccatcgaccagccaggcgaccgtttgggtgagttcacgttgcttgagagtgaagatgcgtcgatagccggtgccgagcgcagggactgcggcaccgttgacggcagcctgcggatcgcgcggccacgatgggaattcgcttgtatcttggggcacggcgtccgagaaggcgttgactgccacggcgacaccgtagacggtctcggtcggaatcaaggccaggccgccgcggccgagcacctcggctgtgcgctcgacggcaagccgatgcggctcgcgcgttccctcgtatacccgatagaccgtctgcatgtgtatgccagccccttacgctctggtgaaagtttgtttactgaggggcattctcgcacgaaacgttcaacctatttggccagagtgcatgttggtttggtgagcggctctagtagtcggtgaaagtgagggggttaattgaagatttttagcgcgcaagcgtaacggtacgatcgggaaactcgatgcttgcaaccagttttccgccgaggctctctgcgtacctgctcagcgtgtcgagcctcatcgaacccaactccccacgctcgagctcggatacacgtttttgagaaacgcccatcgactgggcgaccgacgcctgtgttagatcttttaacctgcgaatctgagcaagcttataggcttcgatacgatcgcgagtcctctcctgctcggcggtaatggagtcgcgtgttatcccgcgagattccatatactcatgcagttccatctcgatcgagcctccttacgtggcgacggtatatttgctcggcccttggaatgttgatcgcataccaaccgttccattttgcccttgacgatcccgctcgcgacttatcacccgccaatagcaataccgcctggcgcttggggtcaaaggcgaagaggatgcgaatcacctgcccaccacacgacgtcactctcagctcctttaaatgatgaagcttcgagccctttacgcggtcaaccagcggacgaccaaggctgggaccttccttctcgagcaccaaaaggtctgcataaatctgcttcagcgtagcttcatcctgctcatcaagccaaggttcaatgtaatcaagcacgatacggtaccgatgcagctgatttgacatacctttctccttctatagtagaagttttacggtatattgcaaggacaaacttgcgcaaatgtctattaattcagcttaaatacgctgtttgggctcggtgacgatggctcggacgatgcgggggcgatcggtgaggtcatggacgatacgcacgtccgaaaggcctgcctggcgacagagctcggccgcggcatcgagggcaccctcgtagagctcgcaggcaaacaggccgccggcgcgcagcatgtaaggcgccgcattgagcaggcggcggaaaatatcgaggccgtcggcgccgccctcgagcgccaggtcgggctcaaagtccttgacctcgtgcggcagcgagcgcatgacgtcggtcgggatgtaaggcgggttggagacgagcacatcaaaggtgccccactcttcgcggggaatggaactcaccaggttggtgaggctaaaggcaacctcatctgccgtgaggccgagggcgtcgcggtttttggtggccagatcgatggcgcgcggctcgatatcggtggcggtgcaggtaacgtggccgcggcgctcccaggcaagggagagcgaaatgcagcccgtgccgcagccgacctcgagaacgcgggcagtgcagggctcggttggggcaggcgcagcggcatcctgagctgaagccgtctcctggccggcaccctcgatggcgatgccgtattcgtcgagctcgggctcggcggcttccgcggcgtcggcttctgctgcctgcgcggcagcttcctcggcctcgcggtcggccagctcctcggcataggcacggctgcccagcacgtcgctgcctagcgccgcctcatcggcggccgtcaggttagcggcacggcgctcgacagtcgcgcgctcgtcggccagcgccgcctcggatttgcgggcctcttcgacctcatcgttccaaggcagctcaacacgctgacgggcagcagcctcggggctcagcacctcggcatccagataattgaggacttcctcgacgagcatctcggtctcggggcgcggaatgagcacaccgggggcgcacgcgacgtcgatcatgcgaaactgcgtgctgccggtgatgtattgcagcggctcgcccttagcacggcggacaacggccgcatgcatggtctcgagctgggccgcgttaagcgtctcgtccatacgcatatataggtcaatgcgcgccaggcccgtggcggcgcacagcagccactcggcagaaagacgggggtgctcctcgccgcgctcggccaggtactccttggtccactcgagacaacgcttgatggtccaaatctcgtttgccatggggccctcccctcttaagcgccggacggcgcgcgaatgtcggagcagattgtacgcgaggccagcgcttggcaagggacgattgaaggcgattatcgagaatcagcccagaattttgcaccgggcttgctcaaagtgctcattcgtcgacgtctaaatctgcattcgtcaagcttttggcaaggttgacccaaaactggccaatatctaaccaagaacttgccacatcgcttgacgcacgacccatcaaaaatcgccccgcgacttctcggacgctttttcgagcaatattttcgatagcagatatatgccgtcaattaccttaagcaggtaagcagctcaaatgacatcacagccgactgaataaaatatcaaggcaatgtcaccaatgactgccctacggatcatttgacaaccaaggaaacgccgatgttttggcaatgccagcgagcgacgtccagagcgaacaagttggcatcagaaccacccttaaaaagggtggtttgctcttagggtataacccacgggcccatttaagccgtccaggttttggggtgcagttcaagacagggggcgtaaagacgaaagtgaccgtcgggcgaaacgccgccgttccccgattgggtgtactttttgagatcgtcgacttgtgccaggatcacgcgtgcacgacgcgcaaattctctgcccgccggagacaaaacagcctcccccgccgatcggtcgagcaaaacaatctgatactcagattccaactttttgattgccgacgaaacggcctgtgggctcacgtgaacggcgcgagccgctttgcgcacgccgccgtagttcgctaccgcttgaaggtattcgagttgagaaagctgcataggttactccaaaggcagccaaggcgacaggctgtgcgtcctcagatgaggttctcgcccaggttcttgccgccgaggacgtgcatgtggaagtgcatgacggtctggccggcgttgacgcccttgttggagatgacgcggaaaccgtcctccaagcccttggccttagcgacctcctggatggcgtgagccatggcgcccatggtctcggccggtacgttgtcggcgatgtcactgtagtgtttcttgggaatcacgagcgtatggaccggcgcctggggattgaggtcgtcgaaggcgatgacctggtcgtcctcatagacaacggtcgaggggatctcgtggttggcaattttgcagaagatgcaatcgcacatggttggttcctttctcacagaccaaggcaattatatttggtcgggatggttagaacgagaggttgtcgtcggtgttggcggcctcgccgtcggcgagcacgtcgttgccgtcgacatccttaaggagcaccgagaccttctgctcggcatcggacaggcgggtgcgcaggctttttagaagctcaacgccgcgggtatagctctcgagcgactcctcgagctccatatcgcccgactccaagctgcggatgatgagctccagttcctgcgaggcctgcttgtacgtaagctgctcgaccggggtcttctctgccatatctgtttcctttcctaaaggttttcgctatgaaacgcggactactcgactgtatcgaccgttgccgccacgttgccgtctgccatgcgcacgcgaatggcgtcgccgggcttaaaggtcttggcactcgtagccaccccatcatcgctgtacgcgatggaatagccacgggcaagcaccttgagcggcgacagggcatcgagcgacgcggcagctcggcccaggtcggacgcgggcttgccgagcatcgtacgtccctgatgctccagacgggaactcgcaagcgtgagcgcatggcgtttgccatcgagccccgaggtgcttgcaaccagacgctcgggcaagcgttcaaagctggatcggaaagctccgaccgagcgtactatggcacccgacaggcgatcggcggtcagcgcaagctccgattcgcgacgctcgaccataaatgtggggtcgttgaggcacgggcggcatgcagccgcatcgagcgcatcgcccaagcgggccgtataggtatcccaggcacggcgaccgcgctgatcgagcatctccaggtcgacctgggccgacccaatcatcgatgccatcgcggcacccagacgctgatggcgtgcctcgagcacatcggccaactccgtcatagccggcgccaccgattctgccgccgccgtgggcgtggaggcgcggcggtcgctcaccatgtcgcaaatcgaggtatcgggctcatggccgataccggtcaccacgggcacgggacaggcagccaccgcacgggcaagctcctcgtcgttgaaggtcatgaggtcctcaaaggagccgccgccgcgcaccagcaagatgcagtcgggcgccggcgtgattgcggcggcacggcgcaggccctcaataagctcggccggcgcaccctcgccttgaaccttagcgcccacgcagacgagctcgacgagcgggttgcgacgacgcaatgtgcgcttgacgtcgtcgattacggcacccgaaagcgaggtaacgaccgccacgcgggagcagaacaccgggatgcggcgcttgcgcgcttcgtccatcaggccctcgcggcgtagcttttcggccagttgcgccacttgttgacgcagcagaccctcgcccgccagcgaaaatgagcgagcgacaaagctcatgcggcccgtggccttatagagattgaagctgcccttaaagctcacctgcatgccatcgcgcaagtcgaaggtgcgcttaaggtaggcgcccttccagataatgcagtcgacggcggccaagtcgtccttgatctggaagtagcagtgaccgcttcgggcgttaggaccacgaaaacctgtgacctcgcccagaacgctcagctgcggaatggcatcgagcgcaccggcggcgatctccactgcctggctcacgctgagctccttgcgctcctgatcgtccgaaccgtcgaactcggcggaaacggcattgccggttagattccagcctgccacgcagcctcctttcgctatcgagcacaagggcttcgaccctgcgcagattcaagtccaacacatagtacagcgccgcggggacaagaatctccgcggcgcctgtcaagccaatttgttatcggttggagtttctgttgtagcgggccatcaggtagagcagctgaataatcgaggtgagcgccgccgccacgtaggtgagcgcggctgccgtcagcaccttcttggcaccgttgacctgcttggaactcatgcccgactgctcgatatacgccacggcgcggcgactggcatcgatctcgacaggcaacgtaacgagttggaacagcacactaaacgagaagaagatcaatgcgagggtcgtgagcccggcgatgttcataaacaggcccaagagcaacacgatggtccaggtgttctgggtaaagttgacgaccgggaccagggcggtgcgaaccttcatcatggcgtaaccgctctgacgctgggcggcatgacccgcctcgtggcaggccactgcaacgcttgcgaccgatccgcccgaacggttagcgtccgagagatacaggttgttatcctgcgggttgtagtggtcggtgagctcaccggcaacgcccttgatacccacggcgttgcaaccgttggcgtcgagcatgcggcgagcgaccgtggcacccgtgtcgccgtccgagcgaaccttggaccaggtcttgtacgtcgagttgatatagctctgcgccgcaagaccaagcaccgtacaaacaaggacaaccagcaggtacagcgggtcgatgccaaagccgtaaccatagtaatagggcatgcgaattcctccgaatcgaattacacgttggaggcattctacccactcaagcggctaggcttccctacaggagctcaatctttccgtccttcacggtgagtcccatattgccggaaagcagatcgtccagacgcgaacccacgagctcaaagcgccagccttcgcgcagggggctttgctcgggatgctcaatgtagtcggccaggtcatcgcgcgaggcaatgaccgaggtcgccacgcccgagcgctcggcaaccaggcggatgagcgcgtacatgagatccgtcacgctctcaagctccggcgaaatctggcgatgcccgcgcaccatgagcggcaggcgatcgtgcggacagcttgcgccgcgcttgatggccatcaacgcgccatccacgtcgcgctcccccagctggtcggtaccgcggatgctacggaactcctcgacacgcacgggattgcgcttaaccagggccagcagcgtatcgtcggacatgacccacttgcgcgggatgttgcgacgctcggcgcggtcctcgcgccaagcggcaagctcgcgcgcaatgcccagctgatggcggctacacgagttgatgcgtttgaccttgcggaatgcctcatggcggtcggcgcggtagtgcgactcgtcggccaaaggacgcaactcgtcgagcacccagtccacgcggcccagctcacgcaggcggctcatcatctcggtataggcgacgattaagtacttgacgtcatcgatcgcgtactcgatctgcttatcgctcagcgggcggcgcgaccaatcggtcagcgactcggtcttgggcagtgatacgccgcagaacgtctgaacgagcgcaccatacgaaatctgctggcgctcgcccaaaaaggcggcggcaacctgcgtgtcaaaaatcggtcgcggcagtgcgcccacggtatggagcataacttccatgtcctgtgagcaagcatggaataccttgaccacgccctcgtcggccataagctcggcaagcggcgacaggtcgtcgatcaccagcggatcgaccgctacactctcggcaggggtggcaatctgaaccaaacacagacgcggatggaacgtgcgctcgcgcaaaaactcggtatcgacggcaatcgcgtcgaactcacgggcgcgctggcaaaagtcgagtagagcctgatgtgtggaaatgtacatatcaacccatcgaataaggttaggcccgaaaaacacgggtaggatatcggcattgccttacaactatactcggttagtcacagaacgggaacgtaagtatgcgctgccttatcatccacaacccggcatcgggccccagctcagatgaaatctacgcattcacgcacgcccttgcacagggcggcgacgaagtcgtgatgcgctttatcggcgatggcatggagcccgaggacgccgtggcagacgttcgcgagttcgaccgcgtggtcgtctcgggcggcgacggcaccgtctccaacgtgctcgaccagatgcgcggctgcggcgtccccacgctcgttttcccctccggcacggcctgcctgttctttaacaacatcggcaatgcccccgaggcagcggcgcttgccaaggcatgtcgcgccggccgcacggtcaaagtagacatgggcgagctcttttggctcgacgagaacggcaacgaaaagcgccatggctttatcatcatcgccggttcgggctttgacgccgagatcatgatgaaggccgcccccaccaaaaacgacatcggcgagatcgcctacttcctctccgctctcgccacgcccaaccccacggtggcgcactttaccattgagcatgatggcattgttgaggagctcgacggcatctgctgcatggcgggcaacacgtctgtcatccaaaacgacatcaacctgttccccaactgccgtatgaacgacggcatggtcgacatcgtcgttattgagcccgtgcgcacggtgcagttgctccccacggtaatcaccgccgcgctcgaccccgccggcaaggtactcgggcgcccgcagttcaagatcatccagaccaaggaagccaagatcacctgcaccccgtcgctgggcatgcagttcgatggcgagattatctccagcaattcgggcgtctttggagcccgcgcgcttccgcaatgcctcgacctcatcgtcgacgaattctccccgctcggaaaataggaggaccctatgaacgacaatcccctgctcggctttatcatcatcgttttggccatgctcgtcggctatgcgatcaacgtgatccaccgccggaagaagtaattccacattggtatgatattcatccaattatcgtctcccctgctgtttatgcatttgccaaacagcaggggattttcatttcaggcattcccagctactttattcggctacagtaattacagggcgtctttattaaagtaaagctacaaactgagtacaattaaccgctcgtcgcatatttcatcacgcttatcgagtaagtgtctttcatagatgaatattgtttccagttcgttacgctaatggggtgtctttattggctgaagccctctggcgacagagggctttcgcacgctgggagggaaaatgaggaaaactcaccccgtcaacgcgctcaagaagctaggcataggcctcgcctttggagctgcaaccatcatgtccatgccgacatccgcgctcgcctgcacgcagatatacatgggcaaaaactatacggccgacggcaatacgtactacggccgcgccgaggactttggcaagcgctatcttaagcactacggcatcgaacctgcccacgaacctggctttaagtacagctcgattgaatctgcttttgaatacacttcgaacaagcctacctatcgttacagctatgtacgcgaccacccctccaactggatgggtcgcaccgacgcctattccgaggccggaatcaacgagaagggcgtctcctgctctgccacgctaagcacttcctataacgaggaggccgatgcagcagaccgcatcgatgagaaagtgggtctgggcgagtacagttacggcagcatcatcctgggcgagagcgccacggcccgcgagggcgtcgagcttctcggcagactgatcgatgatcaaggcgtctgcaccaacgaccagatcatcatcgccgacaacaacgagacctggctgttcgccacactttccgcccatcagtggatcgccatgaagctcgctgacgacgtcgcgtcgctcaaccctaatatcgggagcctcaactacgatgtcgaccttgatgaccccgagaactgcctacactccgagggcatcgagtccatgcccgtggagaagggcttcgccaaatactccgctgacggcaaattcgatgtcgcccaaacgtatggcgaaagcctcgccgattccggcgtaaaccagtggtcccgctatgtgcaaggccgcgattattttggtagtcagctgaccgaaggcacagattacgacattatcacagtaaagaaggatggaaaacctgaccaaaagggagccatggtcagcgaaatccagcccctgttcttcaggcctggcaagtctggctggagcacctttgagctgattcgtgcctttggcaaccgcggcgagaacgtccctggcctcaacgcgaacactgatggtgtttattgcatcggcagcgagcgcaacaccgagatcaacctcttccagattcgtcgcgggtatgaccccgaagtcgctaccatccagtgggaaatgctctcccgcgccgcgtactccgtcgccatcccgttgtactccgctctgataactgaggtcagcccgtacttcagcgatcagaccgtctccttcgatcactgcaaccagactgacgtcgtgtacaacgaggagcccgagaactcaatcaactacgtcctcatggacatcagctcgctctgcttcgagaaccctgacacccttggtgtcagcgtccgtgcctacctcgatgcgctccagaacgagcttatcgagcagaacaaggaagttgacgccgccatgctggccgagacgaccaccgagggccgcaccgccctggccaacaaggccggcaaggctgctaccgagaacacctacaagaagtgcaaggcactgctccaggagatgcgcgcctatcagaaggccgaaaacttcgaccagccctttaccccaagcgacctgaacaccgagaccaacggcctcaaggtgtccatcacctacgccaaggatgctcttgccaccgatccggtcaccccggatcagcccggcactcctgagcagcctggcactcccgagcagcccgctaagcccgagcagcccgctaagcccgagcagccggccgccaagcctgagaagcctggcaagtccgacaccacgaccacggtaaccactaacaagacgaacaccaagggcggcctgcccaccactggcgatcgttttgatggccgcatggtggccgcattcgccatcgctggcgttgccgtcatctccgcgggcggttacttcctctaccgtcgcaataaggagtaacgtcctagctgtgcgggcgaggcagcaatggcagcctcgcccgctcagcccgctcttttgaccggcgggaaacccgcctgaaatcttttcaaaaaagatttccccgcacacactttgctgtgttatagtgcagcgcaacagcaactaggtgcgaccgcgccatggcatcacgaaaggagccaccgacatgaagaacacgatgaagtctcttaacaactggtggtggcgtgatgcgaatacgatcggtcgacagtgagtccctcacgcctgtttttgcgctctaggtgattggaaggcctccggtttcgaccgggggcctttttctatctcgagcccgatcgcattcgcatcacgcgcctccgcttttctcttgcactcccattccaaaaggattttcaccatgtctcagaacaccaccgccacccagccccgcaccgtccagaccgccgaccgtggcaaactcgatgtccgcgccctcgtcctgcttgccatcctgctcgccgccggcttcatcctcaacttcaccgtcggcaaggccatctcgggcatctcgggcggcatgatcagccccgagttcatcatctcggccttctgcctcaccatcctggttgttcgccccaacatcggccaggcgctcgtcatcggcctcatctcggctgccgtgatccagatcaccaccacttcgccgttcgtcgattttgccgccgagggcatcgccaccatgctcatggccggcatcgtcaacgccgccggcaagaacggtcaaatcaagcccgccatcgccattgtcgcaaccttcctgaccacatttgcctccggcgtcatcttcatggtcatcaagatggccatgctcggcgtggtaggcgagctcgccgccgccatgctgcccgtcgttgccatgaccgccgtctttaacgccattctggtcggcgccctctacctgcccatccagaaggcccttaggctcaactaacccgctcggctttacgagccaccccatcttggcgttaattcgtcgctcgcgtactcaagtacgcttcgctcctctttcgcgccaacctggggcccctcgtaaagccgtctccgtgcttcaccaccaaagactgtcccaaacaacgagcttttggggacgttcttaaaagactggtcatttaagaacgtccccaatgactatgaaaggtatccatggaaacgatcatcaacgtcgacgatgtctcgttctcctatggcacgcagaccgagcagacgctcagccacatttcgctcagcgtgaacaagggagatttcatcggcatcatcgggccctcgggcgccggcaagtccacgcttgccgcctgcctgtcaggtgccgtgccccaccactacaccggcacgttctttgggtccgtcatggttgacggccacgacacctgcgaggtctcgctgaccgacgtgtcgcaaatcgtcggcagcgtgctgcaggatatcgacacgcagatggtcgcttcgatcgtcgaggacgagatgctctttggcctcgagaactttggcgttccccacgacaagatcgagcagcgcttgagcgaaacgctcgagaccgtcggcatcagcgacctgcgtgaccgcgagatcgccaccctctcgggcggacagaagcaaaaggtggccatcgccgccatcctcgccatgcgtccgcgcgtcttggttctcgacgagcccaccgcggcactcgaccccgccagctccacgctggtcttcgagacgctgcgtgaggcaaaccgcacacttggaatcaccatcgtcgtcgttgagcaaaaggtcgccctgctctcggagtactgcaaccgcgtgctcgtgctcaaccatggcgaaatcgcgctacagggcgagccgcacgaggtctttgcgcacaccgacgagctccgcgccatcggcgtcgactgcccccgcgtcacacgcatctttaacagccttgaggccgatggtctggcaagcggcaccccttgcttagatgtcgatgaggccgagcgcctgatttcgggcatcgtcgaccccgcacatgctgccagcgacgcccaagcgcccgcaggctccccgcatgccccatcgttgcgtccgcacgccaaggacgccgagcccgtgctcaccttcgatcacgttgagtttgcctatcccaatggcggcgccgccgtacacgaccttaacctgacgctctaccccggcgagctcgtgggcatcgtcggccaaaacggcgccggcaagactacgctcaccaagttgctcacgggcctgcttaagcctgcctcgggcagcgtgcgcgttacgggcctggacaccgctgcggtccccacgagccgcatcgcccgcgaggtcgcaacgctcttccaaaaccccgaccgccagatctgcaaggataccgtgctcgacgaggtcgcttttggcctggagcttgccggcatcgaccgcgccgaggccctgcgtcgtgcccagctcgtcatcgaccgctttggcctgcccgccgacgaggcgcctttctcgctttcgcgcggccagcgacaaatggtggcgctcgcctccgtcgtagtggttgagcccaagatcgtagtgctcgacgagcccacgagcggccttgactaccgcgagtgcatgaccgtcatggaaacggtgcgcaccatggcagagcgcggctgcgccgtgatcatggtctgccacgatatggaagtcgtttccgactttgccgagcgcatcgttgtgatggccgacggccgtatcctcgaccgcggacgcacacacgagctgttctcgaatattaagctcatgcagcgtgcctacgtggagccgccccaggtcattgaactctcgcgccgcttggcatcctccgtctcccccgcttttgcgcaggtgagcgaggttaccgatatcgttcgcattaccaaggagatggtccgtcgtggttaacgtcatcgactatatgccgggcgacacgctgttgcatcgcctgaaccccgtcgtcaagctgggcctcgccgccgccatcatcatcggcatctttttgtccgacacctatgtggcgctgttaggctttttggcactcacccttgcgctgggcgcctacgccggcgtcgtcaatcgcctgttctcgctgctcaagctgctgattccgctcgcgctcatcatgctggtgctgcagttggcatttatgcgcgacggcaatgtggtgtggggctttatcaccgacacgggccttatcactggatcgaaggcctgcctccgcctgctgggcgtagcgttgccactcatcctcatgctcatggtgaccaagctcaacgaccttgccaacgcctgcgtcgaggtactgcacgtaccgtatcgctacgccttcacctttaccacggcactgcgttttgtgccggtgtttggccaagagatgaatgccatcatggaggcgcagaccgcgcgcggcgtcgagtacgacaccaagaaccccatcaagaagctcaaactcatgctgccgttgtgcgtgccgctgcttatctcgagcgtgggcaagaccgacgccaccgcgcttgccgccgagcagcgcggcttttatctgcgcacgcgcgccagctcgtacaagcgctatcccatcaagggtctggatgtcgccgtgatcgccatcagcgccgccctcattgtcctcggtttcctgttctagctcatcgtcagcaccaaccgcctaatgcaaaaggcctcggctcgaccaaacgagccgaggcctttactgtttccccagataaaacctaccaaaataaacctgtccctttttggtaggcatggggctagaggcggtagggagcgccgctgcgaatgatggattcacgcaccaagacgtccatggcgtcgagggtaatctcgggcatctcgcggtacttctgcaacactgagagctccgtgcaagccaaaatgacgcgatcgcagccgctgcgggcgaactcccacatcacgcggtcgaacttgtccatatcgggctcgcgtccggccttcacgtcatcatagatcagcgacatcacatcggcctgacgcttctcgctggggtagacaacctcgacgcccacagcctcgcattcgcgcccatagacgcccgcacccacggttccgtcggtgcccatgatgccgatcttgcgcaccggctctaccggcatgctcaggttgggatcgaactcgcactcccccatcaccgcaccggccagagcatagcgcaccgactcgcgcggcatgtggataatcggcaccgtcgtaaacgactggatctggtcgtagaagtagtgtgacgtgttgcagggaatggcgatgtgcgtacagcccagcgactcaagtgcctgggcgcactccttcatggtcgccagcagctcggcatgctcaccggtcttgatggccagcgtgcggtcgggcatggtcgacttggaaagcaccaccatgtcgatatgttcctggtcgcacgtagcggccgtatggcgcaccacctggtcgtagtaatacgacgtggcctcggcgcccatgccgccgataactcccagcttttccatcgccgcctccttggtgacgcttgcgcaattgcgcgtatcatacccgcgcccgcccgatgtaaaccggacgggcgccgcactcgtctacttgtaatacgtcttgaacagcttaaagtgacgcagcttggtgtgccacatgcgcagccagcggttaaagacaaagtcgcccttcataaacgaagggtcggcccccttgccctccctatccaggcgatgcaccttagcgcgcagctcgggatccttgacgtacttgtcgacgacacccatggggacgaccatccacagcgcctcgtcctgcgccgtcacaaactccggctcaaacgggcggttgaacacatactcgtctaccacgtacttggcaacgttaaagccgctgttggtgacatagtagttgctgcggccctgacgggtattgaagtcgaagaacttaaacgagccatcgcgctcgtcatacttcacgtcaaagttggaatagcccacaaagtgaaggtcctcgagcagcttgcgcacgccacccataagctcgtcattgggctcggtgatgatacaggcatggttgccaacgccatggggctgatgctcctcgagcagcacgtggcccaggcacatcatgcgtaccttaccgttgcgatcggaatagctggtgagcacgcgcatgtactcgtcgttgccgggcacgcggtcctgcaagatcaggtcgtcggtgtagccgctggcataggagtcacggataacctgctccagctcggcgcgatcggcaatctcataagccttcttctggccctcgaactcatgctgccaccacatgatgccgtcggacggcttcaggatcatcgggaacgggaagtcgatctggtcgagcacttcggccggcgcctcgccttgcgcattgagcatctgcgcagtaaaggtaaaggtgtgcggatacggcacgccatgcttctcgcacagctcgtagaagatctccttcttctggcactgctcgagcatgctgtagggtgcatagggcgcaacgatgttatccgccagctcatcggcatcctttgcctgggccaccagggcaacatagttatcgccgcagcccatcaggacgatcgtcttatcggcatgcgcctgggcaatgccgttgacggtctcgagcatcacgggcatggtatcgatgtcgacattgggcgtgtagtcgataatctggcttcgatacgcagggcccgtctgatacttgccaaagaccagactcttgacctgatactcttcgtagaaggcgcgcgccaccgaataggcgttgatgtcgccaccgagcagcacgggaatgaactcgcgctctgtaaactgcaatgccatggaaacttcctatcatgaactgcccgcacaacgggcggtcttagtgcaaccgattcattctagcgtgccaaaccgccagcacccaaagttccaccgtatctatggcaatcggagaatcagactcgagcaaagacggcgctcaccgctgtacgacaacgggcaatgaacctaccgttgttgtaggattcaacatattgtcaatctcataagcgaaaggcgcacacgtgccccaagaacatctgaccgacaaccccatccttgacgccgcaaaacgcgagctggcggaacgttctcagacgatcgctcccctacgcaccgccagcaacgcctacgaagcacccgcccgcatcgtttcgattaacacgtcggcgcacaaaggcacacgcaagtcacccgtctccgatgggcacgacaccgtcattgagcagtttggcctcgcttccgatgcacacgccgggcactggcaccgccaagtctcgtttttggccgcagaatcaatccagactgcccagcatcgcgggctcgatgtgcacgaaggcgactttggggagaacttcaccacacaaggtatcaacctgctttcgctccccctgggcacacagctcaagatcggcaacgacgttctggtcgagatcagccagatcggcaaagtctgccacacccgctgcgctatctaccatctcgccggcgactgcatctttccccacgagggcattttcggtgtggtgcttcgaggcggagaggtgcatgtcggagacgatatccagacagtcaagctcggcaacggcgcatgttctttcaccccagccgaggcgctcgaagaaattgagcaggctcgccgcgaggaaaccctataggtgcaaaaccccatgttggagtagcccttaaggcgtgaatctgcgatcagaccgagttccgtaacgttaaagttgaactctatggtttctcaacaattcactataactgcaggtcaaagccaaagcctcaagtttaacttgaccctttggaacctttaaggttcaagttgaggtcgaaagcagtagtagaataccgttcgaaccataacctacgattgattgcagagggattggatgcagcattcgaatcatcgcgtcgcagcgctcatcgcgtcgaagccagctcgtatcatcacgagcgccgcactcgctgtcgcactgactgccacgccgatgctctcccccgttgcggcatatgccgcctcgcaggcaacgcaggatcagctttccgccgcgcagcaaaaaatcgaagccgccacgagcgcctacaacgatgcccgcaccaaactcgacgacctgcaaaagcagatcgactccgatgaggcgagcatcgaggaaatcgaggccaagcttcccgagcagcaggccaaggcaagctccgccatgcgcgatctgtacaagtaccagaagggcaccaatcccatcgtgagcttcctggtcaacgcgcagagcctgggtgagttcatcaccacctgcaaatacaccaaccagatcacgagctcgagcgtcgatgagatcgaagagctcaacaacatgcaaaccgaactcgagcagaacaaggccgagctccagcaggccaagtcccagcttgaggcagaacagaaaaacgccgaggattcgctggcgcaggcccagcagctccgcagcgaggcgcaggcaaaagccgagcaggaaaatgccgccgagctcgccaagcttgaggccgataaggccgctgccgccgagaagctctcgggcgagggcgtaagcggcagcaattccagcagtcaggccaccaacaccaacaccaccatcgacaccacggtgaacaacgccaataccggtaattccgattacgattcgttcattaatgagtggacgagccgcatcgataattatcttgccgggtcccccatggcaggccagggctataactttgccgtcgccgcttggaataccggtgtcgacccccgttggtcccccgccatcgcctgcatcgagagcaccaagggcacttattgcgctaattcctacaacgcctggggctggagcgctcgtggcggcggttggcgcagctttggcagctggagcgagggcatctccgctcatgttgcctatctgggcgccaactacggctccacccttacccctgcagcggccaaaaagtactgcccgcccacatggcaggactggtacaacaaggtcgccgctcagatgaaccgcatctaagcgcaactgtaaagggccccgacgggcccttttcttttaggcagtggaggtgtcaacgacaccggtcgcattggcaaccgcaactatgacgatcatgcataggagcagcacgcccaatgccttgagccagagcttcgcgagcttcttgccgcgatagctgtcgagcagcgcgaatcgccgacgaaggcgacgcttgtcgagcagcgcaaaatgcataagcaccataaggccatcgacaaagaaaaagtactcgattataagaagccaggtcggatagctttggtttgctccggtggggtgaaagacggcaaagtggcttccggcaaagaatacaagcagcgagaggcagacaagcgtattccaaatgcgccccagaggctccggaatgcgagaaagcaggccgggcatagcaggggtggcaagcttaggaaggtctgtggaaccccggggctcttgagacgttaataccgtctctgacgccggggcacagtcaggcacaggcacaggcgcaggcgcaggaggccgcacagggcaactcaggtcgtatgccgcgcgcgtcgcccgtcccaatgcccccgcgctcgcaaaacgcttggccgggtcgagagccatcgccatgcaaatgacatcggtcagggaagcgggaatgccgcgcatctcgcattgttcgcgcatgtcgatccccggttttggatcgactcctgtcaagcagaagaacagcagggcgcccagcgcatacacatcacttcgcacactcgtctgcccaaacccatactgctcgggcggcgcgtagggccgtgtgccaaacttggcggtatcggcatcggcgccttcgcgccaagcgcgcgcgattcccaggtcaataatcaccagcgacgagaaggtcatgccggcatcggcggcatatctcacgcccgacacgatgatgttcgaaggtttaaggtcgcgatggataatcggagccggcgctttccccacctcgccaaatccagcatggagctctgccaccgcatcacacagggccggaaacaacccgcgcgcataatcgggggtcgcacccaaacgtcccaccaaggcctcgagcgtctcgccttcaatgtattccatcaccacgtcaagctcgtcgcccgcacggcggcaatcgacaatccggggcaggtgctcaaaacgccgtccggcacgctgggccgcaaacaggcgctcatatgccccgccaatctgggccgaagcatcgatgcgtttgcggacaaaggggccgagcgaccctccaccagaaccctcaaagcacacgagttcggttgtctcaacgtccgagcgctttagcacgcgttccacgcgatagctgtcatcgcggtcaaacgacgccaggtgctcggcgagcgcggcagtcagctcatcatcggaatatgttgggttctgagtatccatagcgtccatcatagcgcagggcacagacgccctgtagcacccgtgccctgcacgtttgaaatatagcggacggccctgccaccaacagtcagccgttaactcaccgtctcctcgccaaagcgatacagctcctcattgaccttttgcaggctgcagccacgatcgatgcagaagatgataatcgcatcacgacggtccttgcagttgaggacgtttgccccggcagccgtaagtgcgcggttggtctccttcatcgataacgccatcgcgaatgcaatctgcagcactttatttcgactcgggtggcgcgcgcccgtaaaaatctgatagccaaacgtttcgttgaggtcggccatacgcaccacgcgcgaacgctccaagcccttttcctgcagcagttgcttaaggtagtccgaaagcgacggggcggcaaagtcgtgctccctgatatagccgtcgatactcggcgcatcgagcaactcattgagcagttcctccgtcaacttcttatcgggcatacggcttcaccccctatgcgacgcaacggcagcgacatactaggccaacacccagcttgcggtggcagacttatcaaacatgttggcaaagtacaaagcctttttgatgtcgccgtcaaaatagatattgcccgcaacagtaccgccggctgcaagggtgcccgactgcagctcttcagagccttcgctgtagtagccctgattctgctgagcaccgttggcgtcctcgcccttccagtcgtagacattgtaatccgcgccctcatcgccgttgttgacgtacgtgacgtgaatgcccgtcatagtcgagccgtcataattggtaagacctgtctggacggaatcgacgacaacggaaaggccggcggccgtggtcacggttgtgccaacagccaggtcagtcgtgggctgctcttcttttaatatgagaaagccattgtcaataggcatgttcgtttgagcccggtttaaatcccatgcgaacctccagtccggaccgcttcacggtccaactttctgtccgcacccccaaacggccccttttcgttctcggggacaaaaatcgcgcgtctactcactcgggataaatccttactcccattcctccgaataccgccccgtgccttgccgtctcgaaacacggggagtaaatcgcgaaattgcaggtgaaagggagtaaatagccaaagaaaaagcctccgttccgacgcgggaacagaggctcgataatcggatttactcaccaatgtcgctggcggctttgccgtgactctcgtacaaaacgaaactcagcagcacagtgcggcactcaaaaatacaggtcagaaccctgtcagactactcccactcgatcgtcgcgggcggcttggacgtgatgtcgtagcacacgcggttggcgccgggaacctcggcaacgatgcggccggagatgcgggcaagcacgtcgtagggcagtttggcccagtcggctgtcatagcgtcgctggactcgacggcgcgcaggatgatcgggcgctggtaggtacgctcgtcacccataacaccgacggacttgatgtcgggcaggaccgcgaaatactgccagcagctgtgctcggagttgcgctcgccagtctgctcaaacagacgctggttgtaggcgtcgagctcctcgcgcacgatagcgtcagcgttcttgaggatctcgagcttctccttgtcgaccgcgccgatgatgcggatggcaagacccgggcccgggaaaggctggcggaacacgatgtgacccggcagtccgagcgccagaccaagcgcgcggacctcgtccttaaagaagtggtcgagcggctcaataaggtcgaagtgcacgccctcggggaacgggattaggttgtgatggctcttgatggtggccgtcttgccgcccgtcttgcgagcgccggactcgatgatgtcggggtagatggtgccctgagccagatacttgaccggcttgccatcggtctcgagctgctgcgccacggcgaagaactctttccagaactgcgtaccgatgatgcggcgcttctcctcgggctcggtcacgccggccagaagctcggcataacggtcctcggcgtggacgtgaataaagtcgacgtcaaactgcttggtgaagacctcctccacctgctcgggctcgcccttgcgaagcagaccgtggttgatgaacacgcaggtcatctgcttgcccacggcgcgggcgcccagcgcagccacgacggaggagtcaacgccgccggacagagccagaatcacgcggtcgtcaccgaccttctcgcggaactcggccgtcatggtctcgaccaggtcgtccatgctccagttgggctccaggccgcagatctcaaacaggaaattgctcagcagctgctgaccgtactcggagtgcttgacctcggggtggaactgcgtggtgaaaatcttgcgctcgacgcactccatggcggcaaccgggcacacgtcggtgctggcggtaacggtaaagccctcgggcacctcggaaacggcgtcgcggtggctcatccacacggtctgctccataggcgtggagttaaagagcttggcgccggccgtgcgcgtgatggtggcgcggccgtactcgcccacctcggagtggccgaccttgccgccgagcgccacggccgtgatctgatggccgtagcaaaagcccaggacgggaaggcccaggtcaaagatggcgggatcgatagacggagcgtcctcagcatacacggaagccgggccgccggaaaggatgagcgcagaggcattcatctcgcgaatctcgtcggccgagatgtcgcaggggacgatctcggaatacacgttgaggtcgcggacgcgacgggcaatgagctgaccgtactgcgcaccaaagtcgagtacgaggacctttgcggaagccttttgatccatggttcccccctcttgttggcggggagccggtgcccacccgcgcgaataaacgagaataactttcatagtgtacacgttatatggggtttctcgtccctcgcagccatcagcgcacggcaaacgcacgacctgggcccctatttgacggcaattgaagtattaccaacgttacagatgatgtaatacgtttgaacattggacgccctgtgccacaatactgccgaacgactccgcctctgcggcggcaaatacgataggaataccagcatgaagcgcatccttctcatcgccacgggcggcaccatcgcatcgaccgaggacggcaacggcctctcccccgccctgaccggtgaggagctcgcccagagcgtccccgagatctcggggctctgcgagctcgacgtcgtgcagcccatgaacatcgacagcaccaacatgcgcccgagcgactggatgcgtatccgcgacgtcattgtcgagggttatgccgatcacgacggcttcgtgattctgcacggcactgacaccatgagctacaccgcagcagcgctttcctacctgattcaggacagccccaagcccatcgtgctcaccggctcgcaaaagcccatgggcaatccctttaccgacgccaagctcaacctgtaccagagcctgctctatgcactcgacgagcattcgcacgatgtgtcgattgtgtttggcggcgtcgccattgccggtacgcgcgcccgcaagcagcgcaccatgagcttcaacgcattcattagcgtcaactatccgcccattgcctacatccgcaatgaccgtatcgtgcgcaacgggcttcacggcacgcatcaggacgaaaacccggtgcatttctacgacagcatcgacccgcgcgtatttgtactcaagcttacgcccggcgtaaacccgggcatcctcgacgccctagccgatagctacgatgctgtaatccttgagacctttggcattggcggtattcccgagtttggcgagtccggcgagtcattccaggaggcgattttccgctgggtcgattcgggtcgcaccgtcgttatgaccacgcaggtcccagaagagggcctcgacctgggtgtttatgaggtcggccgcgcttacgccgatcatccgggtattttgcgcggcgatgacatgaccaccgagacgctcgtggccaagaccatgtgggcactcggccagtcacgcgatgcggcagagattcagcgtctgttctacagccaagtcaaccacgaccgcatcccgatggcttaatccctaaggcagttccgattatcgcagccttaaacgacaggtggtccccctcgggccgtgcaaaaatcggagtattctgcaatttctcctccggagacatagaatcggccgattattagacgaacttttaggacgaagggtccgtctagtaaatatttattcctcatttttatttagcgtgtggattatctactgtcaaaaaggcaaagccagccgctcgagctaccatctacggccgaactggtgctgaatactcgcgattttgcacatcgcaaccagggggacccgcccaaagagcgtcaaatacagcgggggaacgccctattcgataccctcgagaagctctgacaccgtcatgccgagtgcgggcgcgatcttaaatagaaccttgagcgtgaaatttgccgtcccatcttcgattcggtcgaggtagggtcggctgattcctgtcgccacacaaaaatcaaccttggagataccaaggtccctgcgtgtctcttcgacccgcctgccaagaatctgtttcgcacgttcgtccatgcagccgagtttgaaatggagtcgaacataaacgtaaactatagtttacgttttgccgaatacacaggagttttctatgtcggattcttcggtccgcatgtaccgagccacgcttcgcacaaacagcgcgccgcccaagctcgtcgtcgttgaagctgcatgcctttcgcccgatgagcgcacagcatttgcattgctatcaagtcgcgtcgtcgccgttctggtcccttgcccggcgaaaggtgaacttgccatccaatgccaaacgcacggctgctcgctcaatcaggctgccgtaatcgcaaccagccaacgcggcctgccgctccttttagaagccggcatagcactcgcccttcgcggcgccggatacgaaaacgaggccgccgccgatgtagtctttcaaccacgatcgagcggcggcctcgcatcagccattgaatatgcgtgcaggctcgttgcctaaaaggacaagctagaaaccaaagccaaagcccgttccggtaatcgccgagtacataaagtaaacgttgatcacgttgaggaacacacccgtgatgcaaccgttgcgcaggtagcgctcgcacacgatgcgcgccatggcggcggagtcatcattattatttgcctggcgtcccgccgtaaagtacgtcgccacgctcagcagcagattgagtaccggcagcgccaacagctcgtagctcttgccccagcgcgtcgcctcgccggcggcattaaacttcgttgccacctcgggaccaatgttggggataacgcacgctgcgaccaccagcggaatcaccgcaagtacgagcagcgcaatacccatgtagccagcttttttgccgtatttaaacatatgcgtcgcccttacacgttaaagcggaagtgcacgacgtcgccatcggccatgacatagtccttgccctcaatacgcagcttgccggcagccttggcgccctgctcgccgccgagctcgatgtagtcgtcgtaaccaatgacctcggccttaataaagccgcgctcaaagtcggtgtggatgacgccggcagcctgcggggcggttgcgccctgacgaaccgtccaggccttgacctccatctcgccggccgtaaagaacgactgcagaccgagcagcttataggccgcctgcgcgagcacgtccagaccgggctgttccaggcccaggctctccaggtagtcggcggcgtcctcgggatcgagctcggaaagctcggcctcaatcttggcgcagatgggcaacggcttgacgccatcgatgggcgccaggtcgtcgttgagcatatcctcgtccacgttggccacatacaggatgggcttcatggtgagcaggaacagccccttggcggcggcacgctcctcgtcggtcatctccatggatgcggcgcgcttgccctcgttgagccaggcaagcaggcgcttggcgacctcgaacttgggcatgagctccttgtcgcgcttggcctccttctcgagcttaggcagctgcttctcgagcgtgcccatgtcggccaggatgagctcggtcatgatggtgtcggcatcgccggcgggatcgacgaactcgcccgtgcggcccacctcacgcatgacgttggggtccttaaagtagcgcacgacctcgcagatggcgtcggtctcacgaatgttggccaggaactggttgcccaggccctcgccctcgttagcgcccttcaccagacctgcgatgtcgacgaactcgaccgtcgccggcacaatacgacccgggttaacgatgtcggcaagcttttgcaagcggctatcgggcacgtcgacgatacccacgttggggtcgatcgtggcaaacgggtagttggcggcaaggccggtctttttggtaagcgcggtgaacagcgtcgacttgcccacgttgggcaggcccacgataccgatggaaagggacacgacagctccttttgatacaggtacttcaaactgcataagtatagcgccgccgcagcatccgggcgaatccggacaccgcggcggcgcaaatgaagcagagatagagctcgctgactagtccgcgagcttctccacttggtcgagcatcttatcgagcttggcctttgcctcggccttgaccttctcggcctcctcgtgggccttggccttctgagcggccttttcctcggcctcggggtcgacaacgaccagattggacgcatcgtgctcgaccagcttgagcgcatgctcggggcacaccttgacgcaggccccgcaacctaggcaataggtagactccagtgcaaagcggccgcttcccaccaaatcgcaggcgaacgtggggcatacattgacgcactcgccgcacgacgtgcacttgtcaaaatcgcactccggcgtgctcacctgcatgttctgggcaagctcggggtggttttgcagcgtcgagagcaccagctggcgcccgtgcgtgagcgaacggcggcgcttggtcgtcgtggtaccgcacatggtgttgagcgtgcgctcaagctgcgtgatctggtgacggtgggccttcaacttctgcgtcaccgaggccggtgccgcagtcgccgggttgagcttggtcaccgtcaggcccgtggtgcgggcaatcttttccatgtactccttgcgctcgtactcgcggcgcttatggcacttgaggctcctggggtcgacctctaggcccatacctgtgccagaccactcttcggccttcgcaatcgcctcgcccagaatgtcctcaccgccggtgttgcggcacttatcgcacacgcccaacggcaggtagacgctcacgttgggatagtcggccagtaccgagaaccaggtctcggccgtaatatcgcccacgcaggcgacgacgacctcgttttcgcgcggcatgcgcttaagggcgcgcgtgcaggtaacgtaggcggtctcgtggctcgtagcagcagagacgatatcgtcatacaggtttttgggcgccagacgcggcgagatgattgcctcggtcggacaggcagcggcgcacaggccgcacttgcgacaggagtcgaggatctcgatggcgtcttcctcgacctcgatagcgttgaccgggcacacgtccatgcacgcggtgcagccgctcttttcgtttttgcaggtcaggcacggaatggtgttgccgcgcggacgctccttgtagtcggcaggattccactgcggcgccgacggatcgagcgcatcggtcacgccgccaagcgggtttttaagaaagtcgaaacccttgctgatctcgataatgtcatcaaacagatcgtgttcctgcgccatgcgcggcccctccctgagcagtgcaaacaagcaagagataatgatacgctatcggcccacacctcgggcaaattacacgcggtgcaccttgagggaaataacccatggcctatcgccgccccgattgcacaaggtcaatcaagcgccaagctatgcctcgcacatgagctgcacgagtttttgtttggtcaccttggcctgttcgttagccatattgcgttcgtttctaaagaccgcatccgcaacgctcatcaggtcggtatcggaaatctcgccaagtcccagctccgcgagcgtcgtcggtagaccaacgcgctggcaaaactcgagcacctgatcaagctcgggcgcacgctccaggcgcagctgcaccaccaggccaaatgccacggcctcaccatgcatggccttgcactcgggcagaatcgtcaggccgttggctatggcatgggcaagcgctaagccaccactctcaaagccaacacccgagagcagaatattgcactcgatcaggcgctcaaccgctggcgatgtacggccctttttgagatcgcgcttggcagcgacgccgcactccatgagtgtgtcatagcaggcacgagccgcaaccaaggccaagtgtcccggcgcgccaccgtgctcgttggcgccgtgcgccgcggcgcacgaacgcgcctcgaaatacgttgccagcgcatcgcccataccagcgaccgtcatacgcagcggggccgccgcgaccacgttggtatcgaccacgaccaggtctggattcttctcgagcatcaggtagcggtcgaacgacccatcctcgtgatacagcaccgaaatcgcgctgcacggaccgtccatcgacgccgccgtgggacatacgcacaacggcaactcggcataaaacgcaacggccttggcgatatcgagcatcttgccgccgccaatgcccaccaccatgtcgcaatactcggcccgggcttccttggccatttcgacaacggcatcttccgtacacggaccgttgtaaatcttaaagaacggctcgcttagatcttcatccagaaatccatcgacgatctgcctgcacagccgatcctcggtgccctggtcaaacaagacataggcagcgcagcccaaccatgacaaatacctgccctggcgcgaaagctcccccggtccctgaacataccgaccggggccgccataaaccataggaagcgccatacgagaatccacccttcatcaaacaacgatggtgcaaagtaccctgacccctttgcaccatagcaaaaaggggcaaagccatctgttggctttgccccttccttagcttgatttactcatccatgagatagtagtggcccagtgcgtcggcacccaggatggcgtttgcgaccatctcgggcgtcacctcaaacggcatgttgcacatggtgtcctcgggcgcgcacgcagcctcggcaacaatcatggccttctcgcgcgtaagctcggcaacgccaagttccttcatcgtgaccggcagacccagctcaatgcagaagcccaagacttcctcgagcttctcggtcggggcatcctcgagtaccagctggacgatggtgccgaaggcgaccttctcgccgtgatacatgctgtggcactcgggcagcatcgtcagaccattgtggatggcatgagcagcagcaaggcccgagctctcaaagccaatgccggagagcagcgtattggcctcgatgatgtgctccacggcaggcgtcagcgcgcccttctccagcgcgaccttggccttgacgccatcggccataagcgtctcgtagcagagcttggcgagcgccaggccggccatgccgcccttgccgccagcgcaggtgccgccgtcggcatcgtgcgtcgcctgggcctcgaaataggttgcgagcgcatcgcccataccggaaaccgtcaggcgcaccgggctcgccgcgataaccgtcgtatccataaggacgatattggggttcgccttaaggaagaggtacttgtcgaactggccgtcatcggtatagagcaccgaaagtgccgagcacggtgcatcggtcgaagcaatggtggggcaaatgataaccgcggactccaggtagtaggcgacggccttcgcggtgtcgaggatcttgccgccaccgacgccgacgacgatatcgcaaccgttgtcgcgagcgagcgcaaccaggcgatcgacctcgcccttggagcactcgccgttaaaatcctcaaacagcagctcggccttagcctcggcaaagccgccctcgatcttggcaccgacgcgcttcttgcccgaaggcgtcacgatgacgagggccttagcgccgagcggctcgacataggagccgagcttggccagctcgtccggaccctggatgtacttgctggggctattgaaaattgcagccataactatcccattctctaaaagaaaaaagaaaggggctccgtacagatacgtgcggaacccctcgttacgataacaagagtcgattagaaatcgatgtcggtgtcgtagtagcaggccttgagaatcttctcgaagtcggcagccttggtctcacgcgggttctcgggcgtgcaggcgtcctgctcggcgttcgcggcgatctcggggagcttggcgaggaactcctcctcggaaaccatctgcgggttctcggcgtcgaccttcacgccaccattcgcgtaatccttgatggactgcggaatgttgagctggtcgttgaggtcgcggatcttctggacgagcgcagcgataagctcctcgttggtctcgccgggaaggtgcaggatctccttggccacgtaagcgtaacgctcggcagcacggggatccttggagttccactggatgaccttgcccaggtacatggcgttagcggcaccgtggatgatgtggccgttctcgaaggcagcaccggtcttgtgagccatggagtgaacgatgccgagcaggcccgaggagaaggcgataccggcgatgcactgagcctcgtgcatgtgctgacgggcctcatggtcgccagcataggacttgggcagccactcgacgatctcgcggatgccgtgcagagcattggcgtcggtgaacatagaggcgcaggtggaaacgtaggcctccatgcagtgggtcagagcatccatgccggtgtgagcgcacagcttggcgggcatggtgtaggtgagctcggggtcgacgatggcgacatcaggggtgatgttgaagtcggccagcgggtacttgatgcccttggcgtagtcggtaatgacggagaacgcggtgacctcggtagcggtgccggaggtagaggagatggcgcagaaatgagccttctgacgcagctcggggaaactgaacggctggatgatgttatcgaaggactcctcgggatactcgtagaagacccacatggccttagcggcatcgatgggcgagccgccgccgatggcgataatccagtcgggctcgaactcgcgcatggcctcggcgcccttcatgaccgtctcgatggacgggtcggactcgacgccctcgaacagcttgacctcgaaaccgccttccttaaggtcgttctcgacgtcctgcaggaatccgccgcggcgcatagagctgccgccagaaacgatgatggccttcttgcccttgaggttcttcacctcgtggcgagcgccctcaccaaagtacagatcgcgaggattggtaaaacgtcccatactgtgcctcctaaacaagcccctcttagacttgcgtatataacggagcacccgattggctccgttaggaccgttttgcgcgttgccggcgatggcaatgcgcgatgtcttaacgcctcaacgctcagacaaacactattttaccgttctggttggtcagttattcacctaaagccgccaatgatgaaacgttttttctatccctgaagacccttgtgcggcattcatactcccaagctgggcaaacgttttatcaaggttgactacatatcccgggcaggacggtgcccctccaaaatatgcaccgttcgccgccaaaaatcgaccgtttgcggcaccgtgataccactcggtcgtccaaggtgccgacatttgtgcgacatccgtcttcgtggtgcaaaggtgcaagtccaagtgcggcacccccggtgtgccacatgcgggtaaactagaaccttatatagaaacatttgaaccctaaccgcagcaaaggaggctccatggcattcgatcccattcaagaggattgccatcgcctcgttcttgaggccttgcgccgcgacaatatcccgctcaccgacggtgctgccgtagagcgtctgatggaacaattcacccgcaaccccgcaccgctcatcgtgcacgaccgcgaccgcgccgggcacctcattgccaaggtggtcgaggctgtcgactaccgcattccctttatccctgacgatacccaggcagagcaagaagaggtagctgccgagaacatgctccgcgaggcagccgcgctcgatccggccaactgggatgcccagcgcatgctgaccgccctcaccgccagctccaacgaggaatacgtacagtacttggcatccaagcgcgatgaagtcgagcatgacctggcgctcaaaatcgcctcggcgcaggacccctacgagcgtgaggccgctggcgaccttatgcgccgcccctacctgcgctggcttgccgccttggcatcgcgcgcgctcattagcggacgctaccacatgtcgctcgaagccgcgaatcgcagcttggactttgcgcccaacgaccccgctggtgtccgccacaccgcgatgctcgctatggcaaagctcgaataccccgccgaggagctcaagcgatttcgctctgcccactccgtcccctatctcgccaacacgccgctgcgccgtcgtcccaaagatgcggagcgcgacttggacccgtggacgctcatcgcactgatgagcgcagcctggcgcgagctggactacgagggcgccgagcactacctgcgtatccttgcgcgctcgtgtccgcacgcggccgaggcgctctacttccaaaccgagtttcccgatggcgtctatgcccgcgtcaacgtgggtgtgggctccaccgacgagctcgtcctcgcgctgtccgaggcaacgccggtgctgcaggagggcctgggcgctcccgacaacgccagctttgccgcctgggtcgccaccaacgatatcgtgcgttcccagatcgacgagcgcatcctgcgggcggccgagcagggcctgccgtttaagggaggagacctctaatggatccgagcgtctacatccccgcctacctggagcgcgcctaccttgcgtcgcaccccgaactcaccgatgcagcacgcgagcttgtccataacgacgcgagcgtcaaccctcataagtatgcgcagaccgagcatgcccaggcactgctgtcctacgccggtgttcatcgccacctgctcgacgagctccatcgcatcgaggacatgggcagcgacgaggagtttgagcagacgcgcaaccgtctgttcgacgacatgcgcgatgagctgctcaagatcgtccgcatcgatgcgcatgtcctcgacgcgcagctgctcgccatcatcctggccgacacgcccgtcgacgcctgcctgggcgacctgatgaagctcgaagcgaccacggccgattacctgcagcaaagcgtgcccgggttcgacatggaagccccgcactactgggccaataatgttttgaccgacggtgtcaccgcagcagaccttaccgtgagcgagccggctcttatcgggtggctccacacgctcgaggccatctcgcagctgtgcatggcgagcgcccgctaccacgctgctgccaactacgcccgccgcgtccttaaggcggaaggctaccccacccgagctgcaggcaccgtgttgctcgccctcgctcgcctggaagaccaggacggcttttttgccctggctcaccagctcgaggaacaggtgggggctgatgcactcgagaactccccctggtacctgctcgcccgcaccatcctcttgttcaaaacaaacaagatgcgcccggcgacacgcgcgctgcgtgagtttgccaaccgttgcgagggcggcgcgttcttcttgctgaaccccatgtaccagacgccgtaccttccctgccggcccgagccgcgcgatccctgggatctttcgcaccaggccgtttgggaagcggacggtattatctcggacactcccgactttgccccctgggccaatgcctgtgaagacgtgtcacagcttgcccaggaatttgcgcgccgctacggtttttagtgacgcactcgacccgaccatgtcgtttacgttaggaacggtttcatgaacctccgctcatctctcgcctgcacctcgagcgatatcgcccgctggggactgcgctccgtccttaagcgccagggcggcgtactccccggccgcatcgccatgaagatcgatcccgagttgctgagcgacctcgctggccttgtcgaccgcagcgtggtgattacgggcactaatggcaagaccaccacctccaacctcatcgccgacgccgttgccgccagcggcgccaccgtggtatgcaaccgcgccggcaacaacatggagccgggcgtggtgggcgcactgctcgaagcgcgcagcggcctcaagcgagccggtggcggcaagcgcgtgggcgtttttgagtgcgatgagctttacaccgtacgcgtcctgcccaagctcaagccgacctactttgtgctgctcaacctgttccgcgaccagctggaccgctacggcgagatcgaccacacccaggacgtcatcgcccacgcgctggagctttcgccggcaacgacactcatctataacgccgacgacccgctgtgcgcctcgattgccgcgcgcgttcccaacgcgagtattgcctttggcatcgacggcgccaccaacaccgagtccgaccgtattagcgactcacgtttttgctcacagtgcaacgcgccgctggagtatgactacgtgcaatacggccagctcggcgcctaccattgcccctcgtgcggctgggcccgccctgcgcttgtccgtcgcgtgacgggcgtggagctcggctgcgacggctacggctttgacctggtctttggatctgcgtccgacgcagctgccgtacacatcgccacgcgctacaacggcctgtacatggtctacaacgttgccgctgcattctttgccgcacatgagttaggcgtggatacggcgcacctgcagcccacgctcgatgcctacgtccccgccggcggacgcatgggccgctgggatatcgccggccgcaccgtcgaggccaacctggctaagaatcccgtaggcttcgatcgacaaatccagtccatcaagacggcaggcggcagactctgcgctttcttcctcaacgataacgatgccgacggccacgatgtatcgtggatctacgacgtcgactttgagcgcatcgccgacacgccgggtcttgtcgcctttgccggcggcacgcgcgcacacgacatgcaggtgcgcctgaagtacgccggcatcgacgccgccatcatctcgaatatcgagcaggcgattggcgccgtggcagacgaggaggctggcgacactttctacgccgtcgccaactacacggccttcccgccgctggtcaaggagctcgacgggcttaaagacgacgatgcaagctcggttgcctcctgcgccgtaacacgcgccgatgggagcgctgtccccaccgatattgcgccggtcgagctttcgcgcccgctgcgcatcgtctacctttatcccgatgccctcaacctctatggcgacggcggcaacgtcatcgccctcgagcgccgctgcgcctggcgtggcattcccgtgcgcgtggacgaggtccgtatgggcgagtcgctcgatctcaccgacgccgatatcgtcatgatgggcggcggctccgatcgcgaccagctggccgtggcgcacgagctgctcgctcaaaaagacaaggtcgcggcctatgttgaagatggtggctcattgcttgccatctgtggtagctaccagctgctcggccgttcatactacatgggtgaagatcgcattgaaggcttgggcatcatcgccgccgaaaccgtgcgcggttctgaccgcctgatcggcaacgtcgccgtcaagaccgacctggcgcccgagccctttgtgggattcgagaaccacggcggccgcactctgctcgacgcagatgccacgccgcttggaacgtccgtcgtcacgggcaccggcaacaacggagacgacggcttcgagggcctcatctacaagggcgtcatcggcacgtacctgcacggaccggcactgcccaagaaccccgaactcgccgactggctcattacccacgccctcgagcgccgtggcgacgcgcaggccacagccctgctgccgctcaagcccctcgacgacacctacgagcgcgccgcccacgacgccgccatgaagctcctcccctagcacctcacaaccacaaaggggacaggcacctttgtggttgttttgacccatcccagcggtttgtctcaatctgtaacatctagaccgttaaaagtcgtcttactgttacagaatgagatgttcgtcccgacgcctgccttttgtctcgatctgtaacagatagagccaatttgcccgcccagatgttacaggttgagatgttcgaagatcgggatagagagccagctcctatgtggtggttttccagtttgccaacgatatacgcgccggcaaaaaagtctgctatactctttcccgctgtccccatcgtctagcggccaaggacgccaccctttcaaggtggatatcgcgggttcgaatcccgctgggggcaccatttgaattgaagagcccgttaccctcgcggtagcgggctttttgctacccatgcgccgggattcgaacccgacagggtgcggagctgaggaaacgcgcaagcgttttccagcgcagcacgcaaggagcgaagcgacgcagcgaaagcgggcggcgccagccgcacgcggacatcccgctgggggcaccatttaaatcgagaagcccgttgccctcgcggtgaaccgcgccccaaatcttggacgccctaaatagcgactaggccacgagcgggggctcctatctttttagtgccctcggattgggtcatagtgtctgtcgttgccaaaacaacgtcgttcccttggttggcttaaagtggcacttttacctgcgacgttgccatcgctgaagtagtcattgggaaggcggcagctggggacgttccttttctgccggcagttggggacactccttgtgccagcgttgcaccgagtgcttgggaaaccgcgacccggtttttggccgaatagtgggtcgcattttccggatggggtgggttgcggaaactgcgacccggaatattgctctgaagtgggatgcggtttccctgatgcgcctcaaacggaaagcccatcccattccggagcttcaaaacgggatgcgctttccgcgcggaagaattgtcgcagctgcgttaagcagtgtcgctcgttactcgcccaggatcagcgctgcgagctctgcctgggtgtccaccacgtagtcggcgccggtggcttccagctctgcgcggccgcggaaaccccagctgacgcccgcactcttaaggccggcgttgtggccggtcaggatatcgacattggaatcgcctacgtagagcgtggtcgccgggtcggcgcctagctcttccatcacatgcagcgtgacgggtgcttcgggcttgggcggaaacgcatcgacacggccctgcaccagcgcaaagcgctcggaaccaaaatacttttcgataagcggagccgccgagacgtggtccttgttagtgagcacggcaagctgaacgcctgcggcgcgcaagcggtcgagcatctcgatcgtgccggcatagggagcggtgtggtcttccttgtgctcgccgtagtaagccctaaactcggcaagcgtctgctcaaacatgcggccgtcgcctgcgtactcggcgggcataaagcgctcaaccagcttgagcatgccgtttcccaccttgtagcggtactcgtcaacggcaaacgtgggccagccgtgcgcctcgcaggtatggttgctggcggccgccaggtcctcgagcgtgttgagaatggtgccgtccaggtcaaagatcacatgggaaaaagctgctgccatgggtgctcctgccgcttgagttgtaaaacgcaccccatgatactgggcatgcgtgccgggcatgtttggaatctgaatatctttaatagccctgagcctttgtcgttagcaaatcctcggcagctgttctcccacgagcatgtcgaggatgcgggtcgagccccagccggtgcgcacgcgcacggcgggatgggcgccctcggcaagtggcagcacgcgaccgatgatggcggcattctcgccgtagcgggcggcgcgcatggcgctcagcgcggcatcggcttgctcggccggcacgacggcaaccatcttgccctcatttgccacctgcagcacgtcatagccgagcatctcgcaagccgcctgcacatcgggacgcacgggcacggcattctcgtcgatctccatggcaatgacgctggcctgggcaaactcgttgagtgtggacgccaagccaccgcgcgtggggtcgcgaaagcagcgcgtgtcgggtgctgcggcaagcacatcggcaatcaggtggttgagcggcgcggcgtcgctttcgatcgtgctcgaaaacgccaggccctcgcgttggctcatgatggcgataccgtggtcgcccagtgtgcccgacaccagaatgacgtcgccggggcggcagtttgcgccactgagcgccacgcccgcgggtacctcgcccacgccggcggtattgatgtagacgccgtcggcaccgccacgctcgaccaccttggtgtcgccggtgattatggacacgcccgcctcgcgcgccgtctcggccatggtctgcacgatctgacgcagcttgtccatgggatagccctcttcgaggatgaagccgcacgacaggtagcgcacattggcacccgaggtcgcgacatcgttgacggttccgcacacggcgagtcggccgatattgccgccggggaagaactgcggcgtcaccacaaagctgtcggtcgacatggcgatgcgctcgctcgcgggcagtgcggcgacgccggcatcgttgccctcgagcagctcgggcgacccaaaggcatccaaaaagaccccgtcgatgatgcgtttcatcatctggccgccggagccgtgacccagcaggacggtgctgtcggtaacgctatgggacatatcgaaaactccaatcgtgggtggtgccggtgtgcgggtgcgtccgggctaggcgcggtatcggtagtacgccgcgcagctgccctcggagctcaccatgcaggggccgacgggatgctcgggcgtacaagcgtggccgaacagggggcagtcgctcggcgtaatggccccgcgcagcacgtcgccgcagcggcacccgcgcggctcgactgtcgcctcaacgggcacatcaaagcgagcacgggcgtcaaagcgcgagaactcggggcggatggaaaggcccgagttggcaatcgaccccaatccgcgccatgtggtatcgcacggctcaaatacctgctcgaccagctggcgcgccacgggattgccgtcggcattgacgccgcgacggtaggcgttgtcaatcgccggcctgtcctcgacaaccatctggaccagcatgcagataccctgcaagatgtcgaccggctcaaatcccgtgaccacgcctggagtcttaaactcgtcgaccaaaaagccaaagggggccaagcccgtgatggtggcgacgtggcccggcaggataaagccgtcgatggcggtctcggggtcgttggcgatggcgcgcaacgccggcggcgtggtcttgtgggcgcaatagaccgagaaattcaaaagcccgcgcgcttcggcctccaagatggcggcggcgatggtgggcgttgtggtctcaaagcccacgcccataaaaataaccgggcgatcggggttttgctcggcaatgtcgagtgcatcgagcggggagtacacaatgcgaatgtcacgccctgccgccttttgtgcagcgagcgaggtggacgatccgggcacgcgcatcatgtcgccaaaggtggtgatgatggcgccgtctatgttggcgagcgcgattgcgtggtcgatgtcgcggttggcggtgacgcagacggggcagcccggtccgctcagcagcttgagcccggccggcataatggagcgaaagccatagcggccgatgctcacggtgtgcgtgccgcagacttccataaggttgatggcgcggtcgccgacaagctcatgaatgcgctcgatgagctcgcgagccagcttggaatcgcgaaatgccgaaaagtcgataccggagcgcgccggctgtccggccgccactagtatgcctcggccgggttgctggccagttggtcttcttcggccagttcggtcatggcattaacgagctcgagcgtttcttgcgcttcctgctcgtcgacgatctggatgccaaagccggcgtgtacgagaatatagtcgcctacctgcgccgtcggcacgagtctgagcgacacggggcgctcgatgcccatcatgtcgacggtggccttgaggtcgtcgtcgcgtttgactactttgccgggaacggcaaggcacatattgttccccttttatacgctttgcgctggatgggcgcttaataatccatcagttgatggtagcgctcgcggggttcgcgggcaaacgcgttacgcctgtgagacggctgggcgcggcggcgtgcgagggcgagctactgtgatgcaatctgcgcgaggcgagcgcgtgcgactgccgcctgaccgtaggcgatgcagccgtcattgacgggtacggtgtgggggacaaggacagtagggcctgcgcttttgagctcgcgggtgaggagctgaagcagaagtcggttcatgaacacgccgcctgagagcgcgacggtgtcgatgccctcgtgcacgcagatatcgctggcgatacgcgccgaggagcgcgcgacggcgacatggaagtcgagtgcgagcctgtcggcgggcgctccggcttcaattcctcccaaaagtgcctcaaagagtgctttctggtccagaacataggggccgtccggccacgatgggccagatgcgaaatagccggcgttgtcgtcgggaaaatgggcgatttcgttgtcgagcgcgcgccaggcggcggcctcaagctcgatggcgggttcgccctcgtaggttgccttgtcgcagatgcccagaatcgctgccgcggcatcaaagagacgccccatgctgctggtacgcgggctgttgatgccgcgctcgatcatggtggttgtcacgctgcgcgtttgctcgtcgaggctgtccaaaagccgcgcggcacctgggtgctcgagcaggccgagctcactgagcagggcaaaggcgttgcggcgggcgtcgcgcacggaggccgccccgccggggagcgcccaggtgcgcaaatgcgcggcgcgctcaaagccgccaaggctggcaacaagaaactcgccgccccaaatggtcccatcggtgccggcgccggtgccgtcaaaggcgatgccaaggacacgcgcgtcggttgtaagctggcccgcggcgatggcctcggccattacgctcgcgatatgcgcatgatggtgctgcacctcgacgagcggcagattgcattttcgcgcctgctcgcgcgcccactggcccgatagatagctggggtgtaaatcgcaggccaaggcggcgggcgccaaatcaaagagatcttccaagcgcgtgcgcgcggcgttccaggcatcgaaggtcccgccgttttcaacatcgccgatatgctgcgacacaaaacaggttgcctcgccgttcgtcccttcacgcgtaagcgcaatcgtggccttttgttgtggcccgcaggcgagcacgcaggacggagcgccgtcgagcgccggcaacggcagcggctggggtgcatatccgcgagcgcggcgcacgggcataacggcgccgtcgaccacgcgtactacagagtcgtcgtagcgcgagaggatcgcgcggtcgttaccgagcaacgcgtcggcgatgccggcggcaacgaggtgttcccaggcaagatcgtcatcggtctcgatgggcccttcgctcaggtttccgctggtcatgacgagcgcgtgcataccgtgcgacgcggcagctgcaagcagaagatgctgaagcggggtgtaggggagcataacgccaagctcgggcaggtcgtgcgcgacggacggtgcgagtacgagggcgtcgggagaatcgccgtcgttcccgcaaacagcacgccggcgcagcaacacgatggggcgaatgctgccggccagcaagccgcgctcaacatcgctgacatggcataggcgttcaacgtcagcaaggtcgcgcaccatgacggcaagtggtttgttgctgcggcgtttgcgacggcgtaactcggtcaccgtctgctcgttggcagcgtcacaggatagatggaatccgcccaggcccttgatggcgacgatgccaccgctggccagcagctcaacgcagcgctcgataatggcgtcgctggcctcgcatgtggtgccgacggctggtgtcgcggacgaattcccgcacgcatcgccgttcacagcctcgcgccacgtaatatgcggcccgcaatcaaagcaggcatcgggctgcgcgtgaaaacgccggtcgagcgggtcggcatactccgcggcgcacttgggacacatgggaaaacaatccatcgacgtggccgctcggtcataaggcagcgagcggatgatggtaaagcgtgggccgcagttggtgcagttgataaaggggtagtgatagcgtcggtcggcgggatcgaacaactcgcgcaggcaatcgtcacaggtggcgatatcgggcgagacgagcgtggtgtgcgcggtctggtcctgcgatgctacgatgtgaaaaccctgttcattggcggtatcccaaccgttggctgccaggtccacaacctcgacatactctacgcgggctgccgcaggcgcatgctcagaaagcgcggcaacaaaagcattgagcgcatcggccggagcgtgcgcctcgatatgcacgccgtcgcccgcgttgagcacccagccgcaaatgccatgcaccatggcctcgcgatacacaaacggtcgcatgccaacgccctgtacaatgcccgtcacatgaatatgcacatgccgcatgcgacacccctcatcaaaacctaccaaaaaagacaggtttgttttggtaggtaaaacttctaaacctgccaaaataaacctgtcttttttggtaggtgcgctgcaggaaatcccgctacagccccaggctctgcttggtggcggcgcacgtgagctcgccgtgcttaacgccgcgcaggcccagcaggcggtcggctagttcgtagacgcgctcgccgcgacccttgagcgccagaatctccaagcagttgtggtgatccagatgcacgtgcatggtcgatacgatctcgttggtgtagtcgtgctgcacctcgtccaggcggcgcgtcagatcgccggtgtgatggtcgtagatcatagtgagcgacccgataacctgctcatcgggcgtgcgcatctgctccttggcgatcgaggcgcgaatcaggtcgcgcacggcctcggagcggttggccacgtcgccgcggcgtgcgatctgctcgtcaaaacggcgcagcaggtcgtcgggtgcggtaaccgaaaaacggaccagctcggagccggagccactacaatggcagcccgcgtcaccgtccgccccgtgcggatgctcgtgctcgtacccgcagccgtgctcgtgttcggccacgttacaccagcttcacggagccgacggagttgtggtcggcctcgatggcctcttcgtagccctcgagtgcggcatgggcctcgtgcagcgcggccatggctgcttcgagcttggcgccgatgcgctccatgtcaaaattctcggtcgcatgcagcagctgatggctccactcatgagcgagctcgatggtgtcgtcgacctgtttgacgctcatggcaagctggctcatgttcattccaacatcatgcatgggaaatctccttttgtatggggcagttcagtggttcagattttactacgcccgctctgcgcgcagttacataagaaaacgggtacgagtctgtgcgacccgcacccgttcactgggggctgtttgtgactaccatactatccgcggttgcactcggtgcattcagaagtccggcgagcggcgtaaaagcgctcatggacggcaggcagacggcaacatgtaacaagcatattacagatgcttttccagcagcgcctgcagcctcgccttgggcagagcgccgaccgagcggtcaatttcctcgccgttcttaaagacaatcagcgtggggatgctcatgacgccatatttcatggccaggtcctggttgtcgtcgacgttgcacttggcaacggcaagtttgccagccagctcgtctgccacctcgtcaacgatgggcgagagcgatcggcagggcccgcaccagggcgcccaaaaatcgactagcacgggcaggccgtcgttaacgatggaatcgaagttctcgggggtaatctgcttaatgtcagccatggtgacctccataatgcgacgcggctcagccgcgtaaaactcagtacgaccgtgcttatacccagtggcccgcaaagcaaccactcgcgggcagctcttttatataatggtgggcacgcaaacgattggagagcgcatgcccacgtcacaaagccagaaaaaagaagccatcgcccaggcgaccgagcaggagctcgcatcgctcgcgggtcgtggcgtgcgtatcgcgggcaacgcgtgctcgccgatcgtgctggtcaaaggcgatttggacgaggccgagcgttcgggtggcgagcttgccgccggcccggatggcgcggcgttgcgcaaggcgcttggggccatcggctacgcgcccgaggatttttgcgtgctggcaagcgtcgccggcgtgggtgacggagcggtcgcggtgggcgagactctgccgtgcgagctgttccgtgaggcgcttgaggctttggaccccgaggcggtgctactgctcgacaacaacgcggctgacgccatgcgcgagacctacgccgatatgctcgtggcaatcgatgacttcgacaccgccatgctcaagcccggcttggtcgcccatgtgcagggtcgccgcgtgctcgcgctcgacggttttgaggcggcgctcactgacaaagccgccaagcagcgcatgtgggcatacatcaagcagctgaccccggcggccgctccgctgtagcggattggcgccggtgagcgattgcctggcgggcaagacacgccgcgagatcggcgccgcacttctacatcacagcgcgcagctcaaaccgatcgccgttaatgcggaactggcagttgccgttcatgcgttcgacggcaagcttaatgctcttggttccaaagccgtgtccggtgtgcccggctacgggcatgccgtcgaccatgcgcggcgcgcggtcaaacgtgttggaaactaacagcagcagctggccgtcctctaatcgcaggtcaaagtcgacgaatcgctttccctggggcgcggcgcttgcggcggtgatagcgttttccaaggcatttgagagcacgctaaacaggtcggcgtcacctacgtggatggtttcgggtacggcggcgcgcaagttggcggtaatgccgtttctattgatatccgagttaaatgacgaaagcgcgatgtttacggtctcgttggcgcagaagcggcgtacggcggtgcggtcgccggcttcgcagagttcgtcgatgcgatcgagcgcctcgtcggtgtggccctcttcaattaaagcggccaggccgcgtagaaagtggcgcatgtcgtggcgaagaatcgacagctcgcgcccagattgacgccaagcctcgagctctttgatggcgacgctgtcgcgggtttcgagcatccagcgctctctctcggcggtttccttttcttcgtattcacgcaggtagacggcgaggaacataaggtagaacgcgcagagcgcaaaggccaaaaactcaaccgtcaccaccgagcccgagtggaacagcgtggtgtagacgttggtggcatagtcaaagacgtaatagacgagcggcaggattaaaaggatgcccagctcggtggtgcttttaatcgccaagcgcggaccgatgtcgccggcccaatgcagcaggacggcaaagacggcgagtgtggtcgcgatgcgcgccagatagtacgcgatctgagaatcggttgcggcaaatgcggcgatgcccatccaattgctgaactggcagctcagataggcactcgtaatgccgagcacggcaagcagcgggctcaggcggtagcgcgcgcacaaatagatgacgagcggcagatgcacgacgagcggatatacctggcgggcgaaaagctcgccgccgacggcattggcgatcgaaaaggcagcgccggtcacgacgccgaccagcaccagttcaagcgcatgacgccggttgatctcgataccgcacagcgccgccgaggcaaagacgccaaagagcagcgtcgtggcgtggtggattgcccaaaggatcatttcgaccgaggagaccatcagtgtctcccaccctcaaagcgcgccgcaaagtaggcgtcttggaatccctgcttgcagctgcgcgaaagcgggatgcacgcgcccgagcgcatgatgatgtccgtgcggtcaaagtgatcgatattgcgcaggttgacctggtagctgcggtggcatttaaagaagaccgcgttttgctccaagcggtcctcgacgctgcggaacgactcgagtgcctcgatatcgcgtccgtcgcgcaggtggaagaccacgtgcttgttgcgcgcctcggcatattcgatgtcggacaggcgcagggcgtggtagccaaaggaagttttgatcacgagctcgtcggttgccgccgggcgcatgctcgaaagctcgtcgagcaactgcgccaggcgttcgtaagtcacgggcttgagcagatagtcgaaggcacggacctcgtaggattccagcgcgaactcgggcgacgaggtgaggaacaccaggcgcacggcggtgtcggcctggcgcagttcgcgtgcggtgtccatgccgttgacgagcggcatgatcatatcgagcaagatgatgtcggcgcgcgatgcggcatggcgggccagcaggtcctcgccgcgcgtgacgagcgcaacatcgaccgccgtgcccgtctcggtcgaccaacggtcgatcatccggtgcagtctatctagaaaagcgacatcatcgtcgcaggcaataatcttgagcattcggcccccttaagtagttcgattttgccacatcgggcacgcgccgcttgcgggggtgcggaccgtttgcgcctcacggcgtgcagctcgcgccaagcggtgttgcggtggcgaaagatgcctcctgcgctatcgaaagcccggctatcctcagcttgccagttcgaaaatggacctgccacatgattgaatctttatttcaactttacacctaggtttacagctgtcttgtcagctgtaaacctaggtgtcatactaaagccccaagattcgccaaaagagaggggccttgatggcacagagcgcgaacatggatgcgtcggagcttgcacgcgatatcgcggccggcctggcatcggcaacgacggcaacggagcgtgcggcactggtgcccgcagagctcgtcgaggccattcagcaactaaaaacccaacgtgacgcggtgatcctggcgcactattacgtggcgcccgaggtgcaggctgtggccgattacgtcggcgacagcttctacctggcaaagcttgccaagagtctgccgcagcagactatcgtgctgtgcggcgtggagtttatgggcgagagcgccaagctgctcaaccccaccaagaccgtgctgctgcccgagccgggcgcggactgccccatggcgcacatggtcaagcgcgagacggtcgacgcggcgcgcgccgagtacggcgacgacctggccgtggtgtgctacgtcaactccacggtcgagatcaagagctggagcgacgtgtgcgtcaccagctccaacgccgttaagatcgtgtccgagctgccgcagcagcatattctgttcattcccgaccaaaacctgggacgcttcgtagccgagcaggtgccgcaaaagcacgtcatcctcaacaacggctactgcccgcgccatcacatcatcaccgtcgagcagatcgtcgacgcgacggaggcccaccccgacgcgctcgtgctggcgcatcctgagtgcaaggccgacgttctggccgaggccgactacatcggctccaccgccggcatcatcaagtatgccgaggagtccgacgcgagcgagttcattatcgtgacggtccgcggcgtgctctacgagctcgagcgccgctgccagggcactggcaagaagttctacttccccgcggtgcagcccacctgcgtcaacatggatctcatcacgctcgagaagctcgtgcgctgcctggagacgggcgagggcgaggtgcagatcggcgtctcggacgaggcggcagaccaggccaagctcacgctcgaccgtatgctcgagtacgcagcgcgctagaacaatgttgcatgagggacggtcccttatgtcacattacaagggagaggattcctgtggaaaccaagcaataccccgatatggagtgcgacgtcgttattgccggctgcggcgtggcgggtctgtacgcggccctcaatctgccgacgagcacgcgcgtgatcatgctctccaagggcgcggtcgacgagtgcgattcgatgctcgcgcagggcggcatctgcgtgctgcccgaaggctcggactacgatgccttctttgaggacaccatgcacgccggccattacgagaaccgccgcgagagcgtcgacatcatgatccgctcgagccgctcggtcatcaacgacctgctagcgatgggcgtggattttgagcgcaaggccgacggcagcctcgactttacccgcgagggtgcacacagccgtccgcgcattgccttccatgccgatatcaccggcaaggagatcacgactaagctgcttcaggctgtccgcaagctggacaacgtgcagattttggagcacgtggccatgaccgacatcctgacgggcgagcgtgacggcgacacggtgtgcaccggtatcgtcgccgttcccgtggacgaggacaactcggttcgtcccgccgacgagctggtaaatgccgctgagggcgcgcatgccggcgagccgtttaagatccatgcccgccacacgctgtgggcgacgggtggcattggcggcgtgtacgaccactcgaccaactacccgcagctcacgggcgacgcctgctacatcgctcaggagcatggcattaagatggagcacctggactacgtgcagatccatcccacgggtctgttctcgccgcagccgggtcgcaccttcctgatcagcgagagctgccgcggcgagggcgcgattttgctcaacgccgccggcgagcgttttaccgacgagttgcagccgcgcgacgttgtcgccgccgccatccgcgagcagatgaagcaggatgacaccgagcacgagtggctgagctttgcccccgtcgagcgcgacgtggtgaccgggcactttgccaatatccgcgcgcgctgcctggaggacggccgcgacatcttggacgagcccattcccgttacgcccacgcagcactactttatgggcggcgtgtgggtcgacaaggacggccacacctcgatgcccgagctctacgccgcgggcgagacggcctgcaacggcgttcacggcaagaatcgccttgcatcaaacagcctgctcgaggcgctggtctggggtcgtcgcgccgcgtggtacatgcgtaccggcgagtcgctggccgtggagcaggcgggcgagcccgcgctcgacgggcgtcaccgcgccttgagcgccgacacccttgcaatcgatgatttggcccgtgccgccggcacgcaggccgtggaggagtagaccatgaatcccattaccatgaagctcgtcgtcgatgatctgattctgcaggctctgcgcgaggacattacgtttgaggacgtgagcacggcgagcgtgtgccccacggcgcgccccgccacggtggagcttatcgccaaagccgatggtatcatcgccggcctagacgtgttctcccgcacctttgagctgctggatccgcagagctccgtgttgttcgatgtctcggatggcgacgaggtgcacgccggcgaccatgtgggtcaggtgcgcggcgacgcgcgcgtgttgctttcgggcgagcgcgtggcgctcaactacctgcagcgcatgagcggcatcgctacttacacgcatcggatggcggctgcgctcgagggcaccaagaccgtgcttgtcgacacgcgcaagaccacaccgggcatgcgtgtgtttgaaaaggcggcagtcgagatcggcggtggcagcaaccaccgctataacctgtcgacggctgtcatgctcaaggacaaccacatcgacgccgccggtggcgtgacgcgtgcgatcgagatggcgcgcgcccatgcatcgtttaccacgacggtcgagatcgagtgtgagaacctggacatggtgcgcgaggctgtggaggccggcgccgatatcatcatgttcgacaacatgacccacgacgacatggctgccgcgattgagcttatcgccggccgcgccaagaccgagtgctcgggcaatgtggatgccagcaatatccgcgccctggctgatctgggcgtcgactacattagctcgggggcgttgacgcactctgcgccgattctcgacctctcgcttaagcacctgcgtctgctggacggtaaataatgaacgcccgcgagcgtcgccgtgccatcatggccgtgctcgagggggccaaggggcccgtatcgggcagcgcacttgctcgtgaggtgggtgtgagccgccagattgtcgtgcaagacatcgccctgctgcgcgccgatgggcacgatatcgtggcgaccaaccgtggttatgtgctgcaggaggcccccagcagccccgctgtgcccacgcgcttggtcaaggttcgccacagcgtagagcaggcaggcaatgagctcacgagtatcgtcgacgccggaggcgccgtgctcaacgtgatcgtcaatcaccgcgtgtacggtaagattacggccgacctggacatccgcaatcgtcgcgatgttgagcgctacctgcacgatatcgagagcggcaagagttttccgctactaacggtgacgagcggctatcacttccatcgcatcgcggcggaggacgagcaaaccctcgacgagatcgaggctatgctcaaggagaaaggctaccttgcagacttaatgccctacgaggatgatttgtcctagcccgacaccgtctttataagttgcggtgaaatagttcctacaatcggcacctaagcaatgagccaggaactattccaccgcaactgcccaggcttataggacaaaatgtgtgtcccgatagaacatccgtttctatccattaatcaagccagaacgggtacgggtccctgtggtggaggtcctcccacacggccctgtcgccccactccggccctccgtcctcgcgcgacggcgaggcggagtagacgctgaacaggaagtcgatgtccgcgtcggtcggcatcgcggcgagcttctcgcgcgccgtcctctggattggcaacacctatttggacgattccgggagggacagccccgcctccctgagctcgaggccaatgcgtttgatggcggcttcgtccagaccaatgcttaatttccaaaaggtggattccatttggcacgatcttcgggtttctccacaaatctgaataccaagcgacaatcaacgggtatgcgcccgttgattgttttcagcctgatttcggtgttgctgctcacgttttacatccgcgagggcgaggcagggccgattcatgccgtgcgttcgggcgtaacgacgattacctctccggtgcgctttgtgggctcggctgtggcggctcccttcaatgcgattggcaacgtgttctctaacctaacggcgtcgcaggacacgctcgacgagctcaagaagcaaaatgaggagctgacctctaaggtcgccgagctttctgaggctcaaaagactgccgagcgcctggagggcctggtcgggctgcaatcgacctacaatctcaaatcgaccgcagctcgtatcgttggtgcctccggcgatgcctggacctcgaccgttaccatcgacaagggctctgccgacggccttaccatcaacatgcccgtgacgagttctgccggtgttatcggccagattatcgaggtatcggccaagacctctaccgtgcgcctgattggcgacgagaactcgggcgtgtccgccatggtgcaggacacgcgcgcccagggtatgctgcagggtcaggctgacggcacgctgcgtcttgagtacgtgagcgtcgactccgatgttaaggttggcgatatcatcgtgacctctggcatcggtggcgtgttccccaagggccttccgcttggcaccgtctcgtcggttgagaaatcggcaaacgacgtgtactacaccattgtggtgcgcgctcagaccacggccgagaacaacgaggaagtgctggtcatcacctcgctgaccgacgaacagtcggcctcggatgaggacgtgagcacggccaacagcacgccgcagggaacgtcgcgcgatgctgtgaccaagacgaaggacgagagctcggatgacagttccgacacgtccgagacgacgtaatcgccgccattgtgtgtgtgctgctgcaggcaggcctggcaccgcagatctccattgcgggaggtcgcgtcaacttcatgattatcctggtgtgcctaagcgtgttctcgggcgacccgacccgtgccgtcgtgtgcggtttttgcagcggcttgttttatgacctgtccgctgccgtgccggtgggcgttatgtcgctcctgctgaccgtgggttcttttgccctggtgcacagcgccgtcggtcagacgggcggtaccccgagtgcgcgcggcgtcaccgtgggcgcctttgcgctcgtcattaatgtgatctacagcatcatcttgctgtttatgggtttggagacgagctttgtcgtggcgatcttcggccatgcgctgccgtcctcgatcctgacgggtctggttgccattccgtttttgatgtccggcgtcgtgccgcagtccggctatggattctccgcacgtggcggacgccagacgggtatgcgctttaagcccaagacccgcaagctcaaataggggaggcccgtagatgtcttcccagatgacggttattatcgccggtatcgtgctggttgtggccatcgtggtcgcgctggtcatcatgcgtcgtggcgattcccgttttacctacgatacacagcatggaacggccccgcgcgccaccgagggcgagggcaataccgcggcgaccgcctttaagggccgcttttccatcctcaccacgggtgtgggcgcgatgtttgcggcacttgccgtcaagctgtggggcatgcagatggtctcatcggactattacgagaagcaggccaatagtaatcagactcgcaccgttaccacacccgctgtgcgcggccgcatcctcgaccgcaatggcgtggcgcttgtccagaaccgtccctcacttgctgtcgtggcctaccgcgaccttgccgaggatgaggttctggttcgccatcttgccaacgtgcttggaatgccttatgtggcggtccttcgcaatattcaggacaatacagagggcgctcagagcctgcataccatcgcgacggacgtccgtcgctccacggttgcctatatcaaggaacacgccggcgagttcccgggcgtcaagattgccgagcgtaccgagcgccagtatccatacggcgagacggcatgccatatcttgggctataccggcaccattacctccgagcagctcgaggcccagaataagaaaacctctggcgatgatgatgcttctgctggcaagattacgtaccagtcgggcgatatcgtgggccaggcgggcgttgagagctactacgaaaacctgctgcagggtattcgtggcgagcagaccgtcaaggtcgatgcctcgggcaatgtgaccggtcaggccggcgccgtgcccgcgaaggccggctccgacattaagctcacgctcgaccttaagatccaacaggcctgtgagacggcgctggcgagcgctatcgagcttgccaagaccactggctacagcaatgccggcaacggcgctgtggtgtgtctcgatcccaacaatggcgagatcctgggcatggcgagccagcccaagttcgatccgtccgtctttatcggcggcgtctcaaatgacgtgtggaccgagctcaatgatgacaagggttcgcacccgctgctcaaccgcgccattagcggacagtacatgtcggcctcgaccatcaagccgctctcggcactggccggtcttgagtttggaacctacacttcaacgcagacaaccaactgcacgggttattggacgggtctgggcaaggcttggggcaagcgctgctggctgacgtctggccacggcaccatgacgctgcagtcgggtatcgccaactcgtgcgaccccgtcttctacgacatgggtaaggcgttcttttatgacgagcaacatcccgagggcctgcaggaggtctttcgtcgctggggcctaggcaagacctgcggtatcgatctgccgagtgagggcgcgggtcgtattcccgatgccgagtggaaagagtcatacttcaccgacgcctctgccgaggaccgcaagtggaatgccggcgatatgaccaacattgctatcggccagggcgacatcctggtgacgcccctgcagatggcgtgcgcctatatgggtcttgccaacggcggcaaacagtacgtgcctcacgtatttttgtctgccgtgtcgcgcgatggcgacggcgatgcctataagtacaatggcaagggcaagaagaagcgcctggaggccaagatcaacagcgattcggatttggctcttgttcgcaacggcatgcacgacgtgatttacacggcatcgacgtccctggcggcgcactttggcaccctgacgccgcaggtatacggcaagtcgggcacgggcgagaaaagtggcgaggacgaatacgcgtggttctgcgcctatgcaccggccgatgatcccaagtatgtcatcgctaccgtcctggagcagggcggcggtggctcagataccgcgatgcatgtcgtgcgcgacgtgctcggcgtgatttatgacgagcccgatacctcttcggcctcgggcgattcttcggttcgataggaggttgcgatggatttttctccggcggatctgttccgttcaaccaagaccggctctcgcagcagcctggaccgcgtcaacaagcaactttcggcctcgcgcggcacgtttcgccaaaaggtgcatatcggtgtgctcgtggctactgtggcgctcgtcgcctacggtgccatcattatctggtcggcttcgcagtttaaggccgatgcttcgttctcgcgccatttgctgggaattggcatcggagcggtgctggcggtgctcgtctggcgaaccgacctgcgcggtatttccaatttctcgacggcgttgctcgtcatcgacctgatcgtgatcttctcgcccaagattccgggtctgtcctatacgggcggtctgggcatgacgggctggatcaagattcccggtatcggcttgacgttccagccggttgagcttgccaagctcatcaccatcttctttattgctacgcttggctcgcagtataacggtcgcatcgataccgttcgcgactacgtcaagctctgcggcatgctgtctattccgtttttggccgtcgttgccatgggtgacctgggctcgggcctggtcgtgctggtttcgggcgccatcgtcatctgcatgagcggtgcacgccgcgaatgggtgctgtcgaccctggccctgctcgtgggcctggtggccctcgtcctggcgcttgattcggtctttgattcgttgctcggccacgatgtgctcatcaagcagtatcagatgaaccgtctgacggtctttatcgaccccgataatgccgattcggacgatgcctacaacctgcagcagtcgcttatcgccgttggctcgggcggcttctttggtaagggcctggggcatgcgacgcagtcggccggcggctttctgcctgagttccacaccgacttcgtcttcgccttcctgtccgagacctttggcttttgcggttcctttttgctcctgtgcctctacgtgctgctgatcttttcgacgattcgcgtcgcctttaagtgcgagtcgctgtttttgcgtctttcgtgtgtgggcatcgttggcatgtgggcgttccagactttcgaaaacatcggcatgtgcatcggcatgatgccgattaccggtattccgctaccgtttattagcttcggttcgtcttcgatgatgattcagctgctgacggtgggtatcgtacaatccatatggcggcatcgttcgggcgccgcgtaaccgctggaggggtttgctatgaaaattcccgtagataagctgacccgcgcttttaagatgggcgcgtccgttaagaaggattccgatacgccggtgcgcgtctcggtctatctggattcgtccgcctcgcgctttctggccgagacggtgcgtgacgcctttgtgccgcagacgacctcgggcattgtgcgcgtcgagcgtctgggggaggagcgaattgctccaaagaccgataccgatgtggtgctggtgctctcgtgtggttccgaccgcttggagagtgccgtgcaggagctcgtgatcgccggcgcgcccgtgtgcgtgcttgccgagtctgctgtggaggtgccgtttatcgaggagtccacgcccatgctcggcgtggtggcggcaatcgataagacgtatctgctcgagacgcttgcccgctggattctcgatcgcaccgacaaggaaacggcttttgcggcgaactttgccttcatgcgcatcgcggcggccaaccgtatcatcacctcgtgcgcgctcaccaatatggcgaccggtgcactggtgtttttgccgggcgccgattatcccgttatggcgctggcgcaggtgggcatgctctttgagctcgctgccgtctttggacgcggcattaaacccgagcgtggctacgaggtcgcgggcgtgcttgccggcggtcttgtgatccgcgcggtcacccgcgcgctcgtcaagcagacgccgcatattgggtttgccgtcaaggcgctcactgctgccgcgggcacctatggcatgggccgtgcgctcgtttcgctctacgagcgcgatgtcgactacagccgtgccaatgaggtggtcactgccacgttttcccgcgttcgcgatcttgtgaccacggtcgcgggcgctacccgtcctatggcgtcctaccaggacgcatcagatctcgctgcttaggggttttccgttgcgcgttccgtaccaagattgttttcatttaattgagccgttgctcgccaaggtcgagaagccgagccgctatatcgatcacgagtggggcacgctttccaaggccgatgccgactaccgttgctgcctgatctacccggatgtgtacgaggttggtctgcccaaccagggcatcgccatcctctacaacatccttaaccaggccgagggcatctcctgcgagcgcggctatgtgccgtggcccgatatgggcgacgccatgcgcgaggcgggtattccgctgctatcgctcgagggtgcagcgccggtcgcttcgtttgatatcgtcggtctgcatgtgccgcacgagatggcggtgacgaacttcctcgaggctttggacctcgctggcattccgctgttagcggccgaccgaggtgaagacgacccaatcatcatcgccggcggtccctcggtgtacaaccccgagccgtacgcggccttcttcgatgccatcctcatcggtgagggcgaggaatcgctgctcgagacctgccagctgcatcgccgcctgcgtgacgaaggggtcccgcgcgcgcagattgtcgagcagcttgcatccattgccggcaactacgtgccgtcgctctatgaggttcgtcatgacgagccctgctcgccgcatggctacaccgtgccacgtgagggcaaggatgcgccgaccgtggtctacaagcgcgtcgtcgctcgacgacgcgcttgtcgcagtcgtgcgtgccctatgcgcagctggttcacgaccgcctgtctatcgagatcctgcgcggctgcgcccgcggctgtcgtttttgccaggccggcatgacgtatcgcccggtgcgcgagcgctcggccgaccagatcgtctcgtcggtgattcagggcctggaaaagactggctatgacgaggtgtcgctgacctcgctctccacgaccgaccactcctgcattcgcgacgtgctcggcaggctcaaccgtcgcctggaggatacgggtattcgcgtgtctattccgtcgcagcgcctggattcgtttggcgtggatatggccgagtcggtcgccggcgaaaagaagggcggactaacgttcgcgcccgaggccggcagccagcgcatgcgcgacatcattaacaagaacgtgaccgaggaggacctggaccgtgcggccaaggcggccttcgaggccggttggaaccgcatgaagctctactttatgatgggccttcccggcgagcgcgatgaggacatcgtggccatcgccaatctggccgatcacgtgctggagctcggtcgttccgtggtgcccaaggctcgtcgcggctcgatttcggtgtcgatctcggtttcggtctttatccccaaggctgccacgccgttccagtggtgcccgcagctcgactacgacgacgtcaagcgtcgccagaagctgcttatcacgagcgttcgcaaccgtgccgtccgcgtgcattaccacgatgccgagacctcgctcatcgaggccgcgctttcccgcgccggtcgtgacatgacgcccgtcatcatcgatgcttggcgctcgggctctcgctttgacgcctgggtagagcatttctcgctcgataactggaaggaagctgctgccaaaaacggcatcgacctcaatgagctcgtgcacctgccctacgagttggactggcgcctgccgtgggagcacgtgagccccggctgcacgcgcggcttcctcgagcgcgagtaccgtcgctcgctcgagggcgtcacgactcccgactgtacccgcacgtcgtgcaccggctgcgggatctgccccacgctccacgccaagaatgtattgatgggtgatcgcgcatgagtgagcgcctgaccgacaacccctcgctctttagacttcgtgttcgctatggcaagcgcgatcgccttaagtacctgggccatctcgaagtaatccataccattgagcgcatcgtgcgccgtgcgggacttccctatgccgtcacgcagggcttctctccgcacatgcgcgtgggcttctcttccgcgctgccggtgggtactttatgaccgagttcgtggcgctcgacgaggcgtttgggcgcctggctgcggcgtctccggccgatctggcgcccatcgaggcggcgtacatcgacgtgcgcacgccggcgttgacggcgcagctcacgcgcctgtcgtatcgcatcgacctgcacttggatcccgaggcgcccgtaagcgccgacgaggtgcgtcgtgcgatcgacacgctgcgcgcgggccacggcatcgactacgcgcgcggcaaaaagagcaagcgcttggatttggatcacacgctcgtgggctatgagctcacggcgggggagcgcccggaccatttggtgctcatgctcgacacccatgccgacaacgagggctccatgcgtccggaaattttgctttctgctgctgatgttttgttgcagggcttgaccccgggcgtggatgcacctattgtttccaccggtatgcaagacctcgtgaccatctgctcctacgatgtcgagcgtcagaatcaagcatgcgaggacgacgagggccgactcgtcagccccatacctgtgcgaacttgtggatttgctccacatactcgttgacgggggtattttcgcctgctactatattcggctgttgcactaactgatgcatgaagggcaagtaaacatgtacgcaatcgttaacacgggcggcaagcagtacaaggtcgccaccgacgatgtcatcaccgtcgagaagatcgagggcaatgagggcgacaaggtcaccctgccggttatcttcctcaacgatggtaagaagatcgtcaccgatcccgacaagctggccaaggccaaggttaccgctcagatcgttgagcagttcaagggcgagaagcagctggtcttcaagttccacaagcgcaagcgctatcgtcgtctgaagggtcaccgtcagcagctcaccaagctgaagatcgtgaaggttcaggctacctcccgcgccaagaaggctgtcaaggcagaggctgaggctgttgccgaggctcccgtcgccgagtagattacactcgtaacgaaagagtaggtatacacaatggcacacaaaaaaggactcggttcctcccgtaatggccgtgactcccgcggtcagcgccttggcacgaagcgctatgccggccagacggtaaccacgggcacgattctcgtccgtcagcacggcacgcacatccacccgggtgagaacgttggccgtggtaaggacgacacgctgttcgcgctggtcgacggtaccgttgagttccacaagggtatcaagcacagggtcagcgtacgcccgctcgcgaacgcgtaattcacccttcatagagcacatatgtgggaggcacttgagttttaggattcaagggtctccctcttttttgtaggaggcgattctgttgtcacagttcaccgatatcagccgcattaacgtgtgcggcggcgacggcggagccggatgcatgtcgtttaggcgcgaggcatttgtccccaagggcggccccgatggcggcgacggcggtcgtggcggcaatgtcgtcatccaggccgatgctcagctgtcttcgctgatcgattaccgctttaagcatcactttcgcgccgagcgcggcacgcacgggcagggtgcccgtcgtaacggcaagagcggcgaggacctgattctcaaggtccctatgggtaccgtggtgcgcgagctcgatcccgagacgcagaccccgatgtttgagattgccgacctggtgcacgacggcgagcgcgtcgtcgtggcgcccggcggtgccggcggtctgggcaacacgcactttgtgacgtcggtgcgtcgcgctccggcctttgcccagttgggcgaaccggccgaggagcactggatcgagctcgagatgaagcttatggccgatgccgcgctcgtgggctttccctccgtgggtaagtcatcgctcatcgcgcgcatgagtgccgcccgtcccaagattgctgactacccgtttaccacgctcgtgccgaacctcggcatggtgcgtgccggtgaatattcttacgtcgttgccgacgtccccggtcttatcgaaggcgcgagcgagggtaagggcctgggtcaccagttcctgcgccacattgagcgtacggccctgatcatgcacgtcgtcgacatgacgggtggttttgaggatcgcgatccggtcgaggattaccacatcatcaaccgcgagctcgagcagtatggcgccgagctttcggagcgtccgcagatcgtcgttgccaacaagtgcgatgcgccgggcacggccgacaagattgccgacctcaagcgcgcagcgctcgacgatggacatatgttctttgccgtgtctgccgtgacgggcgccggcctcaacacgctgatgcttgccgtgggcgagcaggtggctaagctgcgcgccgagttggctgtctcggatgagccggtcgttctgcgcgacgatgagtgggagcgccgtcgcctgcagcgtgagaagcgtttccgcattgttcaggaagagcccggtgccttccgcgtggtcggtcgtgccatcgagcgcatggtcatccagaccgactgggaaaacgaggaagccgtcatttacctgcagcataagtttgcgcgtatgggtgttgacgacgcgctcgagaaggccggttgccgtgcgggcgacgaggtccgcatttgccagcgcgcctttgactttgagggcgccgaggacttctcggagtacgaggagctcgaggatgctggcgaggacgttgccgttgaagccattgacgtggccgatgctgcggatgagggagtcgaggttgtcgatgcggcggatgccgcgggcgatgccgagacctcggagggcgagtaagccatgtcgctgcgcggtggaatcggtctgcccgagcttcctctagaggacgggcaggagtttaggctcggcattatgggtggcacctttgatcccatccattacgggcacctggtgaccgccgagcaggcgcgcgagtcgctcgacttggacgctgtgctctttatgccggcgggctctcctgcctttaagcttgacaagccggtgacgcctgccgaggaccgttatgccatgacggtcctcgccaccgccgcgaacccggcctttttggcgagccggttcgagatcgaccgtccgggtgtaacctatacggccgatacgcttcatgcccttcgcgacttttacccgtcgcaggtaaagctctactttattacgggcgccgacgcgattatcgatattgtgacttggcatgatgccgaacgaatcgctgagcttgctacctttattgcggcgacgcgaccgggctttgatatcgatacggcgcgtgcccgaatcaaagagtcggggctgccgttcgacgtgcgctatattcagattccggcgctggcgatcagctcgacgaacattcgcaagcgtgttgcccgtggtatgagcgtgcgctatcttacgagcgagtccgtgctcggctacattcgcaaacgcaggctatatgccgatttgggccaagaagattttgagtgatgggggtctacgttgtcggtagaggatcagtttgagggcgatgagcgcgcgctgctcaagcgcattcaagagctgctcgatgttcgcatgaaggataagcgcaagcgctatgtgcattcgctgggtgttgccgagaccgcacttcatctggccgaggtctacggcgttgaccgctttgatgccgctgccgccggcctgatccatgactgggacaaagtgctctccgacgacgagctggtcacgcgcgctctgcattacggcattaagattgccggctctccttccgccgcgacgccgcttttgcatggcccagttgccgcctatgagcttccgcagctttttcccgggctgtcgccggcggtctttcaggctgtcgaccgtcacaccgtgggagcttgcgacatgacgccgctcgatatggtggtctttgtggccgatgtcatcgagcccaaccgccacggcgactatgcgcatgcgctgcgcaagatggtgggggagtcgacgctcgatgagttgttcttctcctgttttgcgcagggtttggtctatgtgatccagtccgggcgttatctttatcccacggctattacgatttacaaccattacgcccagctacgctagctcgggtgcgtctagaaagaggtattccatggccgacgagaccatgactgacgagcagattctcaaggatgtggagcacaagagcttcgccgccacgtccgaccgcaccgccgcctcgctgtccgcgagcggtgtcgccgccgaggatgtcgcccgcgccgccgcgcaggccgcctacgacaagaagggcgaggacgttcaggtgctcgacctgactgagctttccgatgtgtgcgactactttgtccttgctaccggcaccaacaaccgccaggttgattcgatcgtcgacgagattgaggagaaggtcgccgaggcttgcggcgagcatccgttctccatcgagggccgcgagcagaagacttggatgctcatggactacggttcggttgtcgtccacgtcttcactcccgaagcccgcgacttctaccgcctcgagaaactctggggagacgccccccagctccccctcaacctcctctagtagctcatttgagacggggtttagctaccctcacgcatatcgccgggcaggtgcggtttccgcacctgcccgcctttctttttgcccaaagtagctaatttgggacggggcttttttagctactacctaccgttcgccgatagaagcgagttgcggttcattgcgtgatatttagctttccgactcgggtaacgtatttgttatctgtagaggaggagatgcgtatgactcggaccgcgcgggaaatctctgtttacggctattaccatgtcgtccaaaagggctgtggtggtcagctgatatttgaggatgccgatgatcggatatatttgattcggttgcttgcctcgaaatgccgaaaatacgacgtcaatatcattgcttggtgccttatggacaaccatattcacttgttgctagatgatgaacatgttcacctgagcgattgcatgcactctgttacgactgcatatgcgatgtatttcaacgcgaaaaccggacggaagggaccagtttttcaggatcgatttaagagcgtgccgattcttaacgatgatcagctgctcaactgtgtgagatatattcacgataatcctgcgaaagccaggattgggactgcttcactatatcgttggagcagttttagcgaatatatgggatacccgggtatttgtatgactgaatgtgtgctaggtttgctcggagattctcagagattttttgctttcagtacctcgggagaaccgaatcgatattgcttccgtgacggcgctcatgtgagcgacatagatgcactggagtttgcacaggctctccttaaaccgtatgagcctcaccaccttaaagatttgcctaaagccgtgcgcgacaactacatccgtacgctcaaaaacgagggcttttcgataaagcagatcgtgcgcctcacgggcatcggtcactgcacgattcagaaggtcaagctcgatcagtagctatttgggacagagttttgttgcggcgggcaaaccggacatccggggtagtcaatttgggacggggctattttagctaccctttggctgacggtgaatgaattaggccgaatgaatctcaaccgatatataggggtagctaaaatagccccgtcccaaattgactaccaatgccgtgtcggacggaaggcagcaaccccccccgtccaaaaaagactagttattgaagcgggattggcggccgaaggaaagggcggtgtcgccgaatttgtctcggacggcgtcgatggcgacggagaggtcgcggcggtcgctggattgggctccgcggtcatcgatctcgcagaacaggtcagtctggatgccgccttggtggtcgaagtcgctcatgccgatgcccgctaagcgaacatgcatgccatcctgccagatgttgtcgagcagttcgagtgcaaccgccacgaagatgttctcatcgtcggtcggatgaggcagccggcgctgtgccgtacgcccgctgccatacgaatacttaagcttgagcgttaccgtggcacccgtcagcccctgacggcgcaggcggcgtcccactgactctcccaacagcgcaatcgccgcctcaatatccccacgctcagtcaaatctttcgcaaaggtgcgttcattgctgaccgatttgacctcgcgctcttcatcgagactcgtgacttcggagatttcgagtccttgcgcacgctggcgcatgcgttcgccgttgacgccaaaaatagaggccaaggtggattccggtgcacgtgatagctcgccgagggtgtagatgcgcatgcggcgcagtcgctcctcggccgagcgcccgatgccactcatggcagataccggcagcgcggccaaaaagcgctgctcggttccggggcgcacgatggtcagcccaaacggcttatcccgctcgcttgcgatttttgcgaccgtcttgttgcagcccacgccaatggagcaggtcactcccagccctgccacgcggtcgcttatacgccgcgcaaccagcagcgggtcttcgggcgcaaagcgacccggtgtgatatcgataaaggcttcgtcgatggatacgcgctcgacgcgcggggtctcgtcggcgagaatcgccatgacctgcgcgctcacctcgtaattctgttcctctcgtttccgagctcgcaaagcagttccaggactcttttgtccttttcattcacaagccacttccttccttcatccttgagctgccccgtcatcatgtcggcaagctcgtaccagtcgggagccccagcgtgcagaaggttctcaacgaagaaggagacattcgagttgaatacataaaccgcccccccgagaagggtcagatagtcctcctctggaagggcaaaacgcgtggggtgaatcatttactttcaccgactttctcggcgtagaggttgaagagatgggcgacgatcttctcctcgtccccgccgaagtcgacgccataggcagcctcaacagcagcgtcaagcgccttatgcgcggccatcagctcggggaagaacgtctcattcttgggatcatacatgtccgcaagcgtcgcaccctcctggacgtctcgggcatcgagcacggcttgggcgcagcgttcgacctcgttcctttgctcttcactgggctcgggccagacgaagttgttgtaatcaatattggccgagtactggtaatcgttcttcaaccttccagttacgaccctaacccatgcattatggaactgggattgcaggatgccgtagtgatagagagaggcattaggaatcaatctcaccttgttactacaaaatatctctggcccaacaaagcccattggaacacgttttcttctgcttgaagagacctcagggatgatgatggaacttccctcaggcatgttctcaacatgaaaccttgtcggcttatctgcaattttccgagttccagcgcttttacttgcaagcctgtattcacgaacctgctctattctctttctgcactcaggaagctgctttaaatctgagaaagttgcctccccaagccatagacaccagcggtgatagccatgaatgaactcttttgagccaagccatgggtgaaagaaggcttcggctttgggctctttcttcaggaaatcgtctttctcctcatcagtaaataggtagaagcctccatcaataggtttatttccgatacccatttccggaacatcacaaataggcttgttgcggctatagataaatacatcaggggcgtctttcagatacgcgttgattcgagccatgggaacctgttcttcgtcgctgtccggggtcgcgtggtagaagagcgtcttgttccccgcttcgcgggagaacccgacgatgacgcaaaagacatgcgccttatctgccgcctcgttgtcccacctgaacgtgttgtgcgcaaagtcgatgtggatacccaggtcgtgcaggggtttccagaggttggcgacctgctcaccctggcagatggagttcgtcgagaccagggcgcagcgcgtgcgcttcccctgcgtgaacctcgcggccttcatgtaccaggccccgcagtagtcgatgttgcccgcgtttttcgctccgtcgaagacctcaagcagttcagatttctgctccttggactggttacgagccccgaggaagggaggattgcccacgagataggtgaggtcgtcggggaacacctcggaccaatcgatcttgagagcgttgccctcatggaggttgctgaggctcctgagcggcaggaagtcgaagtcatagtcgacgtatatctcctgcgtcttacgaagcatctgctcctcggtgatccacagggcggtcttggcgaccgaaacggcgaagtcgtttatctcgatgccgtacagctggcccagggagacgcggacgggactgtcttgcgcaacgacgagggacgtctgtcccgcgttgccggtctcctcgctgagctcgtcctcgatgattcgattctcgatggtgcgcagctgccggtatgcctcggtgaggaagttgcccgagccgcacgccgggtcgccgatggtaatggaggcaaccttgtcgtgcagcctcgccagggcctgtttgcgcttcgccgccgtcctctcaccctcggcctcgtgcagctcgtcccacaactcgtcgaggaacagcggcttcaggcagcgctcgatgttctcaacgctcgtgtagtgcatacccccggcatggcgcgtctcgggattcagagtcccctcgaacacgccgccgaagatgacgcccgagatctcgcgccagtcgaagtcctgggaggcgtcggtgatggcctcaaggatttccggggtcatctgcgggacgatgatggaggagtcggcgaacagcccaccgttcacgtaggggaaggccgcaaggtcctcgtccatgtactcgtcccgctgatccaagggagtatcgatggtctcgaacagatcgaccaatttgcgacggagcttcgcggggtctccctcgcagtacctgccgaacgcctgatgcgattgcaggagatcggcgtcctcggcgtaaagtaagaagatgattcgggtgatgagaacgttgagcgagcgctgctcctcctgggcccgctcgtccttctcctcgatgtgatggtactgcttggcgagagcatcatagagcctggagacgtaagccccagcctcgattgaaagctgctgttccttgtgcaggcggctcgtctcgttggatgtcaggaatgagagcaggtacagactgtccgggagctcttcgagggagaactcctgcacggtgtcctcgggcctctcgttgtcgaggtcgtaaaggcggaaggtcccgaagttgcacgtcatcacccagcgcgggcgctcggagtacggcaggtgccgcgcgtaccacatggcctgctggagcggcgtctccatgcccccgttcctaggctcgggcttgtcgaggtcgatgccccacgacttctgctcgcagaggaagttgtggtcggagacgaacacgtcgatgcgtcggcctctcaccttgcgctcaaagtcgacgaagctgtctatggtgttggacgggatacccaggacattgatgagcaagtcgacccaaaacttctgcgtgtcctgctgctcattgttggagcccgcggggatggcgctgaggcgcttcttccaccgctttacgaactcctttgcctctttcttgctggcaggcataccggacctcctgcgtcgttgtctcttgcggaccattttaaggggtaagggcaaccttgcggatagaggggcgagttttcaacggtccccggtgtcggagggtccccagtaaaacccggagacgccggggactgttggaaactcgcccgctcacgacaacatcgacctaggttttcaacgctttccatagccggagggcttctataagcccgtaagctgtggaaaaggttggaaaccgaatattgggcttagacctccacaaaaaatctttctacccaatttctacccaaatgccgctaataagacccttatacaagaagacaggccagacgttttataccgtctgacctgcaatttcttctggtgcccccgggcggattcgaaccgtcgacacccgctttaggagagcggtgctctatcccctgagctacggaggcatgttgtactagtgtagcagatttacgccgttgtaatacagcgtatagccactcttcgaagttgcgatggaacagccctccggaaagtgtgtcccactatccaggcaaattctgggtcaaactttcccaatgggacctcgctggaaactgtgtcccagaatttcggctcgaaacgggacacagtttcccaaacgaccccgttccggaaactacatcccggaatcggcgctcgaactgggatgcactttcccgatcgagccccatgggaaactgcgtcccacttggggggcgctctttaatgactagttgcctttgtggaagaggtttttgataacggaggggatgctcttggcgcccttggccgtcacatcgataaagtcgggcgaacgcacaagcttatcctcgtcgacgtacttgcggaccgcgcgcaacgtctctttgtcgtcgcgcgtcgaaaacgtaaagtgaccgttgtccttggtgaagatggcaaaacgcgtgatcttcttggtgccgcgtaaaacctcggcggcaatatagtcgacctcgtcccacgggatttgaatataatcctcgggattgcgctcgttgtaatactcgaacgccttattgcccaccatcacgttaccgtggctggtaagccccatcaggcaggttgccggcgttgccagatcgaccgtgctgttctgagattgcgccatgcgcgcctcgccctccaaataaaacaatcggaccgcatccagtgtacccaccgggtgcggtccgtttcaatggctcaaaagcccttgcctagcaattctcggtcttaagccgaagcgtgcttacatgaagccgcagaagcgaccgatgatgccgacggcgaagagagccaggatgatgacgatcgggctgaccttcttcttgaggagcttgcagaccagcagggtcaggcacacggcggcaaggccggggatgagctgatcgaggttaccctggagcgtggtgaccttcatctgatcaagggcggtagcaccgacggagttgtacatcgtcagcgcttccttgataccctcggaaccggaaggcaggctagcccagtcgataaaggcgccagcagactgcttgaccgtggagacgatcggggtgaaggaaatggacacccagcgctcgaccagggcgccgatgatgaacatacccaggatggaagcgccctcggtgaccttgcccatcagaccgccggagaggtccttggcgatagaggagccgaccttgtagccaaactcctgtgtgtaccacaggaaagcgtaacggatgatgttccacgcgaagaagaacagcaacggaccgacgatgctgccggacatggccagggaagcgcccagagcgcccagaatcgggcgaagggtgaaccagaagacggggtcaccgacgccggcgagcgggcccatcataccgaccttgacgccctggatggcgacatcatcgatcggagcaccgttggcgcgctcctcctcgagggcgagggtaacgccaatgacgggggcggaaacataggggtgggtgttatagaactccaggtggcgcttaagcgcggcaatctggtcatccttgctggtgtagagcttcttgatcgcagggatcattgcgaagcaccagccgccgttctgcatacgctcgtagttccacgagccctgaaggaactgatgacggaagcaaaccttcttacggtcagccttggtgagctgaatcttgttctctgccatatgtatcactcccctcctactcgtaatcgttcagaatgtcgccgagcgggtcgccggagccaccgcccgtgccgccaccctgcttggccagatccttaaggccaaggtagatgagggcaagggagatgccgatgaggccaagggcgatcagcgtgagctgagggatggcagcaaggacaaagccgaggatgaagaacggccaggtctccttggtggccatcatgttgatgaccatggcgtaaccgacggaagcgaccatgccgccgccgacggccatgccgccggacagccagtcgggcatagcgttaagcgcgttggtaacagcctcggccgggataacgcacagaagtactgccgggatggcgatacgaaggccctgcatgaggatggcagcgtactgccagcgctcgatgccggagaagtcgcccttctcggcgcaaccgtccatggcgtgagcgatagcggtagcaatggtacggcagatcatggtcaggaacagaccagcgaccgacagcgggacggcgacggcgatggccgcggtaacggccttggccgaatcagtggcgccgccgttgagggcgagcaccatgatgatcgaagaagcgaccgaggccagagcggcgtcaggcgcgacggcggcgccgacgttagcccagccaagggccatcatctggagcgaaccgcccaggaggatgccctcctgaaggtgaccggttacgagaccgataagcgtgcatgccacgagcggctgatggaactggaactcatccagaatgccttccataccggcaagcaacgcgacaatcgcaacaagcagaatagtgattgcagacatgtatcggaccctcctttactatgcttgagcggccagttcggccttagctttcttcaacatggcgtcgagatcctcggaggcatccgaaggaaccttgcggacctcgaacttgacgcccttggccttgagggcctcgagggtcttaacgtcgtcatcgcccatagcgacggcgttggtgacgacgaccttgcccttggagtgagccatggaaccgatgttgacttccttgatgtcgacgccggcctcgatggccttgagcagatcctgcgggttctcgaagagcagcatggccttggtgtcaccaaaacgcgtgtccttgacgacctcggccatcttcttgataggcacgacgttggcatggactcccggaggggcagcctgctcgatcatggtcttgcggagctcgtcgtgagcaacgccgtcggaaaccacgatgatgcggttggggttgatctgcttggtccacgtggtggccacctggccatgcagcagacgggtgtcgatacggacgtgggcaatcttgatgtgcccgtcgccgatgaccgttcccggagggatggcgcctgcaggagcagcggcggccgcagccggcttcttctcctcgggctccagagactcgggcttgacgcgcacgccagccttagcctcagtcacgagatgttttgcgatcgcatgtgcagtgttctttgcatcaaagcgctgcgaatatgcctcgatgagcataggcaggttgacaccggtgacgatagcccaggaatcatggccctcgatgagcccgctaatctggttgaacggcgtgccgccccacagatcaacgaggaagagcacctgctcctggtcctcgaaggaagcgattgcttcctcgaccttagcacggaagtcgtcggggcccatgctcggctcgagcgagaccacggccacagacggctgatcgccaaagaccatcgagcccgtctgcttgattccagctgccaagtccccgtggctagcaagaacaatacttaccatcacataacctcctttttgtctacgtaattcctacacgacatgaaaggagtatacctgtttggtttgtggaattatagctaaattcgtaaaaggttgcattatttgtttaaacgtctatttttgttacaagttgattacattactgcttttcgactcattacccgccaaagcgtcgcccatcaagccatgtactttacagatacaaacaggctgttcattaataacgattttaagcaagtgcgaatgtgcttgtactgctgctattttgtttaaacagacatgacttgactatttgtatgacttatgcacttcgaaactactcaaaaaaaattgcggtggaatagttcttgtttaagagccagaaggctggttttaggaactatttcaccgcaacttatagaggatcctaggcgatgtggagagggttggcggcgtcgacagcatcggggacgtcggagaggccgtcaggagcagcatctgccgggtcctcgtcgggggtctcgatctgcttgatcatgacctcttggccctggagcagataggtatcgccgctaccgcaatggggacaggtcttaccatgctcgaccgtcgcatagtcgtggccgcacgcctcgcaatgcgtcacggcgttgactggctccacgataagctccgcgccctcggtgataggctttttatctgccgcccagcgccaagcgtcgagtagtagatcgggaacgacgcccgagacctcgcccagcagtaacgtcacgctcgaaacgtgacgcacgccattggcgcgcgccacgttctcaacatcgcgaatgatgtgatagacgattcccaattcatgcaaggtagaaacctttcaacaacggttgatgcgatgtcggccagacgtcagtgagcgacgctctgcgccgctcccttactcgttacgtcctgttatttcttcccgaatttgatcttaatcgcacgctttagagcatacttgcccaggcttgggagcttttgctcgtatttgaccatcgtggagcactcggggcggtcgcgatacagatggatagcgtcaaacgcgcacttggtggtgcacaggccgcagccgatgcacttgttggggtcgacgatcgaggcgccgcagcccaggcagcgggcggtctcggcgcgcacctgctcctcggtaaaggtctcaacatactcgctaaacggtgcagccttctcgcgttcgcggtccacatgcgcaacctcgcggctcgcgttgtcgtagctctcgatcacgacatcgtcgcggtcgagcgcggtgtagcggcgctggttgcggccgatggtgagcgtggagcccggctgcacaaagcgatggatggacaccgcggcctcgtgaccggcggcgatagcgtcgatggcaaagctggggccggtgtagacgtcgccgcccacaaagatgtcgggttcggcggtctggtaagtctggggatcggcaagggcaccctggccgcggccgagctccaccttggagccagccagcaggtcgccccacacaatggactggccaatcgacatgacgacacggtcggcatcgacacggcgcagatcgttctcgtcgtactcgggcgcaaaacggccctcgtcgtcaaagacacgcgtgcagcgcttgaaggtgataccgcatacacgaccggcctcgtccaggtgaatctccttggggccccagccgcagctgatgtgagcgccgtcctcaacggcctcgcgacgttcctcctcgctggcgggcatctgggcctcgctctccaggcagaacatctcaacgtgctcggaacccagacggcaggcgttgcgcgcgacatcgatagccacgttgccgccgcccaccacaatggtgcggccgggcaacgcgtcgatcttgccactgttgacctcgcgcaaaaagtcgacggccacggtcacgtccacggcatcctcgcccggaataccggcaaggcggccgccctggcagccaatagcaacgtagaaggccttaaagccctgctcgcgcagctcgtcgagcgtcacgtcgcgaccgacctccacgccatagcggaactcggcacccatcaggcgaatgatctcgacctcggcctcgataacatccttctgcagcttaaagctgggaatgccataggtgagcatgccacccgggcgctcgttcttctcgaacacgacgggcttgtagcccttctcggccagatagaaggcgcaggacaggccggccggaccggcaccgatgatggcgatcttctgatcaaagccgccagcgcgcgtcggcgtaaccacgggcgggacgtagcgggtcgcggcatccagatcgcgctgggcgatgaacttcttgacctcgtcgatagccacggcggcatccacacggccgcgggtgcgggcatcctcacagcggcggttgcacacacggccgcagatagcgggcagcgggttctcgcgcttaatgagtgctagggcctcgtcatagcgaccctgagccgcgagcttcaaatagccctgaacggcaacgtgcgcggggcaggccgtcttgcagggagcggtgccggactcatgcgtctcgatacggttgtcgttgcggtagttgggcgaccacttggtgtgatcccatttggtggcgtcgggcagctcctggcgcggatactcgggcacctgtccgccggcctttttgctgcagagcttctggccgagcttggcggcgccggccgggcacacctcaacgcagcgaccgcaggcaacgcacttgtccttctcgaccttggcgacataggccgagcgcgacaggttgggcgtgttgaacagctgcgaggtgcgcagggcgtagcacacgttgacgttgcagttgcagatggcgaagatcttgttctcgccgtcgatgttggtgatctggtgcacaaagccgttgtcctcggcctggcgcaggatgtcgtagacctcgtcgcgggtcacgtaatggccacgatcggtctcgaccacgtagtcggccatatcgcccacggcgatgcaccaatcggccgggtcgtcggcgcagccctcacccatcacgcgacggctcgcgcggcagctgcaggtgctagcggcatacttaccctcgtatttgtcgagccagtgctcaatatgctcaataggcaccgacgtgctcgcggcgtcaatggccttctcgaccggaatgacgtgcatgccgataccggcgcctccgggcggcaccatcggtgtggccttggacagcgggcccttggatgcctgttcaaagaacttggcgtagaccgggtgctcctcgagctggctcacgcgcatgttgaggaactcggcggaacccggcaccagcatgggcagcacccattgcttggcgcgctcgggattttcccagttgtactcgagcaggcccgtgtagctcatatcgtcgagcatcttctcgatctgggcctcgggcatgccggtgagcttgaccatctcgggcagcgtgtagggacgacgcatcttcatcttgcagagtacctcggcctgctcgtcagttgcggcctcggcaaacgaccagtactcgtagcccagcagctcgtcgcgatgcagcaggcggttagtgcagtgctcgcacagtttgacgatggcctcgcgcggatgctccggcagcggcggcacaaactccgcaccgatatcgggctcggtgtagctaatccccggtccgttgagaatcatagtcgtcccttctcttgccgcagcctggcaggcacgcagcgcccctctttttacgggctcgacatgcccccacgccgttcacccgttattgttgacattgtgtcaaaaacagtattgacgaaccgtcaacaatattcaagactgttaggcgaacggtcaggctcaaacggatgaaaggcggcaagcacatgagcagtaacgcagcgaacacctctgtggccgacgccgtccccgcgcccgacagcacggcaaagcgcttgacgggcgacgaacgccgtcgcgagatcctcgatgccgtgcgcaccgtaagctccgagctgggcgtgtcccacctatcggtatcggccgtgaccaagcgagccggctgcacgcgctcgctgttctaccactacttcgccgacatggacgccgccgtcaccgccgtcatggacgaggcaatcgacggttttatctccgagctcgagcagtggaatgccaaccgcaccgtcggcgatatcgagggcgcactcgacaccgtcgccccgctctttaagcgcctggtcgccagcggccacgagctgccgagtacgctcacctccagcagcggtgcgctctacggcggctttctgcacaacgtggtccaacgcgtggcgcagtatatctgcgacaccaccgtggtggattttgtcgcccatcatgagctacgcatcgaccatgtctacgagacgttctacaccctcatcatggggttgttgatgtatatccgcacgcaccccgatgtgcccgacgagacggtcaaggaaatcatcgcctcgacactccacatcgagggctataccgccaagtatccggagcgcaagccccagaactgacgacatttggccaaactgcccgcgatcagaagaggggccgcgggcgtgtgaaaggagagcagcatgctgttcgatgtttggggtagcgatacccttatccactgggccggctgggccatggtctttatcggcctgatcgtgctcaacgaggtcggccgccgcaccaagctgggcgcagcaatcatctttggcgtggctccgctggccatgaccatctactgcgtcgccatcgccatcggcgtctcacagggtgccgagtgggcgctcaccaaccccacccatgtgtaccagaacagctggttccactacgccaaggtatacgcggcgctcgccggttgctggggcttcattgccattaagtaccagtggggcaagatcggcaaggcgcattggttccgcgcatggccgtttgtgatcgtcgccatcaacatcatgatcgccgtcgtgtccgacttcgagagcgcctatcacttctttgtcctgggccagtccacttgggtcacctccgagggtgccacgcagcttgccggctggaacaacgtgttcaacggcatcgccggcatcatcaacatcttctgcatgaccggttggtggagcgtctacgcctccgaggatcagaccgatatgctgtggcccgacatgacctgggtctacatcatcgcctacgatatctggaacttctgctacacctacaactgcctgcccacccactcctggttctgcggctttgcgctgctgctggcgcccaccatcgccgcctttatctggaacaagggcggctggatccagaaccgcgccttcacgctggccatttggtgcatgtttgcccaggtgttcccgtacttccaggaggagtccatctttgtgacccactccacgctcgaccccggcgccgctaccgcggtctcgatcgccgcactggtcgccaacgtcgccgcgatcatctacatcgcctaccgcgccaagaagctcggtcgcaatccctacaagcaggatgtctttgagggcaccagcgattgggagaaggccaccgctcgtcgcgccaaggtcgattacgctcacgccgagtaacatgttggtcgctgttggcgcctgggcataggcccgcccgccaggtttttcatccaatgcctcgcagagcccccggaaagcgtttcgctcgcttttcgggggcttttgtcgttgcgtctctattcatctattcaaaaacatgcgcatatataaaatcggatttcaaatcatgaggcggctctatggggtcccgtttttgggtacagtgttgtcccgatattgagcttgggggatgtatgaatgatgagacgatgggccaagaggatgcggcccaagatgcagaagcgtgtgccgaggccctggagagcctagaccggatttcgcttgacgatgttgcgtttgacgattcgagcgttgatgtgcaggatgagccggaagccgaggcgcagtccgatgatcaggatgcagacgacgttgagcctgccgaagatgaggcagatcacgaagacaccgaatgcgaggccgacgaccagcccgaatccgacacgagcgaggaaaccatcttgctcgacagcttgccggccgaagattcgctgacccgcgagcttcccggcctgggctccgctcctgccgtggacgagaccatcgccatgggcgatattcccctgccgtccgttccctcggcacgcgaggccgaggtccgccatcgcaagatgtcgcccaagcgccgcaatctgatggtcgccggtgtcgtggccgtcgcgctcgtcgccggcggtgcaggctatgctgcctggaacggatatcagcaagagcaggctgccgctgtcgccgccaatgcccacacgatgatgtcggtgcagattggcgcgcatgccgcgggcctcgactgttccactggctccaagattcccgtacaggtgagcggtcaggattctgacggctcctccgtgagcgaaacgctctatgttgacgagcacggccgcggcatcaaactgctgcccggcgattacacgctctccatcgctgcctcccccatcgcggccgacggcaccatctataccgtcccgaccaccaagacgcaggtcaccgttaagagcgatggacaggatttaagtgcccaggccacctttaagctcaaggtgccttcggccgacacagtgactgacgaccagatcgatgccgccgccaagtatgccgaagagggcggtgcgagctccgccgcggctgccaaagtgctccagcaggcagcaatcgcgcggcgcgacgccgccgtcaatgccgtgagcgcgcaaaaggcacaggcatcccgtgatgctgacgctcgccacaaggcaactgacctctaccagctcgatattcccgtcgagtggtacggcaaggtcgagacttggcagaatggcagcacgctatgcatctatctgggcgacgacgccaatacgccgctcgtgacgctcgtcgccgtgcgcgatggcgagacctttacgcccgatgacggcgatacggttttgggcacggtcagcctaggcaacggttataccgtctatgccagcggccccgtctatccgcacgtggtgccccagactatcaacgggcgcacccagaatcccgtgtcaacctaccccatggacacggccattgagcttgtcgagctgacgaccggcaaccgctatacgtatagccagatcaagaacgacctggttggcaaagacggcaacgcagacgccgccaccaaactcgagaccgactacctcgcccagattctgatgccgagtatcaaagcccaggactagccggcccgaagacagccgcctaacgcagttgcggtgaaatagggattgtttgggggtgcggacgatttcttggaccgcgcctaggcgtatccaagcttcctgcggcatgcgaacctccagtccggaccgcttcacggtccaactttctgtccgcaccccctttttgctggtcaaaccgcaaaacagtccctatttcaccgcaacttattggtggccttttgggtggcacttagcgccaggggtcggcttcgaacatcggctcgcgctcggggcggcgatcgctgtagggatcgtagccgtcatcgtcctcgttctcggcacggatgtaggggtcgcgcggcttgggcgccggtttgggagaagccttcggtgcgaccggcgcggtgggcgctgcctcagcaaccggtgcgtgcgtcttgttctcgtctttcatctgcatatctccttgccatgtactcatgctcaacatcatcgattgtcgcacgaaaaagggcggcggacccgattggatccgccgcccttggcgttttgcgatgaggtgcggttaaagccggccccataatttactctgcgtcggggacctcgtaggtggccgccggcgtgttgtcgcacacgacggtaaagccaccgtccttgtcgacatcgaccgtcacctgatcgccctcgcgcaccgtgccgtcgatgatagcggcggcgatggcatccacgacctcgcgctgaaccagacgcttgagcggacgggcgccaaagaccgggtccaggccgcccacggcgagcatctgcttggccgccggggtgatggcaagcgtcatgcgctccttggccagacgcgcgcggacgtcggcgagctggatgtcgacgatcttctcgatctgcgccataccgagcggatggaacaccacgatatcgtcgatacggttgaggaactcggggcggaaggtctgagccatggccgcgtcgacctgatggcgcatctcctcctcgtccttgccggaaagctcggcgatagccttggagcccacgttagacgtcatgatgatgatcgtgttcttgaaggacacctgacgaccctggccatcggtcagacggccgtcgtcgagcacctgcaacagcacgttgaagacatcaggatgagccttctccatctcgtcgagcaagattacggagtacgggcgacggcgcacggcctcggtgagctggccgccctcgtcgtagcccacgtatcccgggggcgcaccgatcagacgctggacgctgaacttctccatgtattcggacatgtcgatacgcacgagcgcgcgctcgtcatcgaacaggcactcggccagcgccttggcgagctcggtcttgcccacgccggtgggacccaggaagaagaagcttccgatgggcttgtccggatcggagaggcccgcacggctgcggcgcacagctgcggcgacggcggagacggcctcgtcctggccgatgacgcgcttatgcagctcgccctccaagcccttgagcttgtcgagttcgccctgcatcatcttggacacgggcacgccggtccaggcgctcacgacctcggcgatctcatcggaggtcacctgttcgttgaggccctcgccgtcctgctgcttttgcgcctcgagcgcggcctcggaatcctgaatctgctgctgcaggcccggaatcacggagtagcgcagctcggacgcacgacccaaatcgccattgcgcgtcgcgcgctcctcttcgctcttggcctcgtcgagctgccccttgagctcttgcacgtggtcgatggcgttcttctggttgagccagccggccttttgcacgttaagcttttcctggacctcggcaatctcctggcgcagggcctccagacgctccttggaggcgtcatcggtctctttcatgagcgcctgttcctcgatctgcagctgggtgagctgacgcgtggtggcgtcgatctcgaccggcatgctgtcgagttccatgcgcaggcggctcgcggcctcatcgaccaggtcgatggccttgtcgggcaggaagcggtcggcgatgtagcgatcggagaggtcggcggcggccacgagcgcgctatcggtgatgtgcacgccgtggaagatctcgtacttctccttgagaccacgcaggatcgagatggtgtcctcgacggtaggctcgctcaccataacggtctggaaacgacgcgcgagcgccgcatccttctcgatgtacttgcggtattcgtcgagcgtggtcgcgccgatcgcgtgcaggtcgccacgggcgagcgccggcttgaggatgttgccggcgtccatagaaccctcggtggcacccgcgcccacgatagtgtggagctcatcgatgaacaggatgaccttgccctcggacttctgcacctccttgagcacggcctttaagcggtcctcgaactcgccgcggtacttggcgccggcgaccagcgcgctcatgtcgagctcgataaggtcgcggtcgcgcagggtgctcggcacgtcgccggccacgatacgctgggcgatgccctcgacgatggccgtcttgccgacgcccggctcgccgatgagcacagggttattcttggtgcggcgggacaggacctgaatggtacggcggatctcgtcggtacggccgatgaccgggtcgagcttgccggcgcgggcgagatcacagatgttgcgaccgtactgctccagcgcctcaaactgggttttgtcctcggcagatgtcacgcggtcatcgccacgcagctcctcgtagacttgctcgatgcgctccttggtcacgccggcgtcgcgcagcacgcggcccgcctcgcccttgtcctcggcaagtgccatgagcagatgctcggtcaccacaaagctgtcgcccatcttggtggccttcttctcggccttttcgatgacgcggacgagctcgttggaaagacccatctgctggccctcgccggaaaccttgggcgcatggtcgatggcatcctgcgtggagcgtgcgagctgggcagggtcggcaccgatgcgctcgatgatcacggagatgttgcgctcgccggcaccgagcagggcagacagcagatgaatcggctccaccgcgccagcctgcgcgtcggcagccgtgctcatggcggtctgcaacgcctcgcgcgacgtcattgctagcttatcgattctcatggaatcacctctcttggggcggccgccctacggggcggcttcacgttgttcgagaagtattgttgccagctttgcgcgttcttatacacaaatctaagtctctatatataagattttctgagtgattgaaggatagggtactgagacgccgacccactgcatccccgacgaccaaccgtctcgatctgtaacatctagcagccgtttttgggtccagatgttacagatcgagatgaaatgatcggcagcgcccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagccgtttttgggtccagatgttacagatcgagatgaaatgatcggcagcgcccgtttgtctaaatctgtaacaactactcggcaaataagggtccatctgttacagatcgagataaacagaagacacccgaatcgataatctaaatctgtaacaccaagcccacttttaacggcccagatgttacagatcgagacagactgaaaaccaccgcaaaggggcacctttgtggtggtcgcgttctctactcttttgacgagcccgtgcttcccgattcggcgttccagggcatctcatcctcgaatagccatgtacgagcagacccactatcgcgtgcagcctgcaggtcgggcaagcaggtctgttcataggcatcctgaatgcactgacccataaactcgttgagctcggtctggtcgccctccatgacataggccacatcgccgtccatgatgtagatgcccggaccctcattgccctcgtaacccggatcgtacgagacatcacatagctttgcgccgttcgcggtatccagctcgatggaagagtggcatccgccaaccatgtcgttcgcttttgcccgataggacgcatatccgtaccaacgcttaaaggttttgcctttgagcagctcggttgctttgctgattaggctcgcgtccatggtgtagcgcatggccccaagctgaatgcgcggataattgctaatgcccagcgctgccggtttctcatcaaaatcaacagtaatggtctcgggtttttcgtcgccggtcagaagttcgactgattgagtcacaggcttaaccaccggctccgtcaccgcagcaggcagaaatgccataccgacaacgcccacaccaaccacggcgatcgcaagcgccagagcaatcaatccaatacgggcagagcgactcacagcaaaacacctcgcaatgcagatctgcgtcatttgccctaatgataccgtcagctaacactatcaccaaaagaagccgctcgctccccaccaccacaaaggagacaggcacctttgtggtgggtttcgacgctaacggtcgaccatctcacgccatgagattaaacttaatttgttatctgaatttatctatttctatctatcctcaacagctttttgtttcggggagatcatatgaagccgtctcattccaccggtcgcaacgtcatcgccattctcgccgtacccatcgtgatgctcttccttatcgtcatcacgcccttttctctcggtatcgcctcgcccttcgatttgtgcgggatggtcgacgccggctcgcgtgccacctcgctctcctttatctgccgcggcgtgttttacgaagatagaattcccaccggattttggcagtcaaagttgccactgctcagtcagatcgacggatgctccccccatttctgccttgaacctcaggcgctaaactatctgatcgacgaccagccactcgactccatcaccctcgcctacgactacgcaccaaacaccgatgagcgccacatgaaccaagtcctcgacaagatgcttggacagtgcgggctcaccgaggaggacggtcgaaccatctatagcaaccagaaattaaagcgaacagaactccgccgtgtcggaaaaatcgaagggcgaagtggggccgcctactggcaggcctgggcaacacgcgacaagagcgaattcggacacagcacctatatggtcaccgtctacaccaaagacggaattaaggacaatgttgacgatttcgcgtcgtccaaactcggcatccccaaaacaaccaaacccgccaccccagatgaaatcctgtagagacattcattaaaatgctgcccagcgatcacaataacatcgagcccgcccaccaccaccacaaaggggacaggcacctttgtggtgattttcgactccggcgctcatctgtctcgatctgtaacatctagcggccgtttttgggtccagatgttacagatcgagatgaaatgatcggcagcgcccgtttgtctaaatctgtaacaactactcggcaaataagggtccatctgttacagatcgagataaacagaagacacccgaatcgataatctaaatctgcaacaccaagcccacttttaacggcccagatgttacagatcgagacagactgaaaaccaccgcaaaggggcacctttgtggtggtcgcgttctctactcttttgacgagcccgtgcttcccgattcggcgttccagggcatctcatcctcgaatagccatgtacgagcagacccactatcgcgtgcagcctgcaggtcgggcaggcaggtctggtcgtacgcgtccatcacgcaacgatccaaaaaatcgatcacctgctgctggtcgccttcaagaatgtaggtcacgccgccatcttggatatagacgccgtccccacctccggcttttgcgtattccggattgtagttaacggtgcgcatcagtttgccatcagatgaatacaacttcagcgttgtatagtagccaccgttcacagaaccacgtcggcgctcataggcatcccaaccgtcccagcgtttgaacgaacgcccgtttagcaagtccagcgcctgtcgggacaacttctcgtccttggtatagcgagacgagccaagttcaatcatggggtagttgcttatgcttagaatgcccggcgtttcctcgatatcgagcgttatctcatcgggctttgtaacgtccgaaatcatttgcccgggcatcgatgcaacaagggacgccatctcaaccgtctgctcaaccccactcggcccatagaagataagcgagccaaataggaccacgcccgcagcagcgacgacgcaagccaccaacagcaacaaaacagaagtgcaacgcttcatcttcaactccacaaacgagagtgttttgagctcactttaaagcgccaacttcatactgtcaattctagatagcatatgaacaaaggcgcactcccccatagaggagagttgcaacctcgattttagcgccctcaagacccaacgagcagcacttaacaagtagccccggttatacctttctctgacgcgaccctcgcgaagcgcgtgagcggcagggaaaggtataaccggggcggacaagtatgtgcgttactcggcagcggccttgaacttgttgtagttgatcaggcagccggccttgacgatggcacgctcctctgccgtcatatcggcaatgtagagctcaatctgctcgaccgcaccatcggcgcgaaccacgtaagcggcgatgtccttcaggtcgccgtcgagcgcggcgcggatacccggcacaaagacgtagtcgcccacctcaaagctgggctcggcctccatctggaagggcaccatgccccagttcatcacgttggagcgatagcgcttggtggcgtactcgtggacgatgttggccaggccgccaattacgcgctggcagctcgcggcctgctcgcgggcagaaccgtcaccgggcttcttggcatagagcatggagccgtactcagtcgccttggcatcggccgcgacacccgcgccggtcagcgcctcaaacacgctggcaagctcggcatcgagtgccaccaggtcgcccgctgcctcgccggcaatgcggcgcttttccaccgcgtcgacctccttggagcggcccacgtaggcagggtcgcgacggctgagcgtaaactcggccagacccagcgggttggagcggaaggagctcgtctcgcccgagggaatgagctcgtcggtcgtagtgaccgggtccatgatcttggagcacaccttgagcaggatgtcgtcgccgagaggctccatcgcgggccacggcttgatgttggggccctcgaccagctcgtcggccggctcagccttgccaaagccccagtacacgcgcttcttgtacggcgcgtcgtcaaaggtgtactcgcaggcctcgtcccaagtctcctcgggcaggtcggtcgccggcgtcaggacgccgccgttggcagccgtcgccgcaatggagcgggcgtccatcagggccacggcgctcagctgaccgttgcccggcttggaaccctcgcgattggggaagttgcgcgtggtgtggcggatcgaaaggccgttgttggcaggcgtgtcgccggcgccgaagcacgggccgcagaatgccgtgcgcacaatcgcgccggcctccataaggtcgtagatgtagccgcggcgtgtaagctcgagtgccacgggctggctcgtgggatagaccgacagcgaaaactcgccgcagccggtgttagcgcccttgagcacgcgagcagcctggaccacggagtcgtagttgccgcccgagcagccggcgataacgccctgctgcacgtgcagcttgccgtcgacgatcttgtcgagcaggctaaagtgcgtcttgccctcgccgatcttggcggcctcgagctccacctcatgcaggatgtcctcgaggttctcgttgagctcgtcgatctcaaagccgttagaaggatggaacggcaacgcgatcatgggcttgatactcgacagatcgacttcgacgcagccgtcgtagtaggcaacatcggcgggcttgagctcgcggtagtcctcgccgcgaccgtgcatggtcaaaaacgcgtgcgtgtcctcgtcggtagcccaaatggaggagaggcaggtggtctcggtggtcatgacatcgacgccgttgcggtagtcggtcgtcatgctcgcgatgccggggcctacgaactccatgaccctgttcttaacgtaacccttggcaaagacggcgcggatgatggcgagcgccacatcgtgtgggccaacgccggggcgcggggcgcccgtgaggtagatggcaacgacgccgggataggcaacgtcgtaggtgtcgcgcagcagctgctttgccagctcgccaccgccctcgcccacggccatggtgcccagagcgccgtagcgggtgtgcgagtcggagcccaggatcatcttgccacagccggcgaagttctcacgcataaaggagtggatgacggcgatgtgcggcgggacgaagatgccgccgtacttcttggccgcggaaaggccaaagacgtggtcgtcctcattgatggtgcctcccacggcgcacagcgagttatggcagttggtgagcacgtagggcagcgggaactgctccatgcccgaggcgcgcgccgtctggatgatgccaacgaaggtgatgtcgtggctcgccatggcgtcaaagcgaatcttgagtgcctcggggtcacccgacgtgttatgtgcctggaggatcgaatacgcgatggtgccgcgcttggcatcctcgggcgtctgcgtaataccgcgctcggcagcctcggccgcaggcacaacctcgctgccgccgcgcaggtagatgccgtcctcgtacagcttgaccatactgtctcccactctgcccaaaagatttgggcgcatagcatacattcgttcaatatcgtgccatagaacagttgcgagtgggttacgaatctacacgttcactttatctcagtaaagcaaaggacgagcccagtgtgggccggcagatctggtgcaagagcgtccctttcgactagtcatttaagaacgtccccaatgactaccccagcaacgccgatgttttggcaacgccagcgaaagcccgccagagcgagcaaggtgccttgaaacaaggcggcattgatcttttgatcatgccgccgaagttgaaaggcagattgccgctctggcgggcttgcagcgtcgaccggtccgccgttcgttagaacggcggaaccaaaggcgcagcgtcgagccgttacgccgttcggcagaacggcgtaacctacagatccccgccggcacccagcagcttgcgcatgacctgttcggggttaaccgagccgtcgcgcggggccagggcggtgatcttcttctgcatcttgtactcgtgcagctcgtcctcgagctggcgcacgcgggcgcggagcttttcgttctcgcgctcgcgctcctcggcacgctccttcatatcgaggatgcgcaccacgccggcaaggttgatgccctcgtcggtcagctggttgatgagctccaggcgctcgatatcggcacgcgaatacagacgcgtgttgccgcccgagcgctgggggttcaccaggcccttggactcgtagacgcgcagagtctgcggatgcatgccggtcaactcggccgccacgctgatcatgtacagcggtttattcctattgtcctcggccatgctacctgacccctttccgtctcgttatcgtccatcataagcccgcgggcgcgggtgtgcgccacgaccgccctagtacgtcgccttgtaacggttgaccttctcgcgataatcgcgcgtgtcggcctcgcgcagcttggtcatagcatcgcgctcgtcatcggacaggttcgtggggacctgtaccttgatttcgacgagcagcgcgcctgtgcggccacggtgcttaacgtcgggcgcacccatctccttaaagcggaacttcttgcccgtctgggtgccagcgggcaccttcagacgaaccgtcgcgccgccgggcgtgggcacatcaaccgtgcagccgagcgccgcctcgtagaccgagatcggcacctccatggtcacatcggcacccttgcgcttaaacagcgggtgctcctccacatgcgtggtcacgaccaggtcgccgcgctcgccgccggcaacgccatactcgccgcgacgcttgtagcgtagcttgccgccgtcgaccgcgcccgcgggcaccgagaccgtaatggtctgctgctcgcctgtcgagggaatgcgataggtgaccttgtgcgtcacgccgcgaaacgcgtcctcggccgtcacatcgacggtcagcgacaggtcgccgcccttgcgagcacggctgcgacccgcgccggcaccggcagcgcccgcagccccggcaaagcccgagccccaatcgctgccccaggcgccgttgccgctaaagatgctgtcgaagatgtcgccccagccgctggcacccgcgccggcaccgtagccgctgccatacgcgccgcccgcgcccggcatgccgccaaacatgagcatctggtcgtactctttgcgcttcttctcgtccgaaagcgtctcgtaggcctcgctgatctccttgaacttggcctcgtcgccgccggcatcggggtgatatttttgcgcgagcttgcgaaacgcgctcttgatctctttgtcggaggcgctcttggatacgcccaggatgtcatagaaggttttgcctgcagccatcgtagctcctctcctgtttcatccgccgcccagcgggcggcggctcatgctttcatatggcactaggccagaaagggccccgggtgttgccccggggcccttctcaattactcctcggtgctctcggccgtatcggccgcagcatcctcgggcgccgcgtcgggctccggtgcggggcgcttctcgccaccgtaggtcaccgtcaccatcgcggaacgcaggatgcggtccgccatgcggtagcccttctggtacacgtcgttgacggtctcgtcgtactgcgacgcgtcctcgacgcgacccacggcctggtgctcgagcggatcgaacgcctcgcccttggggtcgatgggctcaacgccctcgtgcgcaaacacatcgagcagcttggcatgcaccgcgtcgacgccgtcgacgaactgcttaaagtcgtcggcaagctcctggctgcgggcatggtcgatcgcacgctcgatatcgtcgaccaccggcagcagcgcggtgacgagcttctcggtcgcgcgctcgcgctcggcgatacgctcattggcggtgcggcgacggaagttctcccagtcggcctgaagacgggcggtacgctcagtggcgtcctttgccttgtcctcggcggccttctgagcctctgccgcagcatcgagctcattgcgcacgtcggcgagctccttttgggcctgctcgaacttgagcttaaagtcgttgtcggcggcttcctcaccggcgcggatagcggcttccaccatctcgtcctcggtcatcgtcgcctccttgttggaatcctctacctggttctcggcagcctcggcggccggggcctcgttggcctcggtatcgtcgacggcctctacgggaatcttcacgtccttctcctcagagtcaacgggggcggcgccagcggcggccgcctccgtgcgagctttacgggcggacatgattacttgtcctcgtcgtccacaacctcgtagtcggcgtcgacgacgtcatcgtcggcaggctgggcgccggcggcaccgtcggtctgctgctgagcgtcggcgtagacaacctgggccagctcgtaggccacggactgcagggactcgccggcggccttgatggcctcgacgtcagagccctcgagcgccttcttggcgtcggcgatagcggcctcggccttggacttcacgtcggcggaaaccttgtcaccgagctcgttgagggtctgctcggtggagtagcacaggctgtcggtctggttgcggacctcgacctcttccttctgcttcttgtcctcctcggcatgagcctcggcgtccttgaccatacgatcgacttcgtcgtcggacagagcggtggagccggaaatggtgatctgctgctccttgccggtgcccttgtccttagcggagaccttgacgatgccgttggcgtcgatgtcgaaagtgacctcgatctgcggcacgccgcggcgggcagccgggatgccggtcagctggaacttaccgagcgacttgttgtcgcgggcaagctcgcgctcgccctggagcacgttgatctcgacgctggtctggttgtcggcagcggtggagtagacctcggtcttggaggtcgggatcgtggtgttgcggtcgatcatcttggtcatgatgccgcccatggtctcgacgcccagcgacagcggggtaacgtcgagcagcaggatgccctcgacgtcgccggtgagcacgccgccctggacggcagcaccgtcggcaacgacctcgtcggggttcacggacatgttgggctgcttgccggtcatggtcttgacgagctcctggacagcgggcatacgggtggagccgccgacgaggatgacctcggtcagatcggagagcttaagcttggcgtcgcgcagggcgttggtgacaggctgcttgcagcgctcgagcaggtcgcgggtgatcttctcgaactcggcgcgggtcagcgtgtagttgaggtgcagcgggccggactggttcatggtaatgaacggcaggttgatggtggtctgctgggcggcggagagctccttcttggcgttctcggcggcctccttcagacgctgcagggccatggggtcctgacgcaggtcgacaccgttctcctgctggaacttatcggccatccagtcgatgacgcgctgatcccagtcgtcgccgcccaggtggttatcgcccgaggtggacagaacctcaaacacgccgtcggcgaggtcgaggatggagacgtcgaaggtaccgccgcccaggtcgaagaccaggatgcgctggtcggtgccctgcttgtccaggccataggcaagagcagcagcggtcggctcgttgacgatacgcttgacgttgaggccggcgatcttaccggcgtccttggtggcctgacgctgggcgtcgttgaagtaggccgggacggtgatgacggcgtcggtgacagtctcgcccagatacttctcggcgtcggccttcatcttggcgagcgtcatggcgctcacctgctcggcggtgtaatccttgccctcgatgtcgacgacggcacggccgccctggccctccttgacctcgtacggcacggtcttgatctcagaggtgcactcggagtacttgcggcccatgaagcgcttgatggagaacacggtgttcttggggttggtgacagcctggttcttagcggccttacccacgacgcggtcgccgtcggcacggaagcccacgacggacggggtggtgcggtcgccctcggcgttcacgataatggtcggagaaccgccctcgagaacggccattgcggagttagtagtaccaaggtcgataccaagaatcttgcccattagaaattccctctctcttgtgcgtttgcaccgactcggcggtctgtcgagcggtgtttcggcttgtctttcaggatgtagtgtatccccttatgggccggaatatacaaaatctaagtcaattcatataagatttcttattgctgagagtttaggttcgcaaatgcgcaggtagacgcactgtttgagttctaggcaaatctatcgagatctatgtagagatgactgaggtttgggtccgagggtgcctggggctgccttgcggaaagcttgtcccagttttcggcaaaataacgggatgccctttccgcaggcgcgctcaatagctcaatatttcaagtcacctttagctaacatttgcgcagctcaacggccccacctgcgtgttttttagtaagccgcggcatactcggcgaacggtatgaagatgccggtcagagggtattgcaaacggtcgctcccgtggtatgtttttgcccgaatcaaaccggcgcgcatcgtctgtagcgtcggtcaacagagaggaaactaccatggctcatcccgtaattgatgccgacgagtgcatcgcttgtggcgtttgcgtcgactcctgccccgctggcgttctggagctccaggacgtcgctaccgtcgccgacgaggactcctgcgtcgcctgtggcgcttgccaggacgcttgccccgctggcgcgatcaccgagatcgtcgaggagtaacaactccccacttgcacactcaaaagtacaccgtgcacaaaaaggaggcctccgcatcgccgcggaggcctccttttgcatatgtgggcagtggcttataggacaaaatgtgtgtccacgttgggggcatcggcgcaggtcgatgccgggcccgtgggttataccctaagagcaaaccaccctttttaagggtggttctgatttatctgacggtttaaaacggtctcacgtgttacagattgagacgttatatctggacagtcacgccatcccaattacatccccgttagcagcacgatgtcgagaatcgtcacgatgacgccgatccctacgagcagcgcgttgagcgggcgcgagttggcgtatttgcccataacgcggggcgaactggtgagtcgtatgagcacaaagaccgtaatcggcaactgaagcgacagcagcgcctgactccagatgagaccctcaaaaggattcgggacgaccaagcacgccgccactgcgccgacgaaacaagccgccaccccgatcgaggaatgtcggtcgtggatgtcgtattcctcgtcgaacatgcccgcggtgatggttcccgccgccatgcccgctgtcacgctgctcgatagtcccgcgaacagcagcgctaccgcaaagatggtcgagctcgccgggcccaagatgggggagagcgtggccgctgcgacggcgaggtcgtctacgacaatgccgtgcgcaaagaaggtcgttgcggccaggatgaccatggccgagttgattgcccagcccacgcccatcgaaaagagcgtgtcgaagagctcatagcgcagacgctcttcgataacctgctcgccttggccttcgaagtgcatggattggatgacctcggagtgcagaaaaaggttgtggggcataacgaccgcacccaggacactcacgataatcgcggcagagccagtgggcatgctgggcgtgatccagcttgcggcggcttgcggccagtcgaccttgactagcgcaagctcggccaaaaacgagagtcctaccacgccgacgaaggcgatgatccagcgctcggcacgcttgtaggagttcgtcatgagcattgccatcgatgccgcggccacgatgacgcagccggcgcgcacgggcagtccaaagagcatctggagcgcgatcgcgccgcccaggacctcggccatagcggtggcgatggtcgcgaggtaggcactggcgagcaccgtgcgtccaacgaaacgggggaggtagcgcgtcgtggcttcggcaagacaggcgcccgttgcgatacccaggtgtgcagcgttgtgctgcaacacgatgagcataatcgtggacagcgtgaccacccacagcagcgcgtagccaaattgtgagcccgcggccatatttgaggcccagttgcccggatcgataaagccgacggtcacgagcagcccggggccgatatgccgcgcaatgtctaggcctccgtgaccaccggtgcgtcgggagccaaagtgttgtttgagatggttgagcatggtgcgctcctgcgtgccgtttgtttgacgccgcaaaggatacccgttttaggctaaaaagttaaccaagactaacaagattgttgtatttgaataggatggtggaaggggattgctgaaatgtcttgatctgtaacaaccagggatggaaattgggcctaggtgttacaggtcaagacaggaagaaatggtcctatggaatatctcgatctgtaacagctgaccgccaaaaccggcccttcgtgttacagatcgagacaaaccaaaactgtcctgcagaaaatctcaatctgtaacatctaggcgccaaaattgggtcttcctgttacggattgagatgtttgaagcggtgagcatacgggccgaactcggggcccttgtcgtcgtccttgaggtcggcggtgtccactcgtagggcgtgcgttacgcgattgtttcgaaacgggcgggaaacacaacgggccggcgatgcacctagtatgcctagtcaactgactgtctaatagctaggggaggatcgcgatgcaggcagattccgctcaacagcagggcctttatcgccccgaattcgaccacgatgcatgcggcatcggcgcgcttgccgatatcaacggcgagcgccatcaccagattctggacgatgcgctgtccattctggtcaacttggagcaccgcggcggcaccggactcgagaagaacaccggcgacggcgccggaatcctgttccaggttccgcatcactttttccgcaaagaggctcaaaagtgcggccagattctgccggcagagggcgactatggcgtggccatgctgttcttcccgcaggacgacaagggcgtagaggatgcccgtcgcgtgtttgaggagggctgcgccgaggccggcgtgccgctgctcttttggcgtgaggtgcccgtcgacccgcacgacctgggcgagacggcccgcgcctgcatgcctactatcctgcaggctttcctgggccgtccggacgacacgctcgccggcgatgcctttgagcgtcgcctgtacgtgtgccgccgcaccatcgaaaagaaggccagcgctgagttcgccctgcgcgacaagatcttctatgtgtgctccatgagctcgcgcaccatcgtgtacaagggcatgcttgttgccacgcagatgcgccgcttcttcatcgacctcaacgacgccgccgtcaaaacggccgtggcactcgtccactcgcgctactccaccaacactacgcccagctgggagcgcgcacaccccaaccgctttatcatccacaacggcgagatcaacaccctcaagggcaacgtcaactggattcgcgctcgcgaacccaacctgtacagccccgtgctgcagcacgatcttgagcgcgtgatgcccatcatcaaccgcgagggttccgactccgcgattctggacaatgtgcttgagttcctggtcatgaacggtcgcccgctcacgcgtgccgcgtccatgttgttgcccgagccgtgggaccacaacgacagcctgagcgaggaacgccgcgcctacgacgcctaccagtccatgctcatggagccctgggacggcccggccgccatcgcctttaccgacggtcgcacgctgggtgccgccctcgaccgcaacggcctgcgccccgcccgctactacgtgacgcgcgacggccgctttatgctggcgagcgaggtgggcaccatcgaggtgagccccgagaacatcctgacgagcggctgtctgggaccgggccagatgctcgaggtcgattttgcccgcggccgcgtgatctacaacgacgagctgcgcgcccgctatgccaaggaaaaaccctaccgcgactggattgccgaggagacgctgaccgttgacgcgctcgatgagcccgtcgcgcccacgcccgccgaggataccgaggtgcccgccgccgtgcgcatggccaagctcgggtatcactgggatgatgttgacgaagtcgtgcgtcccatggcccaacagggcaaggcgccgctcgcctcgatgggtatcgatgcgccgctggcctgcctgtccaagaagacgcgctcattcttcgactacttctatcagctgttcgctcaggtcacgaacccgccgatcgacgccctgcgcgagcatatggtcacttcgaccacgctctacctgggcaaccacggtaacctgctcgaggactcccgtacggcctgccagctggtgcgcctggagcgtccgctgctgagcgaggaggagttcgagcgtatctgcgccatcgaccgcgtgggctttaagacccgccgtttccgtgccgtctaccgccgcgatgccggcgagggtgcgctgcaggctgcgctcaagcagcttgcagaggacgttgaggccgcggttcgcgacggcgtgaacatcgtggtgttgagcgatcgcgccgctgcgggcgaggtgcccgtaccgtcgctgctcgccgtgggctgcgtgcacaaccacctgatccgcgccggcgtgcgtacctttgccgacatcgtggtggagtgtggcgacgccgtgtccccgcacgactttgcggcgctggtgggctactccgcgagcggcatctatccgtacaacgcgcatgcgtgcattcgcgacttggcgacgcacggcgatctggacgtgacagctgagcagggcatcgccaactacaacaaggctgcgaccgccggcatcgtctccatcatgtccaagatgggcatctccacggtgcagagctaccactccgcgcagatcttcgaggccgtgggcttcactccggagttcgtcaacgcgtacttcgccggcacggtgagccgtgtgggcggtatgggtgtcgaggacgtcgagcgcgagcagaatgagcgctacgacgccgcgctcgctatccttaagagcccggctcccgatcagctgcccacgttgggcctgaccaagtggcgcccgctcggcggcgaggatcacctcatcgatccgcagactgtctacttgctgcagaccgcctgctgtgaggacagctacgacacctttaaggagtacagcgcccgcctgcaccgcaccggccgtgctgtgcgcctgcgtgacctgctggactttaatgccagcggtcgcacgccggtttcgctcgacgaggtcgagcccgcgctcaacatcgtccgccgctttaacaccggcgccatgtcgtacggctccatcagcaaggaagcacacgagtgcatggccatcgccatgaaccgcctgcacggccgttccaactcgggcgagggcggcgaggacccgcgtcgcgagaccccgctggctaacggtgactccaagaactccgccatcaagcaggtggcaagcgcgcgctttggcgtgacgagccgctacctgtgcagcgccttcgagattcagatcaagatggcccagggcgccaagcccggcgagggcggtcacctgcccggcaagaaggtctacccttggattgccgaggtccgtcagtccacacccggtatcggcctgatctcgcctccgccgcaccacgacatctactccatcgaggacctggcggagcttatcttcgatcttaagaacgccaaccccggcgcacgcgtgtcggtcaagctggtcagcgaggccggcgttggcaccatcgccaccggtgtggccaagggtgccgccgacaagatcttgatcagcggccacaacggcggctccggtgctgcggcgcgcgattcgatctggcacgccggtctgccgctggagcttggccttgccgaggctcaacagacgttgctgcaaaacggcctgcgctcgcgcgtggtactcgaggccgacggcaagctcatggacggcaccgacgtcgccgtcgcctgcctgctgggtgccgaggagtttggctttgcgaccatgccgctcatctccatgggctgccttatgcagcgcgactgccagcaggatacctgcccggccggcatcgccacgcaaaactgccgcctgcgtcgcggcttccgcggcaagcccgagcacgtcgaacactttatgctctttgttgccgagcagctgcgcgaggtcatggcgagcctgggcttccgcaccgtcgacgagatggtcggccatcccgagtgcttgcgccagattgaggtcccgggcaaccgcaaggccaacctgctcgatctgtcgcccgtgctggcgagcgcgacctgcgagttcggtgcccacatcccgggtgccgacggtcgtcacttcctgccgcagatggctgcggacagtgagctcgacaagacgctcgactccacgttgtttgtgccctatacggccgatgcccgtgcgcacctgcgtccgattcgcttccgcgccgatatcgccaacgtcaaccgttgcgtgggcaccatcttgggcaacgcggtgaccaaggcgcatcccgagggtctgcccgccggctccatcaccatcgattgcgatggttcggccggtcagagctttggcgcctttctgccgcgcggcattacgctcaacgtgtgcggcgacgccaacgactactttggcaagggcctttcgggcggcgaggtgtcggtgcgccccaacccgcatgcgacctacaagttcgacgagaacatcatcgtgggcaacgttgcgttctttggcgctacgagtggccgcggcttcattaacggcctggccggccagcgctttggcgtacgcaactccggtgccacggtggtggtcgagggctgcggcaaccatggctgcgagtacatgacgggaggtctggcgctcatcctgggcgaggtcgggcagaacttcgccgccggcatgacgggcggcgtggcttacgtctttgaccagtacggcacgctcgatgcccgtgtgaaccacgagagcgttgagcttaaagccccgacggccggtgagcttgcgcagattcgtgcgctcatccaggagcacgtggacgcgacgcagagcccgcgcggtattaagctgctctacagctttgagacgatgagtaagcactttgtgaaggtcattccaaccgagtacgagcgcgtgctggcgattgtcgccgccgccgaggccgtgggcaagacgcatgcgcaggccgaggagctggcgtttgacattgtgaccggccgcgcgagtgccgcggatgtcgctcgcttagatgtggcgggtggtgtcgctggcgctgcgcccgccaccgccagctctgttgcttcgaccaagaaggaggcgtaagtgccatgggtaagcccggtgcttttcttgatatcgatcgcgtgacccatgagctgcgccccgtggaggagcgcagccgcgatttcgatccgctgtacgtggagctcgacgacgacgcgcgccgtgcccaggcgagtcgctgcatgatgtgcggtgtggcgttttgtcagatgggcgcgagctttggcaaggcacgtccgagcggctgtccgctgcacaacctgattcccgagtggaacgagctggtgtaccgcggccgttgggacgaggctgccgagcgcctgtcactcacctcgcccatgcccgagttcacgagtcgcgtgtgcccggcgctgtgcgaggccgcatgcaacctgggctcggtcgatggccagcccacgacgatccatgacaacgagcgcgcgattagcgaccatgagtgggcaaatggcggtccgcaccgctttgagccggcaggggagggtgcacccacggttgccgtggtgggctccggtcccgctggtctggtggcagcatgggagcttgcgcgtcgtggggcccgcgtgactgtgtttgagcgcgacgaccgcccgggcggtctgctcatgtacggcattcccaacatgaagctcgagaagtccgtggtcgagcgtcgcgtggcgctcatgcgcgagctgggcattgtgttcgagctgggtgctgacgttacgaaccctgcggtggcggccaagctcaatggctttgacgccgtcgtggtggctgccggtgctcgcgccccgcgtgggctggctgctgagaatattgacgcacccggcgtggtgtatgccgtggactacctgacggcctcgaccgtctcggtgctcgatggcggcgagcctgtcgtcgatgcacacggcctggacgttgtggtcattggcggcggcgataccggtaacgactgcgtgggcaccgcggtacgtcagggtgcgcgcagcgtgcgccagtttgagttcttgccggcggcgcctgatgcgcgcgcggcgagcaacccctggccgcagtggtccaacgtgaagaagaccgattatggccagcaggaagccatcgctgccatgggcggcgagatgcgcgcttggggtgtggatacgctcgaggtactgttggacaagaagggcgcggccgcgggcctgcgcgtggtcgatctggattggtcggctggcaagcccgagcgcatcgcgggctccgagcacgaggtgccggcccagctggtgctcatcgcctgcggctttacgggtcccgagcatggcgtgttcgacgccgttggcgtgcctgttgccaccgctggtcgtccgctgccggtgatggctgccgagggctcgcaccttgcggcccgtgtcgacggcgtcgccgcgggcgccacaccggtatacgtggccggcgatgctcgcaatggcagttcgctcgtggtaagcgccatggccgacgccctggcctgcgctgccgaagtcgccgaggcgctggagctgtaaagtagtcatttaagaacgtccccaatgactagtcattttttgtctagtcgttggggacactctttgcgagcgatttgctcgtttgtcgacgtacgggtgtttatttgtcgacttcttgggctgtggtcacctgttgtttctgtggtggctgtgggtatctggctcaaaagggcgggttggccgtctatgtttacctgcggttttgttgcggtgcgtattttcggtcaagcttttcgtcaagtgtttggtcagcatctggtttgcagccggaggcctattttgcccgcgctggtcgtggccgaccaccctcctcgtaagctcaaattgaggtctatcagtttgaggaggatgccatgactgaccacgctttagaccgagcgcagctagccgaagccgtcggcaacgatattgccgacatagcccatttttggatgctgcggaagttccagtttttggagccggcgcgcgaacagttcgagatcattgtcgacccgtggctcagctattgcaccgagccttcgcaaaacgaaatcatggcctacaacatggcgtttaccgattggctgctcttcgagcgctcctatcgccatggcaagacgctgctcgagctgtatgttgacgagccgccggcatcgctttcgcctgcctcgctcaagcggctcgagcaggtacgcgacacgcagtatttctcgcgctttggcattttggacaaggatcctgcgaacggcatagttgcgctgaaggatacgcgcaccgaccgtcgctttgatgtctacgacccgcatatcgtgcaaaaggagcattggagcgacggcgcgattgcggtgcgcctcgcttgcgtcgacgatgtctggctgacggcgggacagctctatctgtacgacatcgcgcgcctgagtgacacggcagtcgatgggccgggtgcggtgcatccggaggacctgcaggatggctttgacacctcgtgcatcagcttctttttgcgcctggtccgcgacatcatgggcgcccaggggcgctacgtaaagtccctcaacatctacgaacaagaatgggagtaggggatgtgactggtgtcgccctacagccctgactttgtctcaatctgtaacgtttagcggctgtttgagcccgtaactgttacagattgagacggaaggttggcggctgtcgaaagatcttgttctgtaacaactagaggctcaaagactgtcttcctgttacagatcaagacatttgtcagcggaggcaacggtgacgatggtccatttgtctgacgtggtggtgacgaaagtgtctaataccgttctcaaacacaaacatgcgactcgcaacacgttggcgcggaatagaatgctcgcgcggctcacggagacggccaagcaaggtgcgctgctcgcaacgcatgacaataccgagctcatgtggctgcgacgccatgttggaaccgacgatatcgcggagcccgagccgtacctgttctgttttcagcatgattgggatgcattgacgccggcggagcgagcgctgaggactatcaaagggcttgcggaatttcatcccgattgggcgttttggggctatgacgcggcgcttttgtggggtctggaggtgccgaatgatctgctcgggccgcgctttcttgttaagacgggttgttcggtgacgttgagcggcgggtgcaggttgttgcgtccgcagatggcgggcgtgctcgagcgtgttgatggcgtgcgggtgacgtcgttttggcgcacggtggaggattgcttactgcgtgcgccgttctcctacgggttggcgattgccgattctgcactgcgggcgaaaggcgtatcacgttgggatttgtgcgagcgcctccgcgccgattgcgagggcaggcgagggtatcgcagggcacaggtgattgcgtcgtatgcggacgggctgtccgaaaacggcggcgagtctcggttccgagcgttctttattgcgtacggctttccagttccggagctgcaggtggagtttcgcgacccgctcgattcgagccaggtgtttcgcgtcgactatttttggcggctcgagaacgggacgtgtgtcatcggcgagctcgacgggaagggaaagtataccctgcaggatggtggggatcgggggtcggtcgacccattcgtggcagaacgtcagcgagagtctcatctgacgatgctcgggcacaaggtgcttcggtttacgtttgatgaactcaagaacccggggaagctggctgaaaagatgagactggcgggaattcaacagcgggccgatctggctgaggaatggagacgccagtggtatgggcgctgagaggttttgtctcgatctgtaacgtttagaagttgtttgagttcgtaattgttacagatcgagacaaaccggtgaaacgtcgaccgaatgtcttgatctgtaacatcaaggggcccaataaccctgtacctgttacagatcgagacattcccctgatgttgctggggtggggctgcaacgtattccgtccccccacatcccctcttccctccgttaaccgatatgtccgcagcaatcctgccgcgctggataataatggacagatgttcaagttttctgagggggaggagctcgatatggcgtctgccgatcgttccacgttgtttatcaatgcgaccgtcctggatggctcgaaacatatggagccgcagcccgatatggccgtggccgttgagcgcggtgtcatcacgtggatggggccgagtgctgtggcgcaggcgcctacgggtgccgaggttatcgacctggcaggtgcgtatctcatgccaggcctcatcaatatgcatgtgcatctgtgcggttcgggcaagccggtttcggcgggcgatgcgggcgcgctgatgaagaagctcgataatcccgtggggcgcgccatcgtgcgccatattcttaagggcagcgcccaacaacaactggcaagtggcgtgaccacggtgcgcggcgcgggcgacccgctgtttgccgatcttgccgtgcgcgatgctatcgatgccggcaagtatcaaggtcctcgcctggtggcgccgggaacgggtgtcacggtgccgggcggccatggtgcgggtttgttcgcccaggtggccaacagtcccgccgaggcagccgaacaggtgcgcgacctgtatgcgcgcggtgccgacgtcatcaagctgttcgtgacgggcggcgtgttcgacgctaccgaggtgggcgagccgggtgtgctgcgtatgccggtcgaggttgccgcggcggcgtgcaaggcggcgcacgaggtgggcctgccggttatggctcatgtcgagagcaccgaaggcgtgaaggccgcgcttgaggccggcgtcgatacgatcgagcacggtgccccgatgactcccgagatcttggaactgtaccgcggcgccgcgggcacgcagctcgaggggcgtgcgcccagcgttacctgcactatcagcccggcgctgccgtttgtattgctcgacccggaaaagacccattcgaccgatacacaaaagaagaacggtgacatcgtgtgctcgggcatcatcgagagcgcccgtgccgcactggaagctggcgttaaggtgggccttggcacggactcgagctgcccgttcgtgacgcagtacgacatgtggcgtgaggtggcctattttgccaagtatgtcggcgtgggcaacgctttcgcgctgcatacggccacgcaggtcaatgccgagctgctggggctgggcggcgagaccggcacaatcgagtgcggcaaggccgccgatattctggtgacgcgcgagaacccgctcgatgacctgtgcgcactgcgtgatccgacgcacgtgatgtgtcgcggtgatctggtgcgcaagctcaaggtgaagcgtattcccgaggtggacgccgagctcgacgcgattatggccatgcctgccgaggcgttggccgaggagcttgcccgcgatggcgtggcgtaagcgcgcgatatggcgatgcgacaaagggacaatccttttgtcataatcagaaaaagccgaggtcccagtgcgaggcctcggcttttatttgtcccatagtatggcagctatgagcgcgtctccatcttggcatggcacttggggcaggtgacgcggatcttgcctttgcccttgggaacggagagcatctggccgcagttggggcacttaagataggccgtggtcttgcggcccttccacatcttcttggctgtgcgcttggcacgttcaaagtcttccttgctagtaccggctgcgcgcgaggcgttggccgctgcagctccgccgcccaagctagctacaaacttgcccaagccgggtacgtttgcagtcgcggcgacaaaggcctcgttctccttgtgacgtgcgtcgatatttttggacaggccgcgcagcacgccaatcacgattacggcgatggcaatccagctgagccactggatgcgggctatcgatccgatcatcgcgatgacgatgccggcaaaacccatcacgatggtgagttcatcggcaccattgcgacccttcataaagtcattcatgcaaattgcctttcgttcgatatgctgcacgcctttatacccgatttagagcaagggggacaggttaatctgcaccaatgtggtgcaaacgtacctgtccccaatgccccaattacttggagagtttgtcgacgacgcgttcgatttcggcgagcttggcggctttgaggtcttcgtcgcccgattcgattgccgaagtcacgcagccctcgatatgcgccttgagcacgtcggcgttaatgcgcgcgaggagcgcctgcgttgccatgagctgcgtggaaatatcgacgcagtaacggtcctcctcgaccatccgcaagatgccgtcgatctggccgcgtgccgtcttgagcatgcgggtcaccgatttatggtctgccatcatgtcgggtcctcgtttctggtcgatcttccggatgtccccgtcagttgcggtgaaatacggaccgtttaaaggcctagggcggcacaacagtccgtatttcaccgcaacttctgaggattgagtaggcagcgactgctatgcggcggtcaccgaaagtgcgtggaacttctcgccggcggcctcgacggcggcggcgagttgctcggcggttacggtgtcggcgcactccacctgtacggtctgagtctcgtgatcggcatcggcgtcggtcacgccggcaacgttgagcagcgcggtctcgacggtggcatcgcaatggccgcacatgaggccggaagtcttgatcgtgtaacgcatgggtattcctctctgttgtgtcggctttcccaggcacccgaccttgaccttcaaaccgtcgctcgcgtaccaaagtacgcgtcgctcctctttcaggtcaatctcaggtacctggaaaacccgttctaaatgaacgtaatagtgatcctattttgccactttaggcataaaggattttaagcgcagggcattggacacgacgcagacgctcgacaggctcatcgctgcggcgccaaacatcggcgagagctgccatccggtgagcgggaaaaatacgcccgccgccagcggaatgccgatgccgttgtagaacagcgcccagaacaggtcttgcttgatgttgcgaatcgtggcgcgcgaaagttcgatggcgcgggcgacgtccatgagatcgctgcgcatgagcaccacatctgccccctccttggcgatgtcggcgccggtgccgatagcaaggcccacgtcggcgcgcgccagggcgggggagtcgttgatgccgtcgcccaccatggcgaccttgccgcccgcatcctgcagctcgcgcacgtggcgctccttgtcggcggggaggacgtcggcgatgacctgctcgcggctcagccccacgcggcggtggcgagatggagatgaccttcatcatggctcacgctcaggacactctctctcctgcgcccctcccggaactgtccacatcagtgtagccaatccacggcgcggctggcggcgaggccgggcaggtgggcgaccccgagccccgcggcgcgggcccgcctcacggcgagggaccctatgttgcggaactggtcgacgacgacgagcgtgccggcgggcgcggaggcgaacagcgcgtcgagctcggcctccctgttgcggacgggggcgctgtccagcacctccccgtcgcggtcgatcaggcaggcccagtgcgatgacttgccgacgtccaggccgagcacggccgcgggtctggtggatggcgctttcacggtggtatccttccggtagtcgttcgaccggatggcctccccctcggcactcacattaccagccgcggcacctgcccggcactttcctatcagccgtcgggggcggcgcgccccgcgccggcagcacccaacgggccctctcggggcagggacgttcggccgtgcgcgggcgcccggtcggcggcccgttctgggcgcgcctcaatcgtagcccgagacggtcccgggctgacaatttcgactgtaatggacgttcttaaacgactagtcattcaagaacgtccccaatgactgggtcggaaaatttcttaaaaaagttcttgctcttcgtccaatcgtccgtataataaacttcgttgcttgagagcacgcacctattcctcggtagctcaatggtagagcacgcggctgttaaccgcgctgttgtaggttcgagtcctacccggggagccagaatttctcagcccattccgctgggcttttaaattcctcggtagctcaatggtagagcacgcggctgttaaccgcgctgttgtaggttcgagtcctacccggggagccaggttgtaaaacccgtcgctatgcggcgggttttttcatgccgcgatcgccggtgccgaacgttaccgtatcaacatttcgtgtcgaggatgtaatcgcgaaccccgtggccttaacatggcgcggtcgttgtaaaatgttggaatgattgctcccacgacatggtgccgcgagcaccagaaaaggagattcttgtgtctgagaccattaacggcagcctgagcgtctcgaacgacgttattgccgatattgccggttatgccgcgatgacgtgctacggcgtcgtcggtatggctgaacagctgcagggcgccgagagcgtgcgcctgcttgccggccagcgcctccgcaagggcgtgcttgtttccgccgacgagaacggcctcacggtcgaccttcacgtcgtgctcgagaacggcgtcaacatgaagtccgtctgccacaatctttcgagctccgtcgccttcaccctgcaggagatcgcccagatcgatcccgccagccttaagatcggcattcacatcgacgcgctcaagagccgtctgaactagcatccgaatacggagatttcaccactcatgattgcaaagaccattcgcacctgttttccgatcgctgcggctgccgtttccgaaaaggccgaggagatcaacaaactcaacgtcttccccgtacccgacggtgacaccggcactaacatgtcgctcacgctcgcctcggtgaccaaggagctttccgcccttcccgccgatgccggcatggaggccattgccggcgccatcacccacggctccctgatgggtgctcgcggcaactccggcgtcatcacctcgcagatcctgcgcggtgtggccgagggccttgtctctgccgatgagcccattacgtctgccaacatcgccttcgccttccgtcgtgccgtcaaggtcgccttccaggccgtccgcaagcccatcgaaggcacgatcctcacggtgctgcgcgatgtctcgaccaaggccgacgagtgcgaaaagaagaagttctcggccgaggacgcgctcgacgccatcgtcgtcgaggcctaccagtccgtcgcccgcacgcccgacctgctgcccgttctgaaggagaacggcgtggtcgactccggcgcctttggctttgccatcttcctggagaactttgttgccgccgctcttggccgcagcaccgttgtcgaggatttctccgccacgtttgattccgctggctctgcccgcgacgcggccctcggtcgcgttgagatcgaggccaacgacgactgggagggctcggagttccgctactgcaacgagttcctctttaaggccgacgccccgtttgacgaggacgagtgccttaagttcctgggttccatgggcgactgcgagctgctcgtgggtgcctaccccgactacaagattcacgtgcactccaacacccccaacttggtgctcgagcacatgctgcagcttggccagatctacgaggtctttatccacaacatggagatggaggcccacgaccgtaccgccaagattcatgaggaccaggagaaggccgccgagcccgccaaggcgttgggctttgtcgccgttgccgccggttcgggcgaggctgacatcctcaagtccctcggcgttgacgtgatcgtctcgggtggccagaccatgaacccctcgactgccgacctgctgggcgccgtcgaccaggtcaacgcgacctcggtcatcatcctgcccaataacggcaacatccgcatggctgccgaggctgccgcttctgcctgcaccgacaagaaggtcgccgtcgttcccaccaagaccgtcccgcaggcgttctccgcgctgttcgcggtcctgcccgattccgagctcgaggacgccgtcgccgccatggtcgacgccatcagcgaggttcgcgatggcgaggtcacccgtgccgtgcgcgattccagcgcctctgacggctctccgattcactccggtgacgtcatgggtatcattgccggctccatcgacgtggtcggctccgatgtgaaacaggtcacgctcgactgcatcaaccgcatgcaggaggaagaggagggcgatgcgctgacgattctggctggcgaggagctgtccgatgaggccttccgggagatcgtcgacgccattgaggaggctcagcccgacctggagatcgacgcccatcgtggcgagcagccgctctatcccgtgatcttctcgatcgagtaggcatctgcccatgtccgagctgtgctccgtgccgcgtgtctcggagcgctttgcccagagcaatgcgctcgacgaggatatcgcgcgactcaaatatgtttcgggtaaacgtgaggaggcccttcgccgtctgggaattcggacggtgggggacctccttctccatatccctcatcgatatctcgacttcacgcgcttctggtccatcgagatggcgcccatcggtaccgtttgcacgatagtcgccacggtcgatcgcattgttcaaaagcagcctcgcccgcgtatgcaggtgaccgaggtctcgctggtggacgagacgggcgtgctgcaagtcgcctttttccgtcagccatggattgcccagcagtttaagcagggagaccgcctggccgtgatgggtaaggtcgagtttgcctacggctttaagcagatggcctcgccgcatttcgaaaagctcgaggacgggcgtgccgcgggcaccatcctgccggtccattacgtgagcgatggcgtgagccaggcgtggatgcgccgcatcgtaagtggcgcgctcgaggtcgtcggcaatcccttcgacccgattcccgcgagcttgcgcgccaagcgccgcctgatgagcaatgcccgcgcgctgcgctcaattcactttccatcgagcatggccgagcgcgatattgcgcgtgcacggcttgcctatgaggagtgcctctacctgcagctggcgctgcgattgcgcaacgacggcggcttggtcgaagttgctccctacgcccacgtcgctggtgagcacctggcggcgctcaagcaagccctgccgttttcgctgagcgacgagcaggaggccgcgttccaagacatcctgcgcgacatgtgcgatggcgggcgcgtgatgaaccgccttctgctgggcgatgttggtaccggcaagacggccgtcgccgcctgcgcgctggctgtcgcggccgattcgggcactcagtcctgcgttatggcgcctacgggcgtgctggcgcgccaatatgccgataagaccggccccttgctctcgcaggccggcatgtcctgggcgctcctgacgggtgccacgccggcagccgagcgcgagcagatccatgcgcagctggaatcgggcgagctcgacgtcctctttggtacccatgcggtcctctcggatgacgtgacgtttaagcatctgtcgcttgtcgtcatcgacgagcagcaccgctttggtgtgggccagcgcaatgccctgcgtgccaagggcccgggtgccgacctgctcgttatgacggcgacgccgattccgcgcacgctggcgctctcggtctacggcgacctggatacgagcatcatccgccatcgtcccgttccgggtgccggcgttgagacgcgcgtcctcaccgagtcgagtcgcgacctggcctatggcgccattcgcgaggcgcacgaaaagggtcagcaagcctacgtgatctgtccgctcgtggagccgagcgattcggccgatgagctcgaagacgtacccggcatcgctcgcgacgacgagggccgcgtgaccgtgcccgtgccgttgcatgacacggcgaccgagctcgatcgccttcgtctggcattaccggggcttaccatcgagcgtcttcatggccgcatgtcggcgggggagaaggaccgggtcctcgatgcctttaagcgtggcgagatcgatgtgctcgtctcgaccacggtggtcgaggtgggcgttgacgtgcccaacgccaccgtcatggtcatcgagaacggcgagcgctttggtttgacggccttgcaccagctgcgcgggcgcgtaggccgcggcagcgtgtcgggtacgtgcctggtcatgacgcactccaagggcaacggcggcgcgtcggcggcacaagaccgcctccagtcactcgagaagacctcggacggctttacgctcgcccagatggacctgcgtctgcgccacgagggcgaaatcctgggttaccgccagcatggcggcgtgaccttgcgctttgtggacctggacgccgacgaggatcttatcgaatgggcccatttggacgcggtcgagctcttgcggtatgctagtaatcttgactctgtggcgacgcgtcccctgcgcgatgcggtcgccaagcgatatcgacatatttttaaggaggtcagcggaggatgagaatcatcggcggtgaatggcgcggtcgcaagatcgaagaaccgcgcggtcgcgatgttacgcgtccgacgaccgaccgcgtgcgcgaggcgtgtgcatccatggtcctatcggccttcggctttgatttggacgaggttcgcgtactggatgcctttggcggctccggtgccctaggcatcgagatgctctcgcggggcgcccgttcgctcacgacgttcgagatcgatcgcaatgccgcgaggctcataaccaagaatatcgagtcgctctgtcgcgatcgcgcgcgttggcgtgtggtgacgggcgatgtccttgcgagcgcttcgcgcggccgcgtgccgggcggccccttcgatctggtcttgctcgacccgccctatgcttttggtgccaagccggtcgatgagctgctgcagaacctggcccagcagggtctgctcaccccgggcgcctatgctctgtttgagcatgctgccgccgacgcgggtgcacatcctgccggctttgtaaccgtgcgtgagaaacgctatggcatcacctcggtcgatctgctccgttgggtcggcgagggcgaggatgacgacatcgccaccgatgccgatgacagcgacggcacgacgtttcaggaggatgcccatgagtgacaccattaaccgcgtcatcgttccgggtaccttcgatcccatcacgtttggccatatcgacgtcatccgccgcgcccgccgcatttttcccagtgtgatcgtggccgttgccgagtcgcagggcaaaaacggcgtgggcaccacgtttacgctcgatgaacgcgtggcgctggcccgtgaggcactcggtgatatcgatggcgtcgaggtcctgccctttaccggactgctcgtcgactttgctcgcgagcagggtgccggtgccgtggtcaagggcctacgcgccatgaccgactttgagtatgagctgcagcaagccgacctcaactaccgcttggataacgagctggagtccatctttgtcatgagtgctccgcagtatggctacatctcgagctcggttgtacgccagatcgcctcgctcggtagtgatgtttcgacgtttgtgccggctaatgtggtcgaggcgcttaaacatcgcttttcgtgacgttttttattgccaggtggcatgtggtaaactagcacgatgatatgttacctatgaaaggagaccggatgccgggcgagaattttcctggcgacaggatcgtgagccttgtcgacgagctcgaggggctcatccaagaggctaagacgccgttcggcaagaacgcccagatgaaggtcatcgatgccgacgtcttctttaacatcctcgatgagatccgcatgagctatcccgaggaatggcagaagtcccgccgtatcctcaaagagcgcgaggagcttatggcttccgccgccgctcaggccgattccatcatcgccgacgctcagcagcaggccctcactattgccggtgagcaggaaattgttcgccttgcgcagcagcaggccgacgatatccgcgaccgtgcccagcagtatgagcgcgagacgcgctatgctgccgaggattacgccgagcaggtctttacgcacctggaggagaacctcaagagtctgaccggcaccgtcacccgttgccgccagcagctcaatgagggcgccgcccagcagaatggtcagtggtaatggctgagttcccgagcgttaccgtcgatctttccgagcagctcgagtttcccggagactcgtatccgctgaccggtaaggtcgatgtcgctgcctacacggtgggcgagaaagagtaccagctgcaggacggtatcgactatgacgtggtctttaccaatgccggcaccggtgttctgcttaccggcatggttcgcgcgcacgccaccggcgagtgcgaccgttgcctggagcctgcctcgtttgacattgccggcgagatcgaggagttctatctcttccatgagcccgaggaccccgaggcctacgaagacggctatgagctcctgggcgaggatcgcgtcgtcgatctgggcgagcccatcaacgacgccgttgtcatggacacgccgtttgttgtgctctgcaagcccgattgccgcggtctttgtcccgtttgcggcgccaatctcaacgtggagcaatgcgattgtgctgcccaagccgaggccgaatgggccgaagccacggaaaatccatttgcagcattgaagaatctcaagcttgacgagtaaaactgtggtagtatcgctacttgcgcgtaatcgccacactggatagttcataaggaaggtcactatgcccgtacctaaacaaaagcagggtcgtatccgcactcacacccgccgttccgccaacatgaagatctcggctgcggctcagtccacgtgcccccgttgcggtgctgtcaagctcccgcaccacgtgtgccctagctgcggtttctacaaggaccgcgaggttatcgttaccgagtaacggtatactctggatacgatgccgttccaactggaaccacaatggccggctcattgagtcggccatttttgtataaggagcatgtatatgagtaacgttcgcgtttgcgtagacgttgtgggtggagacgagaagccgcaggttgtcctcgacggtattgaggctgcacttgccgccgatcccgatatcgaggtcttggcagctggtcccgccgaaatcgtcaatccctttgcagcttcccatgcacgtgttgaggcccttgaggcgcctgacgttatcgccatggatgacgatcccattcgcgccgtgatgaccaagcgtaagtcgtcgatcgtgctttcttgccgcgccattaagaagggcaacgcggatgcgttcttctccgccggctccaccggtgccatgaccgccgccgccaccgcctatgtgacgccgtttaggtatcaggccgaaggcaagaagcagccggtgcgtccctgtctgaccaatgcgctgcccaatcgcgccggcggtctgacggtgctgtgcgacatgggtgccaaccccgatgtggaggtcgatgacatggtgcgttttgcccagatgggtagcgcctatgcccgcgtcgtcctgggcatcgagcatcctcgcgtgggcctgcttgccaatggcaccgaggatgagaagggctccaactttaccaaggcctgtttccctgctatgaaggccgccgttcccggctttgttggtaactgcgagggcaccgacctcacctcaggtaacttcgatgtcgtcgttgccgatggcatgtcgggtaatatcgctctcaaagctaccgagggcgctgccaagtttttgctgcaggagctcaagggcgcctttatggcctcgctcggcaccaagatcgccgcgctgctcatcaaaaagcagatgcgcgagattaaggccaagctctctggcgacgccaagggcggcgcgattcttctgggcctgcgcggcgtggtcctgatcggccatggcgccacctcggtcgaggctgtcaaaaacggtacgctcgcggcggccgaagccgtgcgcgccgggctggtcgagaatgtcgccaactctatggacagtatcgttttgtaagagcgagttagagcgctgttatgtgcttcgcggcgcacgtcgtggggtagaatcagaaccgtgtcttggtaccgcccgggcggtaccattcttttggtattcatgtactatgagaggaagcgctatggaccgctccgaaatcttcgacaagatcgccgaggtcgctgctgacgttctgggcgtcgatgttgccgaaattagcgaggagaccacctttgacgacctcgatgccaactcgctcgagcgcctgcagctggttacggctatcgaggacgagttcaacctcgagatcgatgacgagaccctgctctcgctcaactctgtcgccgacgccgtcgacgctatcgaagctgccaaggaggcctaagtcttggctttatccgaacgacttacgcgcgcccaggaaatcctgggccacgagttcaacaataaggtgctgctgcgcgcggcccttacgcatccctcggcagtcgagggccagccggtttctgccagctatgagcgccttgagttcttgggcgattccattttgggcgctgtggtcgcacgctccctgtttgagtcctatcccgagtttgacgagggcaagctcactcgcttgaaggtgtcgctcgtctcgggcgccacgctatccgaggtttctcacgagttgggcatcgacgacatcattatctttggtgcctccgagaccggtaccggtgcgcgcggcctgcattcggccctcgagaacgtctatgagtcgctcgtgggcgcgctgtacctggatgccggctgggacgttgcggcggagttcattcaccgtacgcttaagccgcatttggcttccgagcgtgccgagcatcctgcgaaccccaagtcgtttttgcaggagtgcgtgcaagccgacggtcacgagcccccggcgtacaagctcgttggctccgagggcccggcgcatgcgcccacctttaccgctgtggttttgatcgatggtattcgccagggtcgcggctccggctcctcaaagaaggaagccgagggagctgccgcgcttgaagcgctcgaccgcatgggttacaccaccaacggcgtgattctgaacaagaagcacgtgtaagcgaggaaccgtgtatctcaagtcccttacgctcaaggggttcaagtcgtttgccgaccgcgcccatatgacgtttgagccgggcctgaccgtcatcgtcggtcccaacggctcgggaaaatcgaacatctccgactcgattctgtgggtcctgggcgagcagagtgccaagcagctgcgcggccaggccatggaggacgtcatcttctcgggctcgtcggcgcgcaagccggtgggtgtcgccgaggtcacgctggtgctcgataactcggaccatatgctgcccgtcgactttgacgaggtcgccatcacccgtcgtatgtatcgctcgggcgaaagcgagtacctcatcaactcgagcccgtgccgcctgatggacattcaggacatcctgcacgattcgggcctgggcaaggatacgcattccatcatcagccagggcaagctcgacgccattttgcagagccgccccgaggagcgccgcgccctgatcgaggaggctgccggcatctccaagcacaagcgccgcaaggaacgtgcgctcaaaaagattaaatcgatggacgagcacctgacccgtgcccgcgacatcaataaggagatcgcccgtcagctgcggccgctggagcgtcaggtcgatcgcgcgcgcaagtacaaagagctgtcctcgcgcgcgaacgagcttacgcagatgctggccgtcgacgagctccgttcgctgcagtcgcagtggaacgacctggagagccgctccaaggagggcgctgccgagcttgagcttgcgcagtaccgcctgggcgaaaaggagcgcgagctcgagaagctccaggtcatgctcgaggaaaagggcctttttgtgggcgatctgggcgagcagcgccgccatatgcaagacgtggtcggccgcattaactccgatatgcgcctgctcgaggaaaaaggccacaacatggtgtcgcgcctgtccgacatgcgcggccagatttcgagctccgaacatcagcgtcgtcgcgtggtcgaggagctcgaggatgcgcgtgcccagcttgaggaagttaccggtgcgcacatgcaggcccaggacgacgttgacgccgctgctcctgccgccgcccagctccacgagcgtcgcgttgcgctcgacaatcagatttcgcagcttacgcgcgagcagcgcgatgtgcagcgtgcggccgataacgccgcgctcgagcttgccaaggtgaaggactcgctgagcaacgccgaggtcgaggacaacatgtacgcctcgcgcctggagcagatcgacgagcagctcgaggaggtcacggcctcgctcgagagccgtcgcgaccgcgctgaggagctcgaaggtgcgctcgatcaggctcgccaagcccaggtcgatgcgcgtgaggccaccgaggtcgcccgtgcggcgttgaaggacctgcgtaatcgcgagagcgaggcgcgcaataaactgtccgaggttcgctctgagctcgcgagccaaaagaagctcgatgcccgcatggctgacagctcgccgcttgtgagccgtctgatgggcgcgttgggcgatgatgtctcgggtcgtctgggcgatgtgctcgaggcccctcgtgagctcgagggtctggtcgagcagctgcttgccggcgatatcgatgccctgctgtttgatgacgccgccacgcttgagcgtgccggccgtgcggctctggaccaaaagaaggcctcaggtgaggcgctgctgatggcgcgcggcgtgagcggcggtgctgctgctaagggcgctgccggttcgcgtttggtcgatcgtctgtccgtgcgttccggttatggcccggttgtcgaggccctgcttggcggctattacgtggtcgatgacttggctgccgcgctggcggcaccagtcgttgacggtgtgacctatgtgactcccgatggcgcccgcgtgagctgtggcggcctggtgcgcgttggactcgatgccggcgaggcttcgggcgccttggagcgcaagcgccgtattcgtgagctggagggcctggagcccgatttgactaccgtgtttgagcatgtgtcggaccaggttgtcgaggccaacgcggccgtcgaggaggcgcgttccgccgaaggcgatgtggccggcgagattgcccgccttgagggcgagcgtcgctcgctgctctccgagatcggccgcctggagcaaagcgccaacaatgccgaggtcgagcgcgtgcgcatttccaagcgccgcgagcaggctgccgaggccgttcgtgccgctcgtccacgcgtggatgaacttacccgttcgcgtgacgaagctcgtgcgcaggcgagcgacttaggtcttcagattgccgaagccaacgacgatctcgaccgcgtgcgtcgcgacgattccgaggccgccggcaagctcgccgacgctaaggtgcgcctggctcagacgagtgagcgcctgcgttctctgaagggccgcgtgcccgacctggagcatcgcctggagggcatcgaccgccgtatccgcggaacacgccaggcctcgcgctcgcttgagctgctgcgccttcgcgtcgatcccatgcacgagcgctattctgccctgttggagcgcgcctcggactgggcggcacgcctgcgcgatcaggcaacgcttgaggaggcggactcggcttcgcttaagaagaccatcgaggacgccaagaccgaggtcgcccgcgccaaagagagggtcgatgttgccgccacgacgcaaaatgagttcaaggtggcgcgcggcaagctcgaggtgcaggtagaggctgccattaaggccatcaccgccgacggcaccacggtgctcgaggaggcgctcatgctgccggcgcccaccgatcgcgacgccgccgagcgcgagcttaaccaactcgtgcgccagatcaacaacctgggtcctgtgaaccaagtcgccatggaggagtacgagcagctcaagcgccgcgccgattacatcgaggagcagctggccgatctggagagcgcgcgcaaggcgctcaccaagatcaccgtggcgatcgatcgcaagatgcgcaaggccttcctggtgacctttgagaaggtcgatgcgaacttccgcgagatcttcgccatgctcttcccgggcggtcaggcgcatctggagatgaccgaccccgagcatccggccgagacgggcattgaggtcgtggcgcagccgcgcggcaagcgcatcaccaagatgatgctcatgtcgggtggcgagaagagtctgacggcgctcgccctgctctttgccgtataccgtacgcgcacggtgccgttctatgtgctggacgaggtcgaggccgcgctcgacgacgccaacctgtccaagctcatcggtgctctcgatgtgctgcgttccgatacgcagctcttggtaatctcgcatcagcgccgtactatggaggatgctgacgttctctacggcgtctcgatgcaagccgacggcgtcagtcgcgtcgtctcgcaaaaactcgatcgcgaaaccggaaaggtcgtgaatgcataatgggattctttgacgcactctcgcgcggacttgagcgcagccgcgaggccctcaacgaggtcttctactttggcggtgaggtcgacgaggatttttgggaggaccttgaggacaccctcgttatgggtgacatgggtgccgaggtcgccattcaggtctccgatgacctgcgcgatgccgcggccaagaagaacctcaagaccgccccgcagcttcgccgcgccctggccgagcagctcgagggccattttgtgcctgttgagcgcgacccgttttccgatacgccgagctgcgtgctgtttgtcggtatcaacggcgccggcaagaccaccacggtcggcaagattgcgagcgccatggccgcccgcggcaagaacgtggtcatcggttcggccgacaccttccgcgccgccgctatcgagcagctcgatgtgcggggtcagcgtgccggcgtaccggttatccatgcgaacctccagtccggaccgcttcacggtccaactttctgtccgcacccccaaatgggggagaaataggccgcacgccggcgcagggaccggcgctaaaagaaaagcgcggggccgcatggcgactccgcgctttattgttcagcttttgcagccttgcccttacgctacgaagaagtagacgaggaaggcaagggccgcgatccacccgtcccgtgcgaaaaagtgtttacgagcgcttgcggctcaccacggcgcccgcggcgatggcggctgttcccgcaagggcggctgccacgatggctgcgctcgaggcgtcgccggttgctgcgagtttgccggcgatctttgctcccgtggctgcaactgcaacggtcttggtcgtcttcgtgccctcggacttggaaccctcgggcttggtctcgcctggcttctcctcgggtttgatctcctcgggaggcgcgatgaccgtgctcttggcgacagcttcgttatagggggagtcgatcacagcgtcgcccgtgccgatggtttgacccaccacgtagaagatgccgtcatcgagttcttccttgttgcgatagccaatgatcttgccgcctgtgggcgtctgtatgggagcgccttcgatctcgatggtgccgattgtctcgccgtccgcgctcacggcaagggcgaagattgccgccgtgtctccctcagctgtgaccttactgcggacaatcgagatggtcgcgggcgtgatgccctccttggtccgggcaaagatgccgatgttcatgcccctatgctcgggaatgaccgcgccactttggtcgttgctgtagtgatcggggccgtcgctaccggactcgacatagcgggctatagccttgacaacggagtcactaatgtagatgtgaccacccgcttcgttggggtagtagtttctggtgaagattgcggtcgagaactggccttctgcgaacgcatccacgatcgagccgttcttgatgacgatgtcgtcctcgtcggtgaagagggcgctggcttcatcgttccctgcacttgcacggaccgttacggttgcgccatcgaacgtgatgcccttgtagacatagatgccatacccaacgccacttgcgttgagggaagcgttcgtgaccgtgaggctgtttttaccgtcgatggtggcgtcttcctcggagcttgccttgacctggctgccacccgagatctcgatgttgccgtcggcccaaatcgcattgtctttgatagagcttgcctctaccttgccgccgccctttatgatgaggttctcgttagcatcgataccctgatcctcggtggccttggcggtgacggttccgctgttgtcgatcgtgatgttgccgtcggccctgatgccatccgaatcgcccgtggcgttaacgtttcccgagcccttgatggtgacatcgcccccggcatcgatggcatcgtgctcggtgctcgtggcgttgacagtgccagcgccgtcgatgttgatgctgccgacggaagtgatggcgtcacgagaagatgtcacgttgagcgtgctggacgcgtcgccctgaatattaagctcggcgttctcgttcgcgccatccttaaccttgatgccgcggccgtcgccgttagtgacgatgttgtcgccctcgtagctcacgttgagcttgcccgctgcctcgatcgcgccgccgttatagccgttgagcttcatgtcatcggcgccgtcccagctccaggtgccggcggcgtctcccgcgggccccgcggccgcttcgtggcggacgccgccgacgtccacccactcggccgcgagcgagacgctcggcatgagcagcgagctcaccgtgagcgcgcaggccaggccgcagacgatgcggcgcgtcacgcggcgccagctgccgtgtgcgagcagcgtgcgacggcacacgtcgggctcgacaaaatgggctccagaggttttgtcattgcgattgggggtcgtgaacaaggcggccatggtcactcccatcctcatagggcctatgcgattaagcccagcatatctgcaggatgtagccggcggtagtgccgtttggagggcaaaatgtccaaaacttgggaagcaaaacatcgcgcgtctgtgcgttgcctggctttaaaagaaaggcgcggagccgctcgatgcgattccgcgccttgttgttttgctttagcagactatgccgctacgctacaaagaagtagacgaggaaggcaagggctgcgatccacatgagcggcttgatcttggaggcctcgcccttaaagagcgcgacgatcacgtaggcgataaagcccaggccaatgccggcagagatggagtaggtgaagggcacgccggcgacaatcatgaacgccgggaaaccctgcgacacgtcggaccagtcgatctcggaggcctcgctcatcatgaggtagccgacgtagaccagagcaccgcaggtggcggcgctggaaacgatggtgacgatgggggagaagaacgcggcgagaatgaacagcacgccggtggtgacggaggtgaggcccgtgcggccaccgtcggcagcgccagaggtggactcgacgaaggtggtgatggaggagacgcccatgaaaccgcccacagcagcggcggcggagtcgacgatcaggatctccttgatattctcgacgttgccgtcgtcggtgaggaactcgccctgcttggccacggccatcgcggtgcccatggtgtcgaagaagtcactcatgagcagagagaacgagatgacgaggagcgcggggtcggtaaggaccttgacgatggcgggcacgccgccggcgtcggcgatggggccaccgatgctcgagaagtcgagcggggcgatgataccggtcggagcctgggtcacacctagggggataccggcgatgacggcgacgacgatgccgatgagcagcgagccggggacgttgcggcaggcgagggcgactgtcaccaggatggagatgatgccgacgatgaaggtgggggaggtgatgtcgcccagaccgacgagtgtgccggcgccagcggtgataatgccggcatcgcacaggccaatcatggcgatgaacaggcccaggcccaccgagatggcgtgacgcaggacaaccgggatggcgtccataatggcctcgcgcaggccacaaagcacgagcagcaagatgacgacgccctcaaggaagatgacgctcatggccacgtgccagtcaccgccgcagacggtggtggtgattccggcgatcatcgcgttgacgcctaagcccgacgcgcaggcgagcgggcggttggcgaagatgcccatgcagatggtcatgatgccggcgcccaggcaggtggcgcaggcgagcgctcccgcatcgatgccggcgcccgagagcaccgcagggttgacggcgatgatgtaggccatcgccaggaatgttgtcagtccagcgcgaagttcggtcccgattgtggacttgcgctcactgacgtgaaaaagttcgtccatgcataccctttccttgttcggccccgagtttaggccgattgacacgaactcaactactatatcgcctttgaaaggctgatgttcctcgcatgttgatgttcggcgctttgtagcagacagacggtatttttcgcatgaaaatgtgtgggtaccgtatacttaagcagttacaacgacccctatggaggaacgtatgattaaagagctctgccacgacgaggctattctgtcccagcgttgcgaggttgcgaccgtcgaggacgagtcggtggcacaggacctgatcgataccatcaagtcgctcgacgatgccggctgccttgccgccaaccagatcggcgtcaccaagaaggtctgcgtctatctggacgacgccggcgagccccatgtgctctacaacccccgtctggtgtttggcctgggtgccagcaagatggaggagagctgcctgacgcacgaggaggtcaccaagtccacgcgctatatcaagtgcaaggtcgcttatgacgtgatcgtcgacggcaagatgcgcgagcgcaagcaggactttgtgggcttcgaggcgcagatggtccagcatatgatcgaccactgtcttggaaagttggtctaggggaccaaagcaccgcacttcgtctcttttggtccgggcgtgacattgttgtcatgtccgggcttttgtgtttagcgcctttttgtttggtgacaataaccttagcaggaacgtaaagctaggaggcgctatgtgcacgagcattcgatttaccgataattctggccacatgtatctgggccgcaacctcgactggagctttgactacggccaacaggttcgtgtgatgccgcgcgggttccacattccgtattcgtttatcgacgatgcgtcggcggcacacgcggtaatcggcatgtgcatcgattacaagaactaccctatgttcttcgactgcggcaacgatgcgggcctcgccgtggcgggtctcaatttcccgggttatgccgagtatgccgaggaccctgtcgacggcaagaccaatatcgcggcctatgagtttcccctgtgggtggcagcgacgttctcgacggtcgatgaggtcgagaccgcgctgcgcgacacggtgattgtcgccaaatctgccggagaggggctgggcgtgtcgctgctccattggattatcggcgacagccagcgcagcatcgtggtcgagatgatggctgacggcctgcatgtatacgacgatccggtcgacacccttgccaaccagccgaccttcccgtggcacatggaaaacctgcgcacctatatcacagccacaagcgattttccgcagacggcgacatggcgtggcgccgagctcaagccctatggcgcgggtgccggcatgcgcggtattccgggtgattgctattcgccgagccgttttgtaaaggcggcgtacctcaatgccaattacccgcaaaaggagagcgagaccgaaaacgtcgtccgcatgttccgctcgctcgagggcgtggtgatgatcgagggggcgtccaggatgggcgatggcaagttcgagaagactatctacaccggatgctttagcgcgcgcacgggcaattattactacgcgatgtatggggatccgtcgattcgctacgtgagcctgatggatgccgagggcgcaagccccgataggctcgtggttcccgagccgcgtcgttcgtagccgttagctttactgcaatgcaaagcggccctgcgtctctcgtgaggtgcagggccgctgtcgttgatttatgacgtcgctagaagttggcgtcgttgagctgggtgctctcgagtccgtcgagttgctgttgctcgggcgtatcggcgacgctctcgagcagctcggtgggatcgacgttcatgctcttgccggcctcgttgccgttgaccaggtcgtccgagaagatgtcgacttccatttcctcggcctcttcaatctgaacctcgagcggcacctgggtgcgcacgagcttaacggccgggcgcatgcgggcaaacaacggcacgtactcgatgatgatggcagagttctcgagaccgtaccagcgcgccgggcttccgcaagcgcggcggacggcgtacttgatggccatcacgcggtggtcattgcggttgatgtccgtttcgggggcaagcatcttgcgcagcatgcaaaaacggaagtcgcccacgttgccgcgtgtctcgtagatggagtaggtgtgatgttgcggcggcaactcacccgatgccatcaggtcgccaacgatctggcgcaggtaggcgttgatgcgctgattgaccttaaagcccaggtccaagcgtacgcggaacaggaagtctgtgccaaaggtctcgacggaatactcgtgcgtatagggttcgtcggtaacgtgcacgttaatgaaccaatatgccttggcgcgcttgggatgcttatccaggatggaatagagcacgtcgcggtcgagtgtgagcgggtcggggctgttggtgagaaataccagattgtcggcgagcacgggataggtctcgtcgttgcgcaggcggttgagctggtcgatgtacttggagacgggcagcaaaatcgtctgcgtgcgctcgatggcggtgccgcggcgccacacgtacataaggccaaacagcagtgcggccaggaagatcatgacgtagccgccgtcaaagaacatggtgaggcacgaggcgaagaagcacagctcaatggcaccaaagagcagggcgaagacgcaggcacccagcctgtgcttgaggatgccggcgatgtagctcgtcaaaagcgtcgtggtcatgagcatggtcacggtaatggcgaggccgtaggcgctctccatgcgctcggagttttggaacagcagcacgatgaagatgcagccgacccacatgatgttattgacgagcggaatatagagctggcccttggtgtcgctggggtagtggatgcgcagatgcggcataaggttgagacgcgttgcctcggataccagcgagaacgagccggtgatgagcgcctgcgaggcaatgatggccgccacggccgaaagcacgatggcaaaggggcgcaggggctcggggagcatcatatagaacgggttgacgatatccatcgcgagcaactggggattggaattgttggcgagcagccaagcgccctgacccaggtagttaaggataagcgccgctttaacaaacggccaggatgcgtagatgttggccttgcccacgtggcccatgtctgaatagagcgcctcggcgccggtcgtcgacaggaagacaaagccgagcaccatgatacccgagtggttgatgggcgagaacaggaacatgacgccgcggatggggttaagcgcgcgcaagatggacaggttgccgagcatgttgaatagaccggcgcctgccaggaacaggaaccacagcgtcatgagcggaccgaacagcttgccgattgacgaggtgccagcgcgctgcatggcaaacaggccacagataatgatgatggtaataatgatgacgttagtttgcccgtcacccaacagcgcgtggccccactcgatggtgcgcagaccctcgatggccgtggtaaccgtgacggcgggggtgaggatgccgtcggcgagcagtgccgcaccgccgatcatggcggggagaatcagccacggtgccaccttgcgtaccaggctaaacagggcgaagatgccgccttcgttgtggttgtcggccttcatggcgattaccacgtacttgaccgtggtcacgagcgtcatggtccagatgacgagcgaaagcgcgcccaggatcatgtcctcgctgacggtaccgatgccgccgttgttggcgacgattgatttcatggtgtacatggggctcgtgccgatgtcgccatagacgacgccgagcgttacgagcagcatgccagcggagagggggatggctccgtgcccgccttgaccacgctggtcttgggggtttgcctccagtttgttgtgtgccacgtggactcccttagacatccggttgtctgtctaggacagataatctttatgccgtctttatacatacaagagcagtttggcacatcaggttattttagacaataatccccagctggggattatttatgtgcgcaggtagcatttcaaagcaggggcttttaagcgcgtgccgcttgggcgatgcttgctttggtgtctgcgcgtttgccggcgagttcgcaaaagagcgcgccgccgatgataagtgcggcacccatcaggcggaccggtgttatggtttcgcccaaaaggacggccgagaacacgacggccgaaagcggctcgaggtagccgacgacggcgacggtctgcacgggcagtttggcgacagcactaaagtagagcaggcagccaatgccggtgttgacaatgccgagcatggcaacggcgcgccaatcgatgccggcggcaatgctgggggagaggaacgagggggcaccctgcgtgaagagcgtaaggatcaacgcggttacaaaggcggcgctcacctggagcgcggagttctcgagaccctcgatgtgcggcgcacccttgctggcgatgaccatcagtgcatagcaaaatgccgaggcgatgccgcagacgatgcccgcaatgggcatgttgccgcctaaaccttgcgctgcaatgagaaaagcgccgcaggcgacggcgataaacccggcgattttgccaccggtcagcttttcgccaaagatgagcggggagagcgccatgacaatgatagggccgcagtagtacagcagcgaggatatgccgacgccgatcgtctggtaggcgcggaacagaaaaatccagctggcgcccagtgcggctcccgagaggaggagggctgcggcttcgcgggggcgagatggcgcctgcaacttatggcgttgcgtagtgacgagtatgacaacgagtgagagcgcgcccaaaaacgtgcgcaagagcacgatatcggagctcggcagcgcgatggcagcggcgatgatgccgttggagccaaacaatagcaatgctgctaagtacgtaaacagtccgttgttcatgcgctgacatcccctctatatccgagcatgttcactatgggtgaactggctttagaagaaaagcgaatataatgcatggataacatgacaaagactcatgcaaaggtggaggggtgccgtggaaacgaatattcaaaagatgcaggtgctgctcgagaccgtgcgtgccggcagttttacgcgcgccgccgagcgcctgagctattcgcagtcgggcgtgagccgtatggtggccgatctcgaggccgactggggctttaaagtgctcgatagaagccgcgagggcgtagtgctttctgccgatgggcggcaaattatgccggcggtcgaggcgttatgcgaggaatttgttcgtttgcagcgacgggtggatgagatgcgtgggctcatgcgcggcaaaatctgcatcggtacgttttcgagtgtggcgacccacgtgctgccgccggtgattgcgcgctttcgtgccgattacccggatgtcgattacgagctactgatgggcgattactcggagattgagcaatgggtggcggaagggcgctgcgacctgggctttatcccgcgtgagccacgagaaaacggcatggcatcgcggtctttggtgcgtgatgagctgatggcggtggtgccagcagattcgttgcttgccgcggcggaggtcgtctctcttgtcgatttggcaaacgagcagtttattctgctggaacgaggtaccgatgacgagattacgccgctgttccgtcaggcggggctgacggcgcgctccaagctgtcgacctgggatgactatgcgattatggctatggtcgaggacggcctgggcgtgagcattcttccggcgctcatcttgcgtcgctgccagttcgatgttgccgtgcgtccgctcgaagggcatccccatcggcagatcaacgccatatatcgaacggccgatgtttcgcttgccgccgctcgattccttgaatacctctaaatgagcgcacaccgttgtcgctttgggataaatctcgaggtttggctcattttatttttgaaattgaactttcgaatgaggtgccgcgttatactgctgcctaaattgaaccttggttcaattcgtattctataaattgaactttgccagcaaggaggttctagtggcccaagagacgtttagcgatcgcctgcgacagactatgtccgatcgcgacgttcgccagtcggacgtaatccgcgcatcggagatgctcggcaaaaaactcggcaagagtcagatgagccaatatgtgagcggcaagacgatcccgcggcgcgatgtggctgagctgctcgcccgtattttggaggtcgatgttacctggctgcttgccggcgacgccgatcaaggcgaggcatcatcaccccgcaacgattccaagcccgaaccccatccctcagctcaaattgcaaggagcaccaccatgcgtactttttctaaatccaccaagctcgataacgtcctgtatgacgtgcgcggtcccgtcgtcgacgaggccgcccgtatggaggacgagggcgagcgcatcctcaagctcaatatcggtaacccggcgcccttcggtttccgcacgcccgatgaggtcatcaaggacatgcgccagcagctgcccgactgcgaaggctattccaattcgcgcggcctgttctccgcgcgcaaggcgatcatgcagtattcgcagatcaagggcctgcccaatgttcagatggagcatatctacacgggcaacggcgtgtccgagctcattcagctttcgatgaacgcgctgctcgacaatggcgacgagattctgatccccagccccgactatccgctctggacggcgtgcgcaacccttgctggcggtcatcccgtgcactatctatgcgatgagcaggcggattggtatcccgacctggaggatatggagtccaagatcacgagcgcgaccaaggccctcgtcatcatcaaccccaacaaccccacgggctctgtctatccgcgcgaggtgctcgagggcatcgtcgaggttgcgcgcaggcatcagctgatgatctttgccgatgagatctacgaccgcctgtgcatggacggctacgagcacgtctcgattgcctcgctcgcccccgatctgccctgcgttacctttagcggcctgtccaagtcgcacatgattgcgggctatcgcattggctggatggtgctttcgggcaaccagcgctgcatgagcgacttcatcatgggcatcaacatgctctccaacatgcgcctgtgctccaacgtgccggctcagtcgatcgttcagacggcactcggtggccatcagtccgtcaacgactatatccgtcccggcggtcgtgtttacgagcagcgcaactttgtgtatgaggcgctcaacaagattgacggcatctcggtggttaagccgcgtgcggcgttctatatcttccccaagatggatgttaagaagttcaacatcaccgatgacgagcagtttgccctcgacctgctgcacgagaagaagatcctgatcacgcgtggcggcggcttcaactgggctgagcccgaccacttccgcatcgtctacctgccgcgcatggaagtgctcaaagagtccctcgaagacctggccgacttcttcgaccattatcgtcagtcgtaggggacagaagctccgtacgataaaaagctccctgcagttgcttggctgcagggagcttttttgtggacccgtggggcgtgggacaaaataatcagtagttcttgtcccaggttcgaaagaagtatcgaacttgttgccgtaggcgaccctgggacaaaaactactgattattttgtcccacgtggcgttcttgaactaaataacaatcccgttgcaatggtcgatttcgtgttggatgatctcggcggtgtagcccgagaagtttttgatgcggtggacgaagttctcgtccagatactccaccttaatgcggcgataacgggtacaggggcgctctccaaccagcgaaaggcatccttcgctcgtctgataggcattgacctgctcaagaatttgagggttgtacatcaggagcgccctgttgccgtcctttacgcagatgatgcgtttgcgcacgccaatcatattggcggcgaggcccacgcactcgtgctcatgctcatggagcgtatccaggaggtcctgcccggtcacggcgtcatcggggcccgcgtcttcggaaggcaggcgcaaaaagaactcggatttcatgatgggtttgatcatggcgggctccttatggtgggcgtttgattcaaatcatgataccgcgacatgtcgcattaatgtgtgcacatagattctgcagctagattgacggacgacaccataaactaatggacgttttgccgagaggcatgatttataagcgcaaagagtgcgcgacgggccccgcgaatggggcgatgatgcccgagagggccaagaaggagtctcatgtctgagaacgaagagatcatgaacgagaccgagaacgagaccatggctgccgaggttgaggcagtcgagaccgtggagaccgaagctgccgaggttgaggctgctgacgaggtttccgccgaggaggaggccgaggttgtcgaggccgccgctgattacgatgacgaagagctgatggacaagatgcagaaggccgcccgcctgctgcgcagccgtcgctttgctatttccaaggaggaggaggccaaggccgagcgcatggcgaacatcgagcgcgccatcaagctccttgacctcaagcccaagatggagcagaaggagatgtccgacctgctgggcatgcgccttcgtgagctcgatggcctgatggccgaggccgaggctgccgacctggtcggtcgcatcgacgacgccgagggcgacatgcgcaagatcgtcgtcttcgctgctgaggatgctgccgagggcctgaccgagcttgccaacaagaaggagaagctcctgcccgagctttcttacgaggaggccaccgagctgatggctgccctcgataaggttatcgctccgctcgtcgccatgggcctggacgaggaccgcggtcctcgcggcggtcgtgacgatcgcggtggccgcggcggcgaccgtggcggtcgcggcggctttggcgatcgcggtggccgcggcggcgaccgtggcggtcgcggtggcgaccgcggtggccgtggcggctttggtgaccgtggtggcgaccgtggtggtcgcggcggcttcggcggcaaccgtggtggctatggcgaccgcggtggcaaccgtggcggctttggcggtaaccgtggtaacgaccgcggcggtcgcggtggcgatcgtggcggccgcaacggcggcggcttccgcggcaaccgtttctaggggttacgcggttttaccaaaccgcgtaaccggttgacgctgcgcgcccaccagagcgacaacttgtcattcaaagaggacggcatgaccagaaggtctatgccgtcctcttttcatgccaatttgttcgctctggcgggcgctcgctggcgtttgctcaacatgcgacgccttcttgtttcaaggcaccttgctcgctctggcgggttttcgctcatatgacccaatccgctgtcaagagccacaatggccccgccgaccgctccctcccgtctcctgcgcccctcccggaactgtccacatcagtgtagccaatccaccagttgcccttcctgcggccggtgggcgtcctctcgtcgaagacgagcccgtgcctgagcaggaacttggagagccgctgcttcgagcgcgagaggtcgtccctcgcgtcctcgagcgccctagtcaggtcgcgggcggcctcgcactcgtcgtcggggacccacacctcgaccacgttgccgaccgacagcatgcgggcgaggaactcggcgtcgttgcggtcgttcttcctgcgcctgtccgcgctgggcttgatcatcttcgagacggcgccgaccacgcagtcgaccccaaggccggagagcctcttctgcaggtcgaatcccgtgaccccggactcgtacacgcacctggccttagggtccacggagcggacccaccccgcgacggcgccggcgtcgtagccgaaggtcgcgcagcgcacctccccggtcatgacgtcgagggagacggcctttatcgaacgggcgtggacgtcgaggccgacgaaggtggtagtatcgagcatgggagccccttccatgaatgcggcgtggctgccgcggctgaattagacactcaccattgtcggcctaatccgcggtctttcatgcagcaggggctctcaatgtttttatgtcctgctcatatcgtctgtgccggcaggtggggacactcctttgctagaagatccggcgcaggtctccgcggttgagggcttcgtcgaagaggtgcttgaacaccacgctgccgtgcagaccgtcgtgctcgaactcgttggtcacccaggcatgcgagtcgcccacgcggctgagcgtatcgagctgcaagcccgaatcgacgtacatgtcgtcgaaatacaccgcggcctggagcggcacctcgttgcacgccagtcgctgcgggtcgtagatcttgtcccagctggtgtcttccatcagcaggtccatggcgggtttgaagggcttgagctcgggcatctgctcgaacatccacgggaacattgcctcgccggtaaacatgagcgggcgcgcgagggtgtcgaactcggcgcggtgtgccttctcttcggccgcggcccaaccaatgggcatagtgtcgccgtcggcgtagatgaactcctgcagtgtccagtacagcgggtttgtacgcgtgttggtgcgctcgaaggcgcgcatcaaaaagctgtcagataccgaggcgccgcaggccagcgtgccgtcgccgtcggcaaaagcgtgatcgacaatccaatgcatgcgctcaaagctcggcttcataccaaagtcgctgcccatgagctgtaggcgctcgaccgtcatcggtgagccgtcgggcagcacgggcttctgggcctcgagcgcatcggccagtgccgccacgcgctcgacgtcggcggggtagcggtcgtaatactgctgagtcttggccgccatgcgcgggaaggtgtgcgcgtagacctcgcttgcgctcgctggcacatgtggaatgccgccgcaggtaaagctcgccgccacgccttcggggaagagcgacagatagctcaacgtcaaaaagccgccgtagctctgcccgagtgtgacccagggcttgccgccaaagcccaccaggcgcaggtactcaaaatcgcgcacgatggagctggcgaggtggcgcttgaggaagtcagcctgcgagcgtgcggcatcggagccggccgccgtcgcgcgctcgcccagtgcggcaatcgtgcgcccgtccacgcagcaactgcgtccggtgccgcgctggtcgggaaggaccacgcggaagtgcttgacggcctcctcgatccagccgtcgcttgtgggcgacagcggacgcgggctctcgccgccggggccgccctgcaaaaacaggagcagcggcagatcgtcgttgatgcggtcgggcgcgcaaaccacgcggtagaagagcttgatgctctcgggcgcgccggcgattggtgccggcatggcgccgcggcgcatggtgctgccgacggccaggagcatcggctccaggccgcgccagtcaagggggacgtcgatgctgtggtcctcgacgtaaaggctggggacgtggtacgaagtgatgagggccatgtgagtcttccgttcgttgcggtgtttcgggttgaccaattctaccgccgcgggcgaggccatgcgcaaatcggctaccatggttgcaaacttctaggagaaagggccgcccatgtcggtcgatatagccacgtatgtccacgatcttgccgttgccgccaaggcagcgtcggcctcgcttgccacggcgagcgatgagcagcgtcaggaggccgtgcgcgccatggccgcagcactgcgcaacggtgtcgactccatcgtcgccgctaacgagctcgatatgtccgccgcgtgcgatgcgggcacttcagccggtctgctcgaccgtctgctgctgacgcctgagcgcgtcgagggcatggccgccggtttggagaagctcgccgagctgcccgatcccgtcggccgcgtgctcgaccaccgcgtgcttgcgagcggtgtggacctgacccgcgtgagcgtgccgttgggcctggtcgccatggtctacgaggcgcgccccaacgtgacggccgacgccgcaggcatctgcatccgtaccggcaacgcctgcattctacgcggcggctcgctggcctatcactcgtgtgccatgatcgccgagctgctggccgatgcgctcgaggccaagggcttcccgcgcgaggccgtgtcgatgatcgagtccaccgaccgcgaggccaccggcgagctcatgaagctccgcggtattgtcgacgtactcattccgcgcggaggtgcaggcctgatccagcgctgcgtgcgcgagtcgcttgtgccggtgatcgagacgggcacgggcaactgccacatctacgtgcatgaatccgccgactttgataaggcgctcaacattatcgttaatgccaagacccagcgcgtaggcgtgtgcaatgccgccgagtcgctgctggtcgaccgtgctgtggccgatgcgtttttgcctgcggtcgttgctgtattgcacgaccacggcgtgctcattcacggcgacgaggccacgtgcgccgcatgcgccgacgccgggcttgccgagggcgacaactacgtcgccgcgactgaggaggactggggtcgcgagtacctggcgctcgagatgagcgtgaaggtcgtggcaaacgaggacgaggccatcgcacacatcaaccgctacggcacgatgcactccgaggccatcgttgccgaggatacggatgcttgcgagcgcttcctggatgcggtcgatgcctcggccgtgtactccaacgccagcactcgcttcactgacggcggcgagtttggcctgggcgccgagatcggcatctcgacccaaaagctccacgcccgtggcccctttgccgccgaggccctcaccacctacaaatacaagctccgcggcaccggccaggtccgcccctaaacccctcgtaaacgaaaaccaccacaaaggcgcctgtccccttcgtggtggttttaggtggcgtgggcggttaggcctggaaggtatcgcggtcgggggcgaaggactgcatggccgcgatggtgcggtcaaagagctcggggagctcccagcccaacatctcggcgccctgcgaaatcacgtcgcgcgagcagccggcggcaaagcgcttgtccttgaacttcttcttgagcgacttggtcgtaaagtccataacgctcttgctcgggcgcatgatgactgcagcgccgatcaggccggtgagctcatcgcaggcaaacaggatcttttccatctgcagctcgggtttgggcagcgaggtattaaagtcggacgtgtgcgtctggatggcgcgaatgagctcgggagacgcaccttcgcccttaagaatctcggcagcatagatggtgtggttcatggggtcgtcctcatgctcctcccaatccaggtcgtgcagcaggccgacgatgccccaaaactcctcgttctcggggtcgaactcgcgcgcaaagtagcgcatagtgccctcgactgtctcgccatgggtgatgtggaacgggtccttgttgtgctcgttgagcagttcgaacgcgcggtcgcgggtgattccggcggtaagcggctctgccataggagactccttgtgctcgtgggtatcgataagaatgaatactactagaacaagaaaaccaccacaaaggtgcctgtcccctttgtggtggtttttggcgcggatgggttagttgagggcggcttgggctaggcgggcttcagcgtcctcctcggtgacgccaagggccacggcgaactcctcgatggagcggcgcttggcttccttgagtacgcgcatgtagtaggagctgggctttttatcagctttctcggcctggcgaatgcggtgcatcatggtttttgccacgcggaccgtctcgggcgcgcccagcttgagctgctgtttaaagtgcgtctcctcaagtgagctgttgcgctcggtaaaggtgtcgcactccagctcgtcgtagtggctcagcaggtgctcggcatcttgttgagagatggcggcgtgcaaacggtcggcctgcgctacggggtacatgaggatcgtctgcgcatgtccctgcttggtctcgagcagcagcatgggctgcggcgtgtcgtccctaaaaccgacgacggtgcagactccctggcccggatgaatgacgtgttgaccgattgagaacatgctacctccaacttatacgaatttacgtatgactagaataacacgctgacgtgcgcaaacccttactttatgcaggaaaagcacacaactccgataggtaagagtattcgataacagacgcagctcattcacacctttatgcattttcaacgcttgcataatctgcaggcagaccggcatctttgagtgactccatacaagctgtagtcaattttgtgcatatgcaatatctattagctttaccctgcgacagtgcccgtcgcttgtgatagagtgctacaaactctggcttttgccctacgagtgaccaagagctcgggggctttaacacaaggaggatctatgcccgagaagattgaagagctggtacgcgctgcgcttgctgcggcccaggaggccggcgacctttccgcatttgaacttgacgattgcgctatcgagcgaccggctgacacttctcatggcgagtggacctctaccatggccctgaagtccgccaagctggcccactgcgccccgcgcaagatcgccgaggccatcgttgcccatatgcccgaggaccccgcgatcgagaaggtcgagatcgcaggccccggcttcatcaacttctacctctccgttgccgtcaagaatgccatctttggcgaggctcgcgagaagggcatggacttcgctaagtccaacgtcggtggtggcctgaagacccaggtcgagttcgtttccgccaaccccgtcggccccatgcacatcggccacggccgctgggccgcgctgggcgactcgctctgccgtgtgatggaccacgccggttacgacatccagcgtgagttctacatcaacgaccacggctctcagatgaacaccttcggcaactccatcagcacgcgctatatgcagcttgccgacatcatcgccaagcagggcgtggatatcgacgaggctcacaagctactgatcgccgaccgtgacgcctttgttgccgacgagaacgacgagcaccccgagacccatccgtatcaggacaactttgccgagaccctgggcaaggactcctatggcggcgactacatcatcgacgaggctgccgagttctggcgcaccgacggcgataagtgggtcgacgccgacccgcaggagcgtatggagagcttccgcgagcgcggctatgtgaagatggtcgacaacatgcgcgacctctgccacgccgtcaattgcgacttcgatcgttggtactccgagcgttcgctgtatgtgaaggacaccgagggtgagaccgccggcacctccgccgtcgaccgcgcttttgagaagctcgacaagatgggctacctctacaccaaggacggcgccctgtggttccgctccaccgacctgggcgatgacaaggaccgcgtcctgatcaagtccgacggcgagtacacctacttcgcctccgacgttgcctatcactgggataagttccagcgcgtcgaccacgtcatcgacatctggggtgccgaccaccacggctacatcgagcgcgtccgctgcgtctgcgacgcccttggctatcccggcaagtttgaggttctgctgggccagctcgtcaacctgctgcgtaacggcaagcccgtccgaatgtccaagcgcaagggcaccatggtgaccctgcaggagctcgtcgacgaggtcggctccgatgccgctcgctacacgctcatctccaagagctccaaccagatggtcgacttcgatattgaggccgttaagaagcgcgacaactccaacccggtctattacgtgcagtatgctcacgcccgcgtgtgctccatcctgcgccgtgccgccgacgttacgcccgagcaggctgacgagatgggcatgaaggccgtcgccgagaaggccatcggcgagaacgtcgattactcgctgctgaccgacccgaccgagcttgccctttcgcgtaagctcaacgagctcaccgacctcatcgccagctgcgctcgcgaccgcgccccgttccgtctgacgcactttgccgaggagcttgccggcgacttccacagcttctacgctgcctgccaggtgctgccgagcgagggccgtcccgtcgaccccgagctttcgcgtgcccgtctggccgcttgcgatgccgtccgcgtgacgctcgccctggtgctcacccttgttggtgtctccgctcccgagcagatgtaagctgcgggtcatttaaccgtgtaggttcggctttgctgagccctataagcccgatctccatgcggaggtcgggctttttgcaaacgccgacgtattgacgaatttggaactgctggaaatacgaaactatgccggtttactacgatgaatatgagaaattccaaccacgccggcttttcgcaaaaaagtgcagggcatctacctgcggttttagttcaacaagtttcggagtggtcgcggttgagcgattcatcgtagtaaaccgccatagttttggcggaggcagtcagatttgtgggcggtaaaccaaagagtgccccttttgactagtcgtttaagagcgttcccaatgactaagttgcaggtggttgcggttgtgttacactaacgctgcgtatatgacgcaatcatctcgatacagatcaatgatgtccgtcgttttgaacggaactagactgtttagccgccctgaaggtttatgcagggagcatgtgatcacagggcttgaaaagaaagttgagcaaacactgtgtctgatcaacagcaagaaaacgaaataacgacgacgcaagccgctcccgctgcactggttgcgtcggaccaggtcgcggcgcccgcgcatgcctcggctcctgagacgcctaaggctgcttcgacgcctacgcctgcaacggctgagaaggccgtgcctgcaactggtgaggaggctgctccggcaaagcccaagcgtacgcgccgcacggccaagcctgctgctgacggcgaggaggtcaccaagcccaagcgccgtaccacgcgcacgacgcgcgtcaagcgcaccgttgcagctgactcctcggcgccgatttccgatgaggtcgcgcaggcacgtgcgttggcgcagattagcgaggctcaggtggtgcgcgcccgccgtcgtgctgccgagcgcgaggccgcggctctgaccgagcttgcagctccgtctgtgcccgagacgcctgccgccaccgagacccctgtcgccgaccagccgaccgagaagccggtaccgcgcacacgccgtcgcacggctgctaaggccgagcaggttgccgatcaggtaacccccgagctcactgaggcttcggtccgttccgcggcaggggagggcacatcgcctgttgagcccgctgcgcctgtcgaggccagcgaagttcccgttgtcgatccggctttgcgcccgcaccgtcgcggtcgcaagcccaaggccttcgtcgaggcagagaaggccgcagccgcagctgcagccgctcgtgctgctgcggcgaccgccgagtctgcaaccgccgccgacgcgcccgtccaggatgctacgacttccgaggccgctcccgccgatgtccgtcctggtcgcagccatcgtactgctgctaagcgcacgtccaaggccaaggctgccaagaagggtgcgtccgaggattccggcgagacgaccgccgatgcatcgattgatgccgccgagcctcaggacgtcgaacggcctgcgtccgagaagcccaagcgcggtcgtaagaagtccgctaaggccaaggcgtccgagcagcaggctgatgtcgaagcgcaagtcgattccggcgccgagggcaatgacgccgctgcggccaatgccgacgccgccgcaaccgatggcgccgcgcccgccgaggccgaagacggcgctcgccccaaccgtcgccagcacaagcgcaacgacgagcgcaatgagcgcaaggacgagcgcaacaacgaccgtcgcaaccgccagcgcgatcgcaaccagcgcaacaaggagcgcaacgccgcccccaccgagcccacgctttcgcgtgaggagcnnnnnnnnnntcgagatcgagacgaccggcaagaagaaagccgagctcgtcgaggaaatctacgtcaccgccgcgaaggccgagggcttccgcgacatcaagggcatcctgcagattcgtccggacagctccggtatcatccatgcccacggttacatgaagtccaacgacgacgccttcgtccccgcctacctcatccgctccgcgcgtctgcgcacgggcgacgtcatcgagggctcgcttcgtccttcgcgcggcggcgacaagcgcgccggcctcgccaaaatcacgaccgtcaacggtctagaccccgagcagattcgcaaccgccccaagttcggtgacctcaccccggtctatcccaacgagccgctgcgcatggagcatggcaaggactccattaccggtcgcgccatcgacatcgtgtcgccgatcggcaagggtcagcgtggcctgatcgtgtccccgcccaaggccggcaagaccacaatcctcaagaagatctgccagtctatctcgattaacaaccccgaggtgcacctcatctgcctgctcgtcgacgagcgccccgaagaggttaccgatatgcagcgttccatcaagggcgaggttgtggcgtcgaccttcgatatgcccgccgacaaccacactcgtgtggcagagctcgtcatcgagcgcgccaagcgcatcgtggagctgggcggcgatgtcgtggtggtgctcgactccatcacgcgtcttgcccgcgcctacaacttggcggcgcccgcctcaggccgcatcctttcgggcggcgtcgattcggcggccctgtatccgcccaagcgcttcctgggcgcagcccgtaatatcgagaacggtggctcgctcaccatcctggcctctgccctcatcgacaccggttccaagatggacgaggtcatctttgaggagttcaagggcaccggcaacatggagcttaagctcgaccgcgacctagccgatcgccgcatcttcccggctatcgaccccgttgcctccggtacgcgtaacgaggacctgttggtcgacgagcagatgcgtccgtttgtctttggtctacgtcgcattcttgccggcatgaacaacaccgagcgcgcggccgcatcgtttatcaagggtctcaagggcaccaacaccaaccaggagttcctggtgcgttcggccaaaaagcacagcgactacgagcagacgttctaggttgtaatccacacgcagcgttaatcatcaatgcgataaagggtcggggctttgagcctcggcccttttctatatcgccgcttcgcacttatttttgaccataagacttgcaagcagcaggtttcccgtttcaatccgacatcgtcgcttgcaatcgacagggcggtttcgcataatggcttttaagcttcgcgacggaaaacgcagatgaaacgaaccatataccgttgctttggggcatagccccgcttcatcttctctcgcgcagccaactgaatgatgcgatttgggtgctggaagatggggagagctcatggcttcttctgatgcaacacaacgagcagtccttgccggactttcgtgcgggatcggccttgccgctcccgtggttatgtatgccgcgacgctgccgttttcgtcggtgaacgagacggtcgtggcgggtgcggttcccttcgccgtgggcgcagtggcgggcgtgggtatctatgccgcctcgctgggtatctccgagtatcgtgcgcagcgtgaagagcgtctgttccagcccgatgccatgggcggtgccgccaatctcaatcagcatcaaagcgagttcaagaccgcctcgattccagctcagcagcaggatgcgactccttacgctgcggcttctgcttctcaggctcaggcggagcagtctacctcggcattcctttccggcctgactggtgcgttccagcgccgtcatgccgatgatggtgtccctaccatcgctcgagctgcagatgctatggacgaggacgaggcttggtccatgatcgacagtatgctcgacgacgattcgccggtgagctgcgaccctgcacactcgcgcgacgtctatcaagtcgccatcgacgagctcaccaacggcgggcagaccgactccttcaatcgcgacgacatcgccgccgcggcacgcgccgtgtctggctcccaggccgcccctgcgggcagcacggcggctttcgtggcgctcgtcgccaacgcggcagccaataacgcctacagcgctacctcggcggacgcgagcgcttctgccgacaattcgtacgttgatgaagccatggccgcggacgaggaggccgttgccgcccgccgtgccgccgaaagctcgctttggggcgctcctgcccagcagcaggcggctgaggctgcgccgtacaacgcaaacctcgccagcatgcctatcatctccggtgccgcggacatcgatctcgatgacctcgatgagcctgcagccatcaccgcatcgattgatgcccaagatcgcatcgacaccggcgaccttccggacgcctcgctcgaggttgatgtccccatggccgattactcgggccacgaggacatgtgggccgccgccaccgcgattctggatgagattgacgagcctgctcctgttgcagtccccgctcccgtcgctgcccctcagcctgctgcccccgcctatgtcggccgtcacagcgctgtgttccccgaggatactgcccgcatctcgcgcgagagcatcgagcgggccgaggctattgccgccggcattatggaaaatcgtcgtcacgagcgcgtcaatcagatcctcgaggaagagatcgagcgcctgcagtcctctaccgccaagcgtacgggccgtgcctatttgagcgttatcgagggcggtaccgccagcttcgcgccgctccgcgcggaggcataacttctgcatggttaagatcaatcgaaaatgggcggttgtaacctgcctgatggcgctcttgatctggggcaattcgctggttcccggctcggggtcgggctcgctgagcctgacggtcatggaagctatccgcggtttcctgcacggcgtgggacttccatatgaatgggtgaccaactttgttgttcgcaagtgcgcgcattttaccgagtatatggtgctcggcatcttggcaacgcacgcctttgattttgagggccggcgcacctttgacgtgctgctgcccacggcggtgttcctgctgctgattccctcgatcgacgaaacgattcagctctttgtgccgggacgcgccggcatgatcaccgatgtgatgatcgactgctgtggagctgcaacgggcgttgtgctccgatatctcttacggtcgctgatgtacgccaaaaaagccgcctaggacgtattgtttggtcctaggcggccttttttaggcttataggacaaaatgtgtgtccacgttgggggcatcggcgcaggtcgatgcccgggattggtcaaaatagtttgactattagcggctaaaatcgcccggcgctaacaacgctaaagcctaaatgagtgtcggttgttgtgccggtatccgaagccccttcccagcgaatagtggagcgcaatcccgagtggtgattacaacaacctggcgaagcaacagcgataatcggggtcttgaggacatcggttacgaaaggggcttgggatagggtccgccagccgtcatcggagctgggtaggcgcgggtagaggtcatgcacctgcggtgggcagcgccagtagcggaatgcggtgtttgcgcagacgatttcgtccatgtggcctcccctggtttcgaccgtaggccgtgcggattgcgggcatggccgattatctgccggggcatcatgcgggtaagtacgggaagcaaaccaaatgctgacaaaagcatgccgagttccgccgaaaaaccgtcgtgtgatagaaaaccgctggaaggagctttgggcatgtggtccctgtctccacatttgcgcgcggatcacatggggaattcaatgaaaatacgcatgcgtttttcttaaaacatgcaatggcgtcagcaaaaagggtgcgaaaaaaatgacgccttatacgactacgattcgttttggagtcagccttggtgtcaaaaagaaaaaggccagaggcttaacacctctgacctgtactttagatggtgggcgatacaagattcgaacttgtgaccccatccgtgtgaaggatatgctctacccctgagccaatcgcccgtcgcctttcggcaaaagagatactatcatagccgcgcgtggtttaccaagaactttttgcccccgattttaaattcgtgggcgcaagcagcactgtttcaaccctgtcagccaacaaaaccgcagctaaaccaccatttaccgctttatccacgaagtctcggggcggcagataagtcgcgcgttgttgtacgccatgtcgagcgtgaggcacgtgcgcacggcatagaagccatcctcgcgctggatggtcagcgccagctcgggcttgtcgccggttaggcacagcggcagcagcagctggattcggcctccgtaaaactgtggcacagcgagcgtgtaattggcggcggcgcgtcgggcggcttcgacgacggcgccctcaaaggcgcgacgcagcagcaacgagttaccctcccccatcagactggcgggaatacgcgtcaggttctcctcatcgcccagaatgtggtcgatgttggagcggatgggaaggcggtagtcaaagacaagctcggaggggtcctcggcaaagcgcacgcggcacggcaggtactcaaacgagaccagcatggggtcgctctccttaaagaagcccttcaaaaaccagcgctggcgcgcgtcgggcttggtgttgggctcaaacaggccgtagatggtctcgtagcggcgcgtgtacaggccggtgttaaacaggcatcggtcgtcgtcgaacaccagcggcaggttggacggcgcggtctggtccacgtcgcgctcggtcaaaaatactgcgtggctaaacgaaaacgacaggtagttcttgagaatgcggttgcagggaccccagtcctcgggatcggcgaggtcggccaagcgctcgtaacagggctcggggcaaaacgcgaagtcgtacacattgctgcacagggtgctggggatctccatatggcttccaatcaagataatgacaggcgtgtggatgctttgattttatacgtgcgacgggtagcccgtgtccacaacgcaaccgcggcgcagctcgtcggcgagttctgctcgcgtgcggtttccggaaacaaggtcctggatccaggcgtagtgctggttgtctttgggttccgggctatcggaaagtacgactggagcaccagcggcgtaacgggaaggacccgcccgtcgacatcggcaatcatgagttgacaagtgtaatcatggctcaattgcggtttagcaatagaatgtcagggaatcatcaccaaaggtttcgcgccacttgtcacaaatgtatcgatggttcatggtgattagttttgaaagatccctgagatccttagccggaatcttgctctcgttgttcgcaagtgtgcatccgccatttttagtgagccaaaacttagtcgagttagcagccgccctctttacccctacatggatgtgaacgggttctccgttttccgcgatccaaaagaacagaacatactgtccaaaaacaagaattcgaggcattatgccaccgccggtccagctttttgccgttctgcaagctcgaagataaacggagcgtttgatctaacgaactcggtcaaaaaatccagttcgtcagtagaaaatccttcgacgttaaaccatttgaccgcaggtagaaagcattctgcatggtcaaaaccaaaatcaaccgggcgctcgacggctacgcgaacggtcccgtcgtctcgtgtttctgagtaggcaaactgagtgccgtcatctagctgaacatagctccaaagcattgctgcctccttagtgtttatatccaagtataaacagccgcttagatgcaacgtgatgcgaattgaattattcccataagacctgaactgctgattatttgtattactgagatttaagctatttcacacttcagtgtctttttgacatgataaccgtcgcggtgcgttgatcatggggttagcaataaaagcctagcataagcagagttcatcacttcgttcgctgtcctagataaattctcccgtctccaggtcaacgaagtccgcgagctttatctttccgcagaagccgctgcccttgtactttcctgcataggtctcagagtcgaacttgaacgaaatgttataaagctttccggtctttgtcttcctgatcagcccgttttccagcatgtagctcagtaccctcttatggctttctctatcgttgccgtttaggtaaaagcaacagacaccttgtttcgatcctgccgcgatgagcgtttcgggattcgagtatttggcttctacgacgacgccatcaaatactgcggttccgacaatgtcgtccatgagggctgttttgaatggagagaagaagaacatccatttgccgcattggacgggatctatgtcgtggattcgttccttattgataaatcaaatccatgagaacgatttgaccctggcaatcgagccggattcgttaagaagcgtttcttcgacggacggcgttaatttctcgttgttgcttgtgttatttgaacttgccatttcatttatcctaacattcgtcctcaatatagctcctcgccagcagcctcgagcgcttgtatcgctgtgcgtttgggctcattgagactttcgtagccgctttctgacagcgggataatgcgcacgctgaatgagtcgccgtacttgtagtcggcatacacatcgcaattgcccctaccgagaaactgtatggccgcccggtcaatcgcttttgcgctttggcctacgtagtacagatctttggttgcattatggacaatgaagatgccagtaatttcgccttgctgtgtcagggactttcgctgagccatgaactcttcggcgcttgcaacgatttgaggatcatcttctatttgaggatcatcttctaggagcgattggcgtagcctcagtagtttttcttgttgcttcgatgctgtaataacaagaaggagcccgtccacaaaaaagaacaagccaaagagcaagaaaagaaagcgaaccatatatgttggcactcgatgacagagcggaaaagagactgacaattaccaatacaagaccagtagcgctgatgacttttccgatcgggatgagcctccttggaggggccgatgcgacggttttgatttgatagtagttcctcatagtatgactccagtgatataggcaattgaatccaaatggagctttataaacggcagtatttgaattgcaattatcttatcgctctggcagatggggtataaggctcaacatcggtaatagatcgagaggcagtcgagctgaacataatagtgccgtcgcagcgatagctgatacggcaccaatctctaagaatttgatttagtagaaggctaaagacttctgcaatggctgcattcacttctcccctggtctcactaaacggggaattagcagcgttatacggcagccaggagcgctgttccaagaaggaaaagcattaaggaagcggctatccagttgttgtctgcgggcttagggatcgtcgctacggtcgcagtggcggctctttgcttggaggacgcgggcagcgtagtcttgatcgttatgtttgtcttgggcgacgtagccgttaagctccaggtggtcggcttcggtccagacccagccgaggctcgacgcactgagagcctggccccggctgccaagcggggaaagaagggacgctttgtggccttcacatagcgtcccttcctcaaattatcgtgtgaatatgatttaagcatacggcggagcctgaatccactatgctccaacttggctacaaatcataattctgcaacgtagaatacttgataagcgattgatagcgcggatgtcccgatcgaacagcccgcttgtaaagcttgatatatttttcaaatcccttttgaactgcgaattcatttccgcgaagagcttcatattcgttctggcgcaagtgtggacgcacctgttgatctatatattctggcttgtctacatcgacggctttcgaataatcaatcccgcatttgttttcggcatcggtaaagaatgcgtgcccatggcgaatatgcgagcgaaatggtagggcccacgtatgtccctcgatttcgaccaaaaagacgatgtaaggacgattttgcttttgttccatctctttgaacggcgggtttggatgatctttgtagaacgagtttgtcaaaaagacgattttagaattcatgcagaccctccgaaaaagaaaatgcctccaacccaaagagattgaaggcatcttctcagtgggctttcttttgattccgttggtcgcgccctacgaccaaaatcttctcggtgggctttcttttgattccgttggtcgcgccctacgaccaatttctgatttaagtatacccaagttataaaggaaatgagtgaggtttcgaaaaatgaacgtggcagaattaggcagagtcaaataacgaatgcctcgtgttatttcttacccttcgttcggaagcagaagcttggtatatatctggaagacagtaaggagaaataggtcttccatggtctcgattctctcgccatcgaaaccgcctgggcatccgtagtacctattgttggcctcgtcaccagagccgtaggttgccgcgtagaatgcaacggtcgacgcgaatcggcaggcctctatctcagagctcgattcgaattgatactcattttttagatgggaaataggggtgaaggaagcgtccctcgactcgaaggcctcggaaaggactttacggataagatgatcgtactccagggtacagctatcagggggcaggaacgaagagtccaagcactcaggaagaaggtcaacccgaagtgctggcagtctctcccccgcatacctttccaggctgcgaagcacgtatttcccatcatcataaagaacagattcatcttctgggaagcggtcacggagggcggcttcgactgcggtgatgcaacggacgaacaggtcatcctctcccctgacccgcaagtcaagattgcagaattcaagaatcagattctgaacctccggcacgagacaacagaattcccaatacatcttgcgtgaataatggaaaagatcattgtgcatggcggcaacggcgcaaagcggaatcaggcctctgtctgcgtaatgcttcgagatgaactcaatcgcctgcgccttattcccttcggcgtgtctgcgttcgtctctttcgtcctggcgacgctcgagttcttccatgcgcttactctggcaagactgtttcttgccaatgatgactgttacaaataaagagataaacgcgcatattaattcagccaattcgttccacttcacaagaaactcctacaatacttaatggtgttgcaattctatataccaagcaattctacgcatgggacgtagacctcgactgcatcagccggatatacgcaaaagaggggttagaccatactgatcgcaccaaaaatgaactcagcgaatctaaattcgccttgtgcccgaccatgatcgccgtattgcggagctccgtgtactgccgatattgtgcttgggcaccggagcctacataggtcccggtgcccttattggtgcttgtggtctgccccactttattgataatctgttctagcgtatattattccgagtttgttgtcacgattcagcccatggtcgcgtccgtatggcctctgccttcgaaatttgggcgcctataaacaaacaagcaaatagctattcttgtggatgtccctttcttccaaatggcagctacctcaacaacgacatgcgatgcccagaagcactgttcccagcaggaaaagcgccacggacgcggcgatccagttgttgtcggtggtcttggggagcaacgcagtggccgcggtggcggctttaggcttggaggacgtaggcactgtggtcttgctcaccgtcgtcttggtcgttatgtttgtcttgggcatcgcagctgcgggtttcactgtggggtccgtcgcaggttccgcaccgggctgccccgcagcaggatcaccgacagtctcacccgtcccgccgcctggcacgccttctccaccggtctcccccgccggaggcatggcgacatcgggctcaaccaccacatgcggtgccaccgcaccggaggcatccaccacgccacctacaccaaaggctccgccggcaggcgtcacaaatcgcgcggacacaagcgacccgcccaggcaagcaactccgccgtcggcaccggctgcatcgagccacgaggcgtcgacggaaagccggcagccggccaaaccatcgccaaggctcgcatcctgcagatacacgctccggacccggcgcccgcggcaacgacgcgcccgccgccgcgcacggccatgtcgccggcaatcacgccggcgaccgcctcgtttgtaatatcggccccgtctgcccgcgcatcgacggtgcagccgtcaaccacgagcgcctgcgacacgtggatcccgcactgcgagcccgtcgccgtcagggtcccggtgccgcgaagcgtcaggttgccccacacctccatgccgcacagcgtgatgtccgcatcgggcgcatgcgactccgtcacggagttctgcccggcaagcgtcagcaccaggtcgccctcggcgccgatggcctcgcccgcgtagccattaagctccaggtggtcggcatcggtccaggcccagccggggcccgacgcgcctggctcgtagtacgtcgcgcccgcgatgatgaggctctccgcgcccgcggcataagaaggcccgcccagcaaaacgcataggcaggccatggcaacaatcgcaatgtaatgacggctggtgtaggactttgcagcaaacatacccgctccgatcttcgcaggagccaatagaatatgcaccagaaaatgccctggtagcagcagttattagtttagcgagatcagaccttaaatatagaaaatgcctctgagcagtgtcgataattaggtgtaaatcgttttgccggtcggtgaaaggaagtagtcccgccagatcaattgatgctacgcctaccatgatccgatagaaagcggctcgatttatacgcggacgataacctcacagtcacattatagtttcggttcggcgtcggtttcagttttgggcattccgtcgcatccctttagacaaataaatgctctagtaaatacaaaagtgttatacaggagcgattttgtttcacacactattcgaaacgatagggctagatacataaaacagatggctacttcaacataataatcacagcaaatcatagccgtcattttataaatcgtaacctggtcgagtagagagattaaaagactcaacgtaaaagcgactgcaaataaaacaagtgcattctcgtagtagcgaaggtaattcaatagttggttgcctccttgtgaagctaacccacgaacatgcttaccatcaagcaggctgaaaaagatcgcaaaaattgagagcgctactccgaataaacccaagaacacatcctttaatgtcgtggataagttcacaattaactcaatggtattcggagcattaagtatatttaacgaaagaaccagggagatagctgaaactccaatggagattggtaggtttccttttacgggctttaactcgcgaagtgcgtcactgattagttcgccagagcttctaactacggcaatttgggaaagaccgtcaggcattaagaaacccttctaaattttactaacaagcaattcgaggatattgagtgcttttccatatagggctttattatcctcacttgcttcaggtaaataattgcgactcttgcagtaatttgcaattctttcgtcatcgtcagcacttaaatttccagcacttggaatctgaagttcagaaccaagttgattgtcagtgatttttacttttgtgccatcttgtttttcacctgttacagttgctgatgcattgccagaagcaatgctatcttgaaaaagattggagattccgttagctgatttaggggaattgaatgttaagtttcccgtttttgagtcaaccgaatccattgttgaacgtacgtatgccagcagcggcgccggatcaatatcattgtttaaagggaaaaagcgaagattaattgacttaattttcgcaaattccttgatagtttcatcaatactatcaggtaggggcatgttaacgatattgattacagcattaggaaatagaggcaagtctgctttatctctttctcggttggcctcgcgagtgtaacgatcgacgactttcctcaaaacggcttgaaaactcttgagattggggctttggccctcattcttgacgaggatcattctatgactcttgagatagatgatgaagcgagagtatggagcagttggaacggagcttggagatggaacgagctcattatcgacaacgatagttcgcaccctataatgagtttcacggatcagattcccgtgagaacatattccgaacttattagcttcaactcaacatcggagaaatagctgacatttttggaggtacgaactttctgctcattgcagaacgctggatacaaaatgtcttggaagtaagtcaacatgggctcattttctggaccatatgtaatgttgaaattagcgatacttagttttttcacttcgtccatctgcatcccttaaataacaaatattgcgcaggaaccattgtttcccgcgcaatattttagttcatataggcctaaggtccgcgctatgacatacggttcatattacggatgtttgtcaaataatgcattcgaatatgcaactcaaagaaaggtaaaagcgttaagccatctcatcggtctcgttcatcagccggttgcagatgtagatcagcttttcgctctttaaaagttgattgaaaacacggtcgagatcttcatcgtcttgtattgtgatattgcaccgctcggcctcttcgaacttataacgatcatatatctttgctagatcgttgcatacgcctcgatcgacagtcatgatggcaggatacgatggatcgaattcgatggcgaatagcctgaatcggtatctattcgaacgaatctcgaaacaatagtcatttttcttgtaaaggtcatttgcattcaaaaggtcgacttttggagtgagatccgccacgcttgcggaggctgcatgctgaattatctttgacatggagctgatggtttctaatgctggagataacgttctgtttacgtcaaaagtcggggaaaacaccccctttaccctaccgttagaagccccagacaacattttcgcctgttcagtaaaaaatgggatgattccgtctgttcttttttgttgaggttgagtgaacacctctgcccacggattttcactagaagtcatgactggctcacctaactcaaatcgatatcaactaacagcggcaaatggtcgcttatattgctgttgggacgaacttttgcaatcaagcccctattccctatcctctttagatagctataggaattaatggagtccatcaattctgggcttaccagggcttggtcataacagttccaaatagggttggcgcaatccccggaatagtaaaaggatccgtagttctccagctcctccgacaaccaatgaattgttggattatacagaaagggatattcgtcaccgcaccatgttcttccggttttatttctaactaaccctttaaaaagcatcgcgttaaatgcgttggggagaagtagctccttatcatatggatttgcatttaagtcgcccataacgatcgtcttgttaattgatagcgcgttttcatacccgtgaatcacatccatcatcttgcggatatccaccagccttggttccggatcggctgaagacatacggtcaacaagatgcgcagcggcaataatgaaacaaatcttgcctattttcatcggcagaacggcaaaccgagattcctcaaagcaatcaagaacttcaatggactcctgggcaatgattttaactttgtcacacccaccgtaacccattgggcgatatccagagccctttaagagctcatctgagaattcagttccagaaaactcaccaaaagcagcaatgccgacctcattctctcgcatacatgcgagggcaaggttggcattgtctttcttatttaagttccaaaagagcagcttcataaatcagttcatagatagctactgtgcgagcatgtcaactattcgcacgctcgcgtacccatcaccataggggttcgagatgtggctcatagccgcgaactcagcctgaacggagaaaaggtcgtggtcagatgcaacaccgaagacgcgcagcacctggtcgagcacctcgcgatgccgaccggtcatggtcaccgcggactcgggctcatccgagcgcgtcttcggtttgttgacgtgcaggtacatcttgatagcctccgagcgggtgccgaagacgagtatttattactcttagctcaaatcactttacaaaaatgattaaaaaagcttagtgaggtactcccccagctcttcctcccagtcgggcatgtggaacccgaccgactcgagcctggaaaggtcgagcgcggagtggaccgggcgcggggcgatggggccgacggcgccggcgtagtagtcggcagtgctgaccggcacgaccttctccccgttgccgttggcggcctcgaagacggcgcgggcgatgtcggcccaggacttgacggcgccggagcccgtgcagttataggtgccgtagggggcgtgcgtccccagcacgtggaagatggcctgggccatgtcgcacgtgaaggtcaagcggcccagctggtcgtcgaccacggtgatctgcccaagcccgtcctcggggtcggcgacgcggtcggacagcgccttcatggtcttgacgaagttgtgcccctcgccgatgacccagctcgagcgcatgatgtagtggcgcgggcagccggccacggcgatgtcgccggcggccttggtctggccgtagacggacagcgggctgaggggctcgtcctcggtatggacctcggcggtgccgtcgaagacgtagtcggaggacacgtggaccagggtgatcccgtgctcggcgcaggtgcgggcgagcagcgccggcccggtcgcgttggccttccaggcgatggcgcggccctcgggggtctcggctttatccacggccgtgtaggcgccgcagttgatcacggtgccgtagagcgaccagtcgtactgcgtataggccgccgggtcggacatgtcgaaggtgtcgatgtcgcagaagtcgaagtccttggcgacgccgcgctcctcggcgagcgcgcggaccgcatggcccagctggccgttgcagccggtgacgagcgtcctcctgggcgccatggggacgacgtcggcgagcatcgggtggttgaggtcggcctcggagaccgtggcctcctccagcgggatcggcgccatccttatcggcaacctcacctatgtccaggtcatcaaggcgaaggactatcaggacatgccgaccaacaaccacaccatcgcccgctccaagtacatccagcgtggctccatcatcacgtccgacggcgtgacgctagccgagtcgttgcagcaggaggacggcacctacgcccgttcctaccccaacgccggcatcgagagcgtcatgaacgatacgctcaccggctccaaggattactccagctggaacaacgccatcgcgtcgctcgcggggcagacccagccgggcaataccgccaagctcaccatcgactcgcgcatccagacggctgccgagcaggcgctcaagggctttaagggcgctgtggtggtcatggatccgcgcaccggtgcggtccttgcgtgcgcgagctcgcccacctacgacaacaccaacatcgatgcgctgctccagtcgggcggcggcgaggacggctccatgtacgaccgcgccatggacgcgctctacaccccgggctcgacctttaaggtcgtcacactctccgcggcgctcgagaccggcaccgccagccttaccagcacgtaccaggcgcccggctccatggatattggcaacgcgccggtcaccaacgatgccaacgagagctacggcaccatcagcctgcagcaggccttcgccgtgtcgtccaacgtcgtctttggccaggtggcaaacgaggtcggcgccagctcgctcgtccagtttgccaacgcctttggctacggtcaaaagctcggccaggatctgaccaccgcggcttccatcatggccgacccgtcgcttatgaccgaatgggagaccgcttgggcaggcgccggacagcccgtcggcatggaccacacgcctggcccgcagaccaccgttatgcagaattgcgtgatcgctgcggctatcgccaacagcggcgtggtcatggacccgttctttgtgtcccagatactcgccccggacggaaccgtggttaagaccacgcagtcccgctcgctgggccaggctgtcagctctgccacggccgaccaggtcaagcaggccatgctcgccgtcgtccagtccggtaccggcaccgatgcccagattccgggcgtcaaggttgccggcaagaccggttcggccgagaccggcggcaccaacgtcaactctatgtttgttggctttgcaccttacgattcacccacggttgccatctcggtggccctggaggattacgacaaacacgacgtcgaggcggccaagatcgccggcatcgtcctgaccgcggcgctcgccgcacagggagcgtgatgcccgtgatcaaagcggatacttgggacgcgccgcggccgatgagctagcgacaacgcgccacacggccccagcggccatacatttggtactacacacatcgttgagcgaatagttatgttaggagcaggaatggaacagagggtcctcgggggaagatacctcctcaaggataaggtgggaacgggcggtatggcgaccgtcttccgtgcacaggatcaggtcctcgaccgcacggttgccgtcaagatcatgctgccgcagtatgccggcgacgccaccttcgccgcccgctttaagcaggaggcccaggcagcggccggcctgtcctccccctatatcgtgggcgtctacgactggggcaaggatggcgacacctattacatcgtcatggagtacctgcgcggtaccgaccttaagagcggcatcaagagccacggcgccctcgatcccaagaaggtcgcgcagatcggctcgcagatcagctccgcgctttcggtcgcacacaagcacgagattatccaccgcgacattaagccgcaaaacatcatggtgctgcccgacggcaatatcaaggtcatggattttggcatcgcacgcgccaagaacagccacctcacgcaggataacaacgtgctgggcaccgcccactatgtaagccccgaacagacccgcggccaggacctcggccccacctcggatatctactcgctgggtgtcgtcatgtacgagtgcgccaccggccgcgtaccctttgacggcgacgacgccatctcggtcgcactcaagcaggtcaacgagttgcctattccgccgagccagatcaactccggtgtcgacgccgaccttgagcgcatcatcctcaagtgcatggagaaggacccggcaaaccgcttccagaccgccgacgagctgcgtcaggtgctcaacagctacctgtcgggccgtgccgtcaacgtctcggagcccacgcgcatcatcggcgcccccggtgagctgggcgctaccaagacccgtgagctgtctgactccacgcgcgctatggttcgccccgtatcgggcgtaagcggacagaccaacccccgcagcgccgtctcgggttccaccggttcctacgaggtcgatcagcccaagtccaacaagaacaagattatcgccgccgtagtcgccgcaatcgccgtggttggcgttgtggtggccttcgccaccgggctctttgggggcgagcaggttacggtgcccgatgtgcttaacaaggaccagcagaccgctatcgagctgatcaaggaggccggccttgaggtcggaactgtcgaccagagctataacgacgatgtcgacgagggcaaggttgccgagcagacccccaacggcaacactaagaagcccaagggctccaaggtgaacctggtgatctccaagggccccaagccctccgagaaagttgaggttccgcagctcgtcggcctgaccaaggaccaggccgaggccgcgctggcaagcgtgggcctgaagggcaacgcaaccgaggaggccaacgaggccgacgaaggccaggtctttgagcagggcactgatgccggcaaggaagtcgagaagggcacgaccatctcgtacaaggtctcgagcggcccggataccacgtccgtccccgatctgaccgacatgaccgaggcccaggcgcgcaacgccctcgatatggcaggctttggcgtcgacgttagctaccaggagaacgactcggttaccgagggcaccgtgatcagctggaaccccagcggcaagcagaagcccggcgccacgattaccgtcgtcattgccaagaagtccggcaaggccactgtcccgggcaacctgtacggtaagagcatttccgccgctgttaccgcgctcaacaacgccggtttctataacattggcttctgtgaccagaacggcaatcccgtgagcggtaacgaggatgccaccgttacgggcgtctcccccaccggcaagcagtccaccgacagcacgatcacgctaacggtcgcactttctggctcgggttcgggctctggctcgggcacgggtgacgattccggtacgaccaactagtcgccaccccaccgcccatcacggctctcgccgcaaacatattcgctcacaggcgcccgcttgctcccccagcaagcgggcgctttctttatctgaagcagcgaatactacggcatgccttaaaccagaagagcccggcaccgtaacggtaccgggctcgatattcctctggtgcccccgggcggattcgaaaactccccccgcggggaaattggtgacgcgggtgtcgacggtccgaatccgccggcggtccccacaaaccagaaacggcgccgccctcgcgacgccgtcataatcttctggtgcccccgggcggattcgaaaactcccccccccgcggggaaattggtgacgcgggtgtcgacggtccgaatccgccggcggtccccacaaaccagaaacggcgccgctctcgcgacgccgtcataatcttctggtgcccccgggcggattcgaaccgtcgacacccgctttaggaggtcttgtatttctatctgagctggtgttttataattttatacaattttatatagccgcatgtaaaacggcatgtttcaagaatcgcgagataaaggcttcaaaaattttctaccctaattctacccagatactcttgcctgggtagaattttgggattaggctaggggcaagcccttaaaggcttgcccctagcctaatcccaaggaatcccaccatgagcaccagaccaagagttgtcggaaacggcagcgtatatcaagttaaagaaggggtgttccaataccgcttcaacctcggcaaggaccccaagaccggcaaatacgcctactcatccaagagaacgctgcactgcgaaggtgtgagtagacgcacacaacaggcaatgctccgcaaagccctggaagaatacaaggaggagttgaactccggtatcgtccgtgacagcggaaacctcaccgtcgtaaagtacgccgaggacttccacagcctaaggataaagagcttcaagtcaccgctcgcctacgcccgtgagggcaactacattagccatattcaagagatgttcggccatatccgacttgccgacctccaccctgacgatatacggcgcatctacgcagacgcccgcaaaagaggaatgtccgaagccgagttacacgggacacatgtcaagctgcgacagattctccaagacgccgtagacaacgagctcatccttcgtaacccatgcacgccgatcaagcttcccaaaccaacttacagggaaagagctccgcttacggcagacgaggcttcacgatttctgtcttgcctcatggatgaaccactgtcggccaaggcaacaggcaccatgctcctgctccaatgtggtctccgacgcggcgagatgctcggcttgacttggggcgacatcgaccttgggcggcgcacgttgagcgtgtcgaatcagttcaccaatgacaagactctccgagcaccaaaatcgaagatgagccgacgcaccatagcaatcaacgactccctggcccgctatctcggcaaatggaagctggaacagcgggcgcaactcaaccgatacactctcgatcaggacgacaagacgcctatcgtcaacggcataaaggtcgtcacgaccgaggatggcatatacgccacagtcgtcaacgtagacggccacaacttcgaccgatggttccgcgacttctgcgtcgataacggctttgggagctacagcaatatcaccagaagattccagcgaaacggcaaagagcacgtgaggggcacgggatacagtgggctcgtcccccacgccctgcggcacacgcaggcgacgctccttatcggagaaggcgcagacgtgaagaccgtccaggcaagacttggccacgcgtctccgagcacgacgctttccatctactcccacgccatcgaggcaaacgaccgtaaggcagcagatgccttcggcgagctcatttcccaaaagagcagttcataaaggaagggccgagatatacccggcccttctcttgctttgaacatagatgggctaatgacgatagaccatcgccccatatggagccttatcctcccaggaaaacgatgaggcgtcacgaatggggaagacgccgattataggtgccttcgcccattcgtcggtattcagaatcgcaccgtccttgtcatagatcggctcgacctgagaactctggacatcacgaatccccggccatttatcagctatcgcatcaagcacctcatccgtaggacaggcttcctttgaggaaagataaacatagtgcggaattgcgtcgcttgcgttccgcacttcaaggacgaaagcatagtcgcatgacgcagcattcgactcattgaccaccggccaatcgtcggggacaacgagatacgagccacctcgcaggtccacgcgtttcattgacggccccttatcaacaaggctgtcttgcggaacaaatcgcaacatgtgattacgaagagccttgtaataagagagcttgtcgtttaagtcgtcggcagcgagcgacagggactcagcatcgccatatccactaagctcatcctgaatagacttgacccgttgcgcacaaaaagcgctcagttccgtagctgcgcccttgttgacgcggagacagaggctcgcgagaaggtcgaccacttcccccggagtcttaaactcttgcggatgttgttccttgaacatgctgatgttgtcatcggtctgttcaaggatggtcgtcccaaactttcgttttttcggtttcctggagcgttccatttcatcctccaatcggttttcattgcaagtataaccctgtttttcgaggtaaaagtgcttatccgaaaatcttcggaaatttttctgaatcttcagcgcctcgattgccagaagcagtatcatcgaattgcacagataagcgaatgccggaatggaggtgcccaaagaaggccatagaaacaaaaagccgcccacccctcccctctagtcgccaaactgaggtggggaggagtgagcagaccaaaggagattctaccatggtagattccgctattcccaaagcgggtatcgcacccgctcctcctcgcgtcgttctgggacgcgagcgtctgctcggcgtcaccgagattcgtgagctgaccgggcttggggaggttgccgccgcatcgctcatgaaagagagcggtcgctgcctcaagcttcatagccgcctcttcgtcatcgagtccagcttttttgagtaccttcacgagttggaggtgtcggatccgtgcagcctgtagccaatagctcattcaacgtcgaagccgatcagctcaagacctatatcgaggaaatgaacgggcgtaagcccatggctcatatacgcagcctcccctctctcgacaagctcatcggaggcgtcgtacccggaatcctgaccatagtcggagcggcacccgctgccggcaaaacgacgctcctcaaggttatctctgacgaccttgcctcccaaggcgtgcccaccgtcttctactccgcggaactccccgcgtatcgcattgctcagaagggcatcacgcgcctcggcaacggagacttcagcctttccgaagcgaccggggctatccccgagaagaaagaggcatttgagcgcgcttgcgccacctacgccgagagcgtagcacccaactcatgcatcatggacggtcagacgtccatggaagacctctgccgttgcatcggtgactgcatccacgttcgcggccagcatcccgctctcttcgtagattatctacagctcatcgccgcaacgtccttcgacgtccgcgctgaagagcgcgttgtcatcaccgcttgtgtgcaggcgctcggaaacatcgcccggacgtatgacgtccccgtcttcctgatcagcagcgtcgcacgagacaagtacaacgacgcgaacaccgagctcaacgtcttcgcgggctcgcagggtatcgactatggctccgacaacgccctcttcctgcaggtcgatggcaaggacaagaaggagcggaaatacaactcagagcttgacgttcgtcccctgcttgttcgggtccttaaggcgcgttatggcacgcttgggagcaccaagctcatcttcgacgcacctcatgccaccttctacgatcaggagggttaagccatgcgcggcaacgcaaaaaccgcgcacatcaacgtccgtatgactgaggaggagcgtgccgccatcatggcgcgctcctccgctttcggcatgactccatcggcgcttatgcgcgagtccgcacttcgcatcggggagaagcccgccagggtcgccgacgaggcgacgctgcggcagattctttatcaactgaaaaaggagggcgggaacctaaaccaggcttgtcacgccctcaacgcatacggatcagacgcgcagacatcccagcaacttgcagacgccgtccgcctggtatcgaacacggcgtcgcagctttcagccctcctatcgaaagccagggagtaaccatgaaaacgaaactgctcacagcactcgtatcatccattttcctagcagtcctcgcatgccccgtgctcgctgcccccatcgacgcgttcgtcgccgggtacgggctcgacacatcggcaatccccgcaacgttcgacgcggggatcgtcctcggctggtggctctcgggcgggttcgccgcctatcccctcggggtcttgttcgtcttcctccttgcactctgcacctgcgccctcatcgcctactcaagtgctctcaacgcgcgggccgaggacggcggcgtgctcggcgacgcccacgtcaagacaggtcgcgaggtcgtgaaggggtccgtgacctgggacggctcgacgattccatcgtcgcgcgggttcgtctacggtttcaccaaatatcgcggtaagccctgttatctctacgagccgaagaagatgattttcgtatcaggggccactgggtcaggtaagtcacgcttcctctacctcccctcaatcgacctgctcagctacggcgacggctcaaacggctccgaacccgcgaccctcgtcgtctcagacgtgaagaacgagctcgtagagctcacgggcgacgagctggcccgtcgcggctaccgcgtcctcctactcgacacgcagcatccctatcgcggccagaggttcaacccgctcaggcaggtgctcgacctccacgccgagggccggaaccaggaggccgagcaggcggcggacgccatcgctgagctcgtggtacaggacgacgagaaaggcaagggctcgcactggaccgcgtccgcgcgggggctcctgtccgccctcgtcctgctggtctccatgtccgacgagtgccccgaggagtccaagcatctggcgaccgtctgcgaggtgttggaccgtggcaccgaggccgagggcgacgacccggccgaaccgttgaagtccgtcttccgcgccctgccgagcgggcaccccgcgaagaacagggcctcgcagttcgtctcctcgggcggcaacgagctcaggagcatcctctcgacgctcaaggtggcgctccgcccgttctcgtcagccccggtcgcgtggatgacgtccgggtccgacatcgacccgcgttcgatccttgagaacaagagcgccgtgttcctccacgtgctcgacgagggctcgccctacaactgcatagcggcgatattcctctcgcagctctgggcgtccgtccaggccgccgccgactccaacggcggcaggctcccccgccccgtgcagatactcggcgacgagtggggcaaccttccccgcgtcgagtgcctgcccgccctcctttcgcttggaaggtcgttccagatttactggacgggggcaacgcaagatatatcccagcttaataaatacggtgagcgagacgggcgcaggaaaattctcgcgaactgcggcgtcaaagtcgccatgaagctcgctgaggaggaggaccgccggtacttcaccgagctcgtcggcaagaccacgcgccacacgcaaggcacgagcaacggcagggccgcgtcgggcacatcctcctcgacgtcctacagcgagagcgccgacgacgtgatacatccctgggagtggcgcgacatggcacccgaccgggacggggtcatcgtcgtgaagcatgcggacaacgggatgcccgcgtgccgcgcaggggtcttccgctcccccgtcaccgactgcaccaacacgcccacaaaggagcacttcggcctggggacgcccgagcacgaggcagggaatcgccgcgcctaccaggcggggctcgacgcctcggcgaccgagaagatggccgaggcgatccccgtctggtgccccgagtggcccgagcccgagaagagggccggggacgcaggtggcagcaaattcagcgggctctcgctcgactaggaggcgaccatgacggcaataaagcagacgagcgtctgcagcgaaaggcacctctcccgtctcagggactacctttcatgggaccgcgacaaggcgcttgcccacggcacgcagaacatcatcgacgaaggccgctggtttcaggagatggcagacacgagagcagccatgggtcacgacatgcccggcaaggccggtgccaagtgtacctacatgcagcaccagatactcgggttcctcccagacgagtgcgacctcaacggcgggaagatgacgccggagctgtgcatgcgctatgcgagggagtacgtggccgagcgctaccccaaccaggaagtcgtgatggtgctgcaccgcgagcgctgccgcgcggacgccaccgaccgctacgccgtgcacctcggcatcaaccgcagtgatctggaaaccggccgaaggctcgacgagggtcccgcacgcaaggccgcaaccgcgagggtgaagaccgtccgcgccttggacgagaagtatgggctcaggcagcttgaacgcggcaaggccaactcgcgcgttcacgcgagacaaccgggcagggaggaacgcgagatggcccgcaaggggcaggccgagcgctccgagaacgcccgcgtccgcgtggcggttgcccgccgcgtcgaggaggtcgggcgaatgagggactgccccgaccgcatggccgagctcgaccggcggctcaggcgagacggcatcgagctcgcgaggtcgaagggcgggagcctccagtaccgattcttctcgaagaccctcggggccgtgcggaaggtcaacggcggcaggctcggcttcgcggtcgaccgctcgaccggcctcgtcgtccgcttcacgctgcgcgggatagcgacggcgatgagggcgttctgggaacttgagcgcaaggcgcacgagaaccagaacgggcgcggggactaagcacttgggccgggacgcaacaggcgtcccggccccttcttttgcccttcggtgagagcgacctcggagcggttcgccgtcccgccgcaggcgggcaagatgattccgtgcaacggaatccatatcttgcctgcacggagcgagccggttgcccaaggcaacgcgagcccgggcaggtgagcgccggttgaaccgacgccgaggagacgcgaccctgggaagcgtcgcacgacggcgctcggcgacccggcgcgagaggcccagcccggcgaccacggcggagcgatggcgacttctggaagccatcgagcgcagccgttcggcgggctgggccggcgtgagcggaggcggacgaaacgcgaccctggggagcgttgccagggagccgcagcgagagcgacgccgtgcgtcgcgggggtcccgcccataagcgggacccatcggccgcaaggccgattgctgcatcacaagccgcttgacaggaccctaggagagcttagccatagcgacgtttctgtccctgcactcgtacagttcgtcgctcagttcttggtttctgtcgatgaaggagtggagcagttcacggtcaatctggtactgatagtttggttgctcttcgtccttggccttagtcttcgttcgaagctcctgtcgcccatcatgcgttaccggaaagctgtggataattctgttcctctcgtttccgagctcgcaaagcagttccaggactcttttgtcgcaggaagcttggatacgcctaggcgcggtccaagaaatcgtccgcacccccatatgacacgacgtacgattcagctaataatgcgggcaataacggtacgccccatctttctggcggcggtcacggcaagaaccaagatattgatgcctacaataaagatgtatttcgcacgaacggccatgcggatttctttcttgctgcaacgggacacagcgatccaatcgcagcggtgatcggcaagatgcttggtggcggtgacgccaagttttcgggaagcattgaacttgaaaagaagattagtattccggctaatggtggtgttcaggtcaagaatagtatcggcttgtcttcgggtgttaatgccggagatgatgctgcgacggctgcgcagggtcttgccacaaccttcatcactggcaactattcctggaaccatggcggcggcatcatgtcgaacggcgacctgtacttgggtcagccagcagatacgtatgtttacccgagccttaagctgaaggcgaccaaggcgttgaaaaatacgcaaaccggaaaagaagaaacgcccgccccagatcagttttccttcgcggtttatcgcaaggattcggctactgcgacggcgccttcttggaaaaatggcacattcaacgatggtggctgcaactttgttgagcgtgtcaagaatgacgctaacggcaacatcacgtttgaccttggtgagcagtttgcagcgagcggtacggctgacgagattacatactacttggttgaagatgctggcaatgatcacaacatcacgtacgactctgccgtgtacgagattgtggtgacggccgaggaccacacgactgtgctcatgtctgttccgacgcagaaagatccgaactcgactaaagatctcagagttcataactacacgattaatggcatgactgtaaccaagcactccggtggttcaactagcgagccgcgtcctgtgcaggcagattctgacggctattattccgtccctggctccaatgggaaaaagaccttcaccaacgtgtacactccgtacgaatctaccggctcctggattcccaaggcgactaaggtcgttaagggtggcgagatgaaggagtttacgctcgagtttgcggataacccggacttcaacagcgctcagacggttaagactcgggtcgatggcgacaagtcccagacgctttcgttcttaaatgcgtctggtgaggggattaagtactcgctctctgatatcacgaagaaacccttcactgccggtgatcctacgggccgtggcgcttccaagaccttcacgtactacgtgcgcgagaagaatgagagttcaattttctcgcattacaagttcgatcagtcggtctataagcttgatgtcacgatgacggatcagaaagatggcacgatcactgccacgaaggtgacctacacccagatcaaggatgctgacggtaatgccatcgacgaaggcaggcagactcccgtggattacaacgatggatccgatactaccaagcccaagtccacccccaccttcaccaacacctactcaacctctttgcccctttctggtatgtcgggcgtcacgctgacgtaccttgccggtgcggcggtgctttgcgctgctgcggcctggatgcacattcgtcgcaaggcgaatgcgaagggaggtgagcgtcgtgaataagaaagtttgctccttcccgatcttgtttgcgctgcttgccctcgtgatcggcacctgcgcggttgtgttccccgcatccgcgcaggccgcgccgacctcgaccggttccatcacggtgagcggcaccgtggcgagcagctacgacgcctaccagatctttagcgccaacgtcatcgatggcgataacgacgctaaaatcgccaccgacctcgcctgggcaagcgatgccgtgcgcgacgccgcgctgcctgtgctgcacagcgccggcatgtccaaatcccagacaaccgcgcaggaagctgccgagtggctcaacaccgattcccaccttacgagtgcgctgagcgcacagctcgctcgttccctccagagctctggtgccgtgtccgtggcccttaatgcgagcacggcggccgagctgccctgcggctactggctcatcgtcgccgacgacgacgccatcgcccagggcgaggccggcaccgcgccgatcatggccctggtgggcggcagcgccgtcaccgtcaagcccaaggcggcgacgcccaaggtgtccaagcacgtgctggaggacagcaccgccgcatggcagaaggccgccgacgccacggtcgccgacgacctgtactggcgcctctcggccacggtcccggcggggctcacggcctacgacacctatgcggtgcagttcgtcgacaccatgagcgcggggctcgacccctccaaggtcgccgcgagcatgcgcgtgtacgtggcggcgggcgcggacggtggcttcggcgccgtctcggccggcaaggacgggcgcgccggcaccgagcccgcgaagggctggaccgacatcacggcccagtgcagggtctcggtcgacggcaagaccttcaccgtatgcaccggtgacctgattgccgcgctcggcgggaccgacaccttcaccgcaggcgcccgcgtggtcgccgtgtacaatgcgccgctcaacagcgtatgcaaccacggcatcgcgaagggcaaccccaacgaggtctacctgcgctacccgcgctctccctttgccgaccagtccggcgacgccggcttcacccgcacgccgagcgatgacgcgtgcgcctacatctgggatctcgcgttcaccaagcgcggcagcgacggcgacaaaccgctgcccggggcggttctgagcatcgccgacgaccgcggtcgcacgctggcggccgatggcacgtgggatgcagaaggcaaggccaccgttaccacgggcgaggacggccgcgtgaccgtctcgggcgtggactcgggcaagctggaggtccgcgagctcaaggcgcccaagggctacaccgcctttgagggcacgcgctccgtgacggtcaaggccgagggcctggacgtcgaccaggtggctgccgccaagcccaagctcaccattacggccgagtcgcccctgcgcgccgacagcgcggacgggtcgacgggcagcctggaggcgtcgatcattaatacgcccaccggcacaccccctagcatcaccaccggaggctttatacccttgactggcgatatggcaatgtacgccgtggccgccgcagcggtcgccggagctgcactgatcgtggtcgcgctcctgatcaagcggggaggtggcagccataaagagtagctggcagccccacagagagcggggcgagacgtagcgaagcagatgctaagacacagacagatgatgaccgatcgaatgagaaccaaccggaaaacggaggaaaagaagatgagcatgaacaagaacatcgcacgcctggcagtaaccgccggcctcacagcagcgctgagcttcggcggagttatggcgccggtgaccatggcgtttgcagcggagggcgacgatacgatcacgatcacgcagaacgagaacaatggagccaccaagttcaaggcatatcagatctttaaggccgatgtcgtggacaaggacgggcagaaggtcgcgtccaacgtcgactgggcgagcgaccaagcgagggatgccgttcgcggcgtccttacgtctgaaaacgcgccaggcatcaccaattcgtcgaccgcgcaggaggtcgccgactacctttctgaggcgatcatggataccactcctaccacggtcgtgaagaaggacgatcttctcaataagattgccctggctgtcgagaaggacgtacccgcgactggcgtggtttttgatgctggcaccccctttactgccacgagcaagggctactacctcttcctgaccgatacctcttcgattggaaccaaggacgattacgccgataagaagcagaccggcacctcgccgatcttcgccgtcgtgggcggcaaggccgtggcggttgtcgagaagacggatattcccacggtcgagaagaaaattaaggacgacaagtccgtcagcaattgggccgacaagggcgactcgcagatgggccagccggtcaactatcagcttaccggtaccgtcgccaagaacgtcgatacgttcaaaacgtattactaccagttccacgacgagctgtccgccggcttgaccgccgataagacttccgttgaggtcaaggtcgacgggactaagattgctagcgacaagtacattgttgactatgatcaggcgaacggcaataacctcctgacggtcacgttcaacgatcttaagagttcgggcgtaaccatcaaaccgaattctaaggtcgttgtcacctacaccgccaagctcgatcccgacaaggccgaaaacgtcgttgtcggtggcgagggcaacgacaacagcgtcaagctcatctactccaacaaccccggccacgactccaagggcgagtccgtgcccgacaccgtgcgcgactacacctatgctctcaagctcgtcaaggaagactctgtggatacggaccagaagctcaagggcgtaaagttcaccatccaggcgactgcgcccgacgaggacgtagctcagggaacgactgcccagtgcgtccagaagaacggctccctcggggacagtaagtatgagttcacaacgaacgatcagggtgagatttccgtcaagggcctcgatgctggcacctacacggtgcacgaggttgagggcagtaaccctggctacaacacgctggatgactttaccttcaccattaccgccgcgggcctcgataaggcggagggtgacaacacgttgagcgtcactacaggtaagaacggttcgaaccttgttgatactccgagcatcaatggcggtactgtcaccctcaccgtcaggaacaagaagggctccggcctcccgctgaccggcctcaatggcgtgaccttcacttggatcgctggtggcgcggtgctgtgcatcggcgtggcgcacctcatccgcagccgtaagcaggctgaggagtccgagcaggagtaacgctcgcttacccatccctttggcaggtgggatgtaatggccatgagacttgcggacacttttctcgtccatccacgttcttgctttgccattctcttttcggggcagactccgcactggagtttgccccgttctttttggataacacaggcagcctccaccgtccgatgcggactcatccgtcatcgcgtttcttgactcgcatgaagttcggtttaaggtccgtaggcgcacgcgcagtgcggacggtggaaggcatttgcgccgcaacaagcgcaaataagaatgcccgggggtcggattccgggcatttaacaaaaccagaaaactaggccgcccgcgctctctttcatttacgcgggatgcgtcgtttcctattgacattgtatcccgaactgctctgctgattcgcgatattttgaaaactcaaatacgggcctatgcccggcgggggagccttccaatcggctattatttgttcagacaacctgagctgtaaaggagtgaccggcgatggtgcagggcgccaaacatatgaagagcaataacgccgcggacaacggtggctcaagtcctcagccccaacctcagccaaagcccaagcgccgccgcaagcgactgccgcgctgggccgatcggctcatcaccatcgtcatcatccttattggcgtgggccttatgacctggccgtggatcttggaccggctcgaggcctcgggcgtgttcaaccagatcagcacggtgtccagcaccgtggacgcgctgtctgccgaggagcgcgagcgcatcctgctccaggcgcgctcctttaacgagcggctggcgggcgaggccaccgagcttcccgccgaccagatcgagccctacgctcaacagctcatctttgaccgcgaccccatgatgagctgggtcgagatcccctccatcgacgtgagcatgcccatctaccacggcacgagcgaagaagtccttatggcgggcgtcggccacctggagggcacgagcctgccggtgggcggcacatcgacgcattgcgtgctcaccgcgcactcgggcatgcgcaacctgagcatgttcgacgacatccactcgctggagcccggcgacctggtactgctgcacaccatgaacaagacgctcgcttacaagatggtggactccgaggtcgtgctgcccgaggagatggagtcgctgaccatcgagcccggtgccgacaaggtgacgctcgtcacctgcacgccctacggcgtgaacgaccatcgcctgctggtgcattgcgtgcgcaccaagtacaacaagaaggacgtcgacaagcaaaagtcgctggccggccgccactggggcaagcgcgagtttgccgtgctcatcgtggtcgtagccattgtgctgttgctgctggacatcgtgatccacgcggtccgcaggcgccgcaaggccaaggcctcggcataagacattcttcagaaccaccacaatggggacaggcacctttgtggtggtcgggacttccaagccatcacaacattcgatgaaaatctcgattttgacgaaaagcgtcgaatgttgtgatgcttttcgtttcggacgggatgcttttcgttgtgggcgggacggttttcgttgtgggcagtacggctttcgctatggacggtgcggtttcgctgtagaaccgccggcccgccgcctgccagcccgccgtcctcgttacgttttcgctgcatttaggtaaagcacctgctccaagcggcgttgccttgtatactagagcggtttatctgttatgcggaagggagcgcctatggcactcagcgagaaagacgtgcgcggcatcgccgagtacgcaaagatcgcactgaccgatgacgagctcacccagatgacgtcctacctgaacgacgccgtccagatgctcgagcccgtcttgcaatatgacttgcccgacgtggagcccacgttccatcccatcggaagcctgtccaacgtgatgggcgatgacctgcgcgagcccgagcgcgacctgccgctcgacgttgcgctcgagaacgccggcagcgcgcgcgaccgctacttccgcgtgccgtccattttgggagagggggagagcgagtaatggcgctaagcttcgattcccttaccgccgcccagatcgccgcgggcgttgccgccggcgactttaccgctaccgaggtggcccaggcctcccttgccgccatcgaggcgcgcgagggcggggtccaggcattcctgcaggtggcgcccgagcttgcgctcgaggccgccgcgcgtgtggatgccgaccgcgccgcaggcaagccgctgcccccgcttgcgggcgtgccgctggccatcaaagacaacatgaacctcgtgggcacgcgcaccacttgcgcttcccgcatgctcgagaactaccagagcgtctacaccgccacctgcgtccagcgcatgctcgatgccggctgcctgcccatgggcaaggccaacatggacgagtttgcctttggcagctccaccgagagctcggcgttccaccgcaccaacaatccctgggataccgagcgcgtgcccggcggctcttcgggcggctccgctgcagccgtcgccgcaggcgaggtcgcgctctcgctgggctcggacaccggcggctccattcgccagccggcgtcgctgtgcggcgtggtgggctttaagcccacgtatggcgccgtgagccgttacggcgtggtcgcctttggctcgtcgctcgaccaggtgggcccctttggccgtacggtcgaggatgtcgcgctggccatgaacgcgcttaccggcgcgggccgcgatccgtacgactgcaccagccaggattgcgccgtcgactttaccgatcacctcaacgacagcatcgagggcaagcgcgtgggcatcatccccgcgtttatggaagccgagggcctgacgtccgaggtcaaggctgctgttcagcgcgccgcccaggagctgcagaaccagggcgccgagctggtcgaggtcgatctgccgcacctggacgccgctatcgccgcctactacgtcatcggcccggccgaggcgttctccaacctggcccgcttcgacggcattcgctatggctatcaggaggagggctgcgccaacctgtccgaccagagctcgctttcgcgtgcccacggctttggtgccgaggccaagcgccgtcagatgcttggcgcctacctgctgagctcgggcgtgtacgacaagtactactacgctgcgcaaaaggcccgcacgctcatcacgcaggactacgacgccgcgtatgccaaggtggacaccatcctcatgcccgcctcgccgcgcacggcctttaagtttggcgagatcagcgaccctacgcagatgtacctctccgacctgtacaccatctcgctcaacatttgcggcaacggtggtatctcggtgccgctgggtctgggcgaggatactcagctgcccgtttctgcccagctggtgggtccggcctttaaggaccgtcagctgctcacgtttgcccgcgccctggagcgcggctttgccgatgccgccacgggtgcgcccgcgctttccgtcgcgcccgattttgccgggaagggaggcgagctgtaatgaaggagctttccgaggtcctgcaggattgggaggccgtgatcggcctggagatccataccgagctcaccgcactcgataccaagatgttctgcaactgcaagctcagccacgatgacgagcccaatgctaacgtgtgcccggtgtgcctgggcctgcccggcgccctgccggtgcccaacaagcgcgccatcgagagcattgtcaaggccggtctcgccactaactgcgagatccagcgccactcgatgttctaccgcaagcactacttctatcccgacatggccaagaacttccagaccacgcagggtccggtcgcctttgccatgtacggtcacctggatctggacgtgaccggtcgcggtgccgccgagcgccccgactgcgcgtttggcgaggccgaggcccagagcctggcgagcgcctcggccaacgccgagggcctgtccacgtccatgacgtcgaccatgcgcgagggtaatcagcgtgccggccacctggccagctatgacgcgtccaacctgcagatgcccgagcgtcgcgaggacggttcctacacggtgcccattcgcatcctgcgcatccatatggaggaggacgccgccaagatggtgcacgtgggcggtgccgagggccgtattacggccgctgccgagtcgctcgtcgactacaaccgctgcggcacgccgctcatcgagctcgtcaccgagcccgatttgcgtacgcccgaggaagcgcgtctgtttatggaaaagctccgtcgcatctttgtgacgctgggtatttcggactgctccatggagaagggctccatgcgctgcgacggcaacgtgtcgctgcgccgccgcggcgagaccaagctgggcaccaagaccgagctcaagaaccttaactcgtttaagagcctgcacgatggccttgcctacgagatttgccgccaggccgaggtgctcgaggaaggcggcatcatctatcaggagacccgccactgggagcccagccgcaagcgcaccgtggtcatgcgtgtgaaggaaacggcagacgactatcgcctgttccccgatcccgacctggcgccgttcgacctagacgacgagttcatcgaccgctgccgtggcgagatccccgagctgcccgatgccaagcgcgcccgttttgaggccgactttggcattaaggcggccgacgccgagcagatcgccggcgaccccgagtttgccgagttctttgaggccgccgctgccggtatggctggcaaggaggcccagacggttgcaaacttgctggtcaacgagatgatcgcctaccttaagggcgcgggtgtctcgctgaccgagtccggtattgcgccggctcaggtggcagcccttgccaagctgctggcgaccgatgccatcagctccaaccaggcgcacgaggtctttgaggccatggcccagaccggcgacgaccccaacaagatcgtcgacgagcgcggcatgcgtcaggtgagcgatgccggcgcgctgcagccgatcgtggacgaggtgctggcaaactgtgccgatcaggcgcagcagtatcgtgacggtaaccaaaaggtcatcggctttttggtgggccagtgcatgaaggcgagtcgcggcaagggcaacccgaagctcttcaacgagttgctgagaacgtcgctctcgtaagcgggaacccgggagccccggcagggcgggtgcttcctcaaaatttcgaacagtcctgcgcaagacgaaggccacattaagtggccttctttgcgtgcggaactcatgcgaacctccagtccggaccgcttcacggtccaactttctgtccgcacccccttatgaccggcgaacggtattttttctccgataaacggtatttatgcggtacttagggacgttccttttctgccggcacccggggacactccttgctctggtgcattggggacaggtttgtttgcaccaggtcggtgcagattaacctggccccattgcgccaatttcgtatgcgctagatgaagagctcgcattccttccgcacgacgcaaaccttgctcagcatctgggaaacagcggatagtttgctggaatcaagcttgcgagcacctcgcggacatacggcgatgcagcgcatgcaggagatgcacgcctcgccagctgctcgtttggggtcacccttgtcgatagcacaaacggggcacgccgcggcgcatgcaccgcaggagacgcaatcctctgttgcctcgggcgccatgcggtgacctccagcttgtttataaggacgattgccggggatagagggctcggacgcatcctcagccaacagcttttgctgaatttgctgagcaaactcagcaagctgcgccgcatcctgcgcatccggacgaccggcagcaaaccgtcgcgcaatggaatgttctgcaatggccgcaactgccgcgatcacccggaatcccgcatgcttcgcaacgtcctccagctctacgagcgtgtcctcaaacgcgcggtttccgtagacgcacaccagaacggcccgcgctccgttgccgtgaaccatgcccaaccggtcagccaccacagccgggattctaccggcatacgccggcacagagattacggccacgtcgtcctcagtcatcgagacagcgctgaaatctagcccgctatcggtcagatcgacggtaacggtattcttgtccagtgccccggccacaaggccagacaccttctgcgttccacccgtcggactaaacacaatttcgaatacgctcatcgagacaccctcccccctacgtctggcaacgcgtcaagccgttttcacatccagccagagtatacggcacgtgggatccccattttggtgcatcaagcaccccaatgcaccaaccctacgctgtctgcctcttcgttttgtataaattacggtacagattgtatatatttacgggataccgccgtgttctcccgaggtaccccatcccggaccgtgcaaaaaacggagtattctgcaacgtgaccgcgccagcaataccccgagcgggcaaacctttagggcgctgcgtcattttgggttccgacatggcgagaatgacgcgcccctgctccggaaaacgacgaaatctgactcagaacgctcgctagggatatccgaaagccaccgttggcgacgtcaaatcatatgcagacaactcgaactgcagaatactccaaaaaatgcacggcgcaccccataggacccattgctgcatggcggaaaataggtcctcagcatcccccagatgcattcccgagaacatcacgtttgaattagcgatggacacggcaaacaaaagggcccgagcgttatttgctcgggcccttagcttgtctcacgctagcgcgcgatgcgcatcttacttgcgcttgccgccgccgtcgtcggggcgacgggagctgccaccgcgcttgccgccacggctgttgccgtagctgccacggttatcgcgaccgccggcacggccgccacgggagccggcctggttgccgccacgaccaccacgatagccgccgcgacgctcttcgcgggtatcgtcgtagttgcgccagtcatcgcgacgatcgcggctggcacgcgggtcacgacgatcacgcgactcgttagaacgaccagcgccgccgcggccgccattgccgcgagcaccctcgcgacgctcgccgccgcggctaccgcgctcttcaaagcgcttgccgccacgggactcaccgccacgggcagtacgctcaccgcgaccctcgccgccgcgacgctcatcacggccgccgcgctcgtcatcacgaccggaacgccggcggtcgcccgcaccgcgcttgccaccgcgcgaaccgcggccctcgtcctcgcgctcgacacgacgacgaccgccgcggtcctcgtcctcacgacgacggcggtgtgcctcgccctggaactgcttggcacgacgctcggcacggttgccgcgcgcaggctgctcagcggcaccagcaccgccgcgctcctcggcagctacctcgcgagccacgctctcaacagcctcgtccacgcgagcctgaacgccctcgcgcacgcgggtcttgccgccgcgcttgggacggctcggacgctcgccgtcgccgcggcgctcgtcgcgaccgcggttggaacgaccggcaacatcgccgtaatcgtcgccgttgcgcttgccgtcgcgacgcgcccgctcaagcttcttcttgctcttggacttgccgcgcttagtcttcttcttcaccttaaaggccgcagggtcgcgctcgggatcaaccgcaggcgggttgggacccacatgcaggtcgccggcttcgtaaatatcggccgtcttgtccatgagcttctcgatctcgtagaactcatcgacgtcctgctcggtcacaaacgtaatggcccagcccagctcgccggcgcggcccgtacggccaatgcggtggatatagtcggtcggctcggccggcacgtcaaagttcacgacgtagcgcacgtcgctaatgtcgatgccgcgggcgagaacatcggttgccaccagcacgtcgacggtgccgtcgcggaaggccgaaagggcacgctcgcgctgggcctggctgcggttgccgtgaatcgcggcggccttgatgcccttacgctccagacgacggcagcagctgtcggcgcggtgcttggtgcgcataaagacgatagtgcgctccgggccctcctttttgaggaactcgggcagcaggttgttcttggcctcaatggacaccgggaacacaaactgatcgacggtgtcggcggtcgacgtggcgggtgcgatctccacgcgggccgggtcgctcaccaggtcggtgatctcgcccactgcctcctcgtcgagcgtcgcagagaacagcagcgtctggcgctcggccggcgtctcgcgcacaatgcggcggacggcgggcaaaaagcccatgtcgagcatgcggtcggcctcgtcgagcaccagcaccttgacctcgttcaggtggcaggcgccctgctcgatcaggtcgaccagacggcccggcgtggcgaccaggatgtcacagccatacttgagtgccgcggtctgcggcttgtagctcacgccacccacgacggtcacggcgacatggccggtgacgtcggcgatcttgctcgcgacctcgtcgatctgctgggcaagctcgcgcgtgggggtgatgacgagcatcacggggccgcggccgttgtcctcgggcttcttggcaccgcgacggcggttgcggccgccgcgctcgcgcacgggcttgggcggagcgatgtgctccagattgttcatggacggcagcaaaaaggcggccgtcttgccggtgccggtctgggcggcggcaagcaggtcgcggccctcgagcaccacggggatggagccggcctgaacgggcgtgggcgccgtgtagcccaggttctcgatagcacgaagcatctcgtcggaaagccccagctcgtcaaaggcgggcaggctctcggtagcggactcgacggcctgggcagcattggcctcatcggcggcatcgaaggcagcctgggtcatggcctcgcgggtctcgtccagaatctcggcgtccgtgacgtcggatacagaattacgcatatgtcgttgttccttatctgcacgcgttatgggcacggcatgcggccgcgcgggcgtgcttggtagtgcgctaatacatacaaaaacaggtgcgcacagagaggacgttgctcagcacgctggcgatcgctttggcagccctatcacgcgccgtccagacgcagcagctctaagcgatggagcagattcgccgccggatagtatacccgtgcttcgcatgcccccacgtaaaccacagatgacgaggcggacgaggtgggcctggccgattgtgtcaatctgtaacagatgcagggcaaaaccgggtccaaatgttacagaacaagacagagggggatttccgttcagtccaaccaaaatctctcggtcttcctgcaatttcgaacatgtggcctataatgttgctttggttacgctatatattgcgcagccatttaatacgtcgcccaccgggggccattaattcctatcgccatattggctaggaagcaatcaaaggaggtatccgtggcagcagagacgccttgctcggtcctctataacgatattcgctcgttcggcggtcttaaacatctcgagatcgcccgaatgctcatcaatggaaactcttatctcggcagtaccctgctcgagaaatgctcttccaaccgctcgtatctcacccgttacatcgtccatcgcaagcctgaccagtgcgcgcccgccatctacagcgactttaccgtcaccacgctcaacctttccgcggcaatctgcagcaagctcggcggcggcgagtccgcctatcaggcaatcgccgagcactatcgcggtccggccgccaacgaaatgatgtcggctctcgccagctacaagctggacagccgcctatatgcaaatgccctcaatcgcatcgacaactttgacggcaatgccgtgcgcgagaaaagcacgctttaccttatgctctttgtggcaacgggggcgctcgccgatcccgttcagggcgtggccaccgtcgagcgcttttgcgacagcaagacgggcgggcactttggcaccaccgaaactaccgtcggacgtggctttatgagcagcctggagcagccgcgcaccgtcgcccccaacctcggtctgctcagaacccatgccgacaactgcgccgacatgcaaatccatcccctcacacgcgatccgcgcggcaccgtgattggttctttgcccaaaacctcgcccagcatcaccgatgtaggcgccgacgcctcgcgcgagcatcttcgtatttggctcgagggtgagcactggtacgcccagggccttggatcgaccaacggcacagtgctcgaatcgggcgcgggcgacggcgatattgtgattgagccgccgcgcgaccaacgcgagcccggcaaagtctatccccccgtggaaatcgccaacagcgacaggctccatctgggtctctacacgacattccttgtcattgtggactagcgcggacggcgatcggaagacggtcgccgtccgtctttcgtcttctaccttctgcgtcgtaaacgacaatactcagcggtatacgtgagcagtgcggctatcatggtactttaccgatatccgcactgctcacgtatacgcacggcaacccatgccagacaaaggaacgccatggatactaccgatagcgcctatggcgacaaactcatccgtcttgacacgttcgacgccgccgtggcggtcgaccccagcgccgaggacgacgccaagcgtcggtttatgacgcttattctccagacggcccaccgcaacaacggcaacatcgggcacgtgctgcgcgcgaccaacacgagcggcgaggtctttgccgtcaagctactcaaggacaacgccgtcctttccggccaagcccccgaccgctccgccgagcaatcggccgctcacctggccaacaccgccgcgctgttcgaggagtaccgtcatctgtgcaccgtctcgcacctgcgcggatttccgcgcgtctatggctacggatcgtgcgaggacgacccgctcatcctcatggagtgggtcgagggcacctcactcaagcaggcgctgcccctgcttcctcacgacgcctcgggcgggctgaccacccagatggtcgccgccgtcggaaacgccgtgcttcgtgcgctcttgatgacccaaggcctcgtgaatccggtcgtccatcgcgacctttcgcctgccaatatcatgttccgcaccaccagccgaacgctcgagcagcagattgccgattgctcctttgacccctgcctcatcgacatgggctccgcgaccatggctctcggcgacgacacgatcacccggcgcgccgacatctggcgctttgccacgcccgcatacgccgcgcccgagatgctcacgcaggatatcgaaggcatcgcggctcttcgccgttcgccggcaatcgacgtctatgcgctttcgagcattctgtaccagctctacagcggtcgcaaaccgtttgactttgagtcgacggacgccgctgcaaccggctcgttctatctcgtaaagaccaagaccaagcctgcaccgctcgagccgcgctgcgagggcgatgaagcgctcgtcaaaatcatcatgaagggtctctcagtcgagcagtgcgatcgtcccaccgagcagcagatgctcgaggtgctctcggcatacctcaccgatgccgaatccgagggccgcgaaggcgcgggcagtgatgccgcaatcgacatcgactccggtacacaccttaaggtcgacgtcgccggcgagcgcgcgagagagatcctggagcaggcccggcacgatgccatgacccgccgccggtttattatcggtggcgtcgttgcagccgttgcgtggctcagcgtcattggggcggcgacccatggctttggcatccccgactacctggatggcatccgcggttcgcttgacgactacacctgggatcagctgcaggagatttcgctcaagattaaggccgccgagacccgtagcgaggcacgcgagattgccaagcgctatcacctgctcgatgccgatgggcatatcccctatccgtgtaccaaacgtgtcacgctcaccaacgggctgcaggttggcgcgcagcttgtgggcatccgccacgatgagcttctggacgggacgggcaaggccggattgacgtttatgttcgatgccggcattgccgagcgcgatgccacggcccaaccgttgagcgccggctgggcagattgcgagctgcgggaatggctcgacggcgacggccttaagctgctgcccaacgagttgcgcgcactcattaaatctgtcaaaaagatctcgaataacgttggcgctgccagaagcgcatcgtgtctgagcgagttgcccgcaaccctttggctgcccgccatggtcgagctgtgcggagtgcagccgcccgagtcatttgccgagggctttcactacctggccgacatctacaacggcgaaggcaaggagtaccagctgttccgcgagctcaaggtaagtccgtataccacgaacgagacgttggttcgccagtggaaaggcaaggacacctgttggtgggatcgcacggtgagccccgacacatcggagagcgaaggcacgctctatatgaaccgcgtggggcacgccggcgacgtctttacgtacgcaacgcctgcggaaaagccaaacaagctaacctgtgtgatccccggattctgtatctaggcggcgggcgtcttgccatgacgggacccctccccgtcaattgtcttgatctgtaacactagctcggcagatacaggtctagatgttacagaacgagacaaaccccaaccccgcgagacaacatctcaatctgtaacatctagcaggcaaaacggtcctcagatgttacagattgagatggttggttgggacggtccatcggccaaccatccatcctcatctgtaacgaaatgtcatacatttctttctgtactggacacccccagggggtataggtgtatagtatcggcaggttaacaattccaacaccgaactacagaaaggagaagccatggctcaagataagttcgacgtgggcggcatgacatgcgccgcctgccaggcgcacgtggaccgtgccgtgagcaagctcgacggcgtagaaagcgtcgcggtcaatctgctcgccggttccatgatggtggactatgaccccgcgcaggtcacccccgacgatatctgcaccgctgtcgaccgcgcgggctactcggcctcgctcatcagcacgggcgccgacgctgtccaaagcggaagtgcgcaagccaggtccggcgccgcccatatggagtcaccgaccaaaaagttggaggccgccgcctccgccatgcgcacccgcctcatcatctcgatcgtattcctcatcccactgttctacataggcatggggcacatgctcggctggccgctgcccggttttttcaccgaccatacccacagcatgacactcgcgctcaccgagctcgtcctgctcatccccatcgtctacgtcaacgacgcgtactttatcaacgggtttaaatcgctcgcgcacggcgcgcccaccatggacgcccttattgccgtgggcgccaccgcctccatcgcctggtcgctctacgccatgttcatcatggccgaccagctagccgcaggccaggtgcacgaggccatgatgacgagcatggacaacctgtattttgagagcgctggcaccatcctgtcgctcgtcaccgtgggcaaatacctcgagacacgcagcaaatccaagaccggcggcgccatcgaggcgctcatcgacctggcgcccaagaccgcaaccgtcgtggcagaggacggcagcgaggccaccgtagatgtcgacgccatccttcccggccaagtcctgcgtgtgcgccccggcgagtccatccctgtcgatggcgtggtgctcgagggcagctcggccgtggacgagagcgcgctcaccggcgagtccatccccgtggaaaagaccgccggcgacaccgtcaacgccgccactgtcaaccgcaccggctcgtttaccttccgtgccacacgcgtgggcgccgacacgtcgctcgccaagattatccagctcgtcgaggacgccaacgccaccaaggcgcccatcgcccgtatggccgacaaggtcgccggcgtgttcgtgcccgtagtgtttgcgatctcggccgtgacttttgtggcatggatggttttgaccggaagcatcaacgaagcgctcacctccgccgtcgctgtgctggtgatcagctgtccgtgcgcattgggtctggccacgcccgtcgctattatggtcggcaccggcaagggcgccgagatgggcattctgttcaagagcgccgaggcgctggagaatctgcgcagcgtgggcaccgtggtgctcgataagacgggaacggtcacccgcggcaagcctgccgtgaccgatatcgtggtagccacgcgcgccgacggatcgcccgccatgagcgaaaaggcgctgctcaagctggccgccgcgctggagcgctcaagcgaacacccgctggccgaggcgattatggccgagtgcgagacgnnnnnnnnnngagacgcgagggattgtcgcgcgcgccgtcgaggactttgccgccgtgcccgggcgaggcgttacggcacgcgaggggcaaaacaccatcgccgctggtaacgtgcgcctgatgaacgagctaggcgttaccgtgcccgcgggccttgccgagcaatttgccgccaagggcaagacgccgctgttctttgccaagaacggcgagcttgccggcaccattgccgtggctgacgaggtcaaggagacgagcgccggagccatcgccgcactgcgctcgcttggcgtcgacgtgcgcatgctcaccggcgataaccgtgtcgcgattggcgaaaatgcgttggtggaaatggtgaaaattatattgacgctaacaggcgccgctgatctcgttttgctccctgagctcggcgaggcgctcgtcggcgtccttgtacatggatcggaacttccacatgcggaaggtggacaggctgccgtcgcggtgggtctggcccacgcggatctggctgtagaaggggttgccctcgctctccaggcggatggccgcggcgagcaccaggctcggtacggcgatgacggccagcacgcagccgctgaacacgatatcgaaggcgcgcttgacggtgcggtatgccaagcgcgagttgtcccattccatgacggattgcatggccttgtaccggccggcgccctcgcgccggtccatggcctgagcaatgagcgccgcccccgcggacacattgctctctgttacttctttagcagccacagtcaaacttacgtccccgttgtccagggatcccccaatcggcaaattcaaaatgcgaacgaatagctggtgcaacgtctcccttacgttttgctgggaacgtcgagcggtagcagctccctaaaagcggagtcgccttcgcccacgtctaccaggcaccagcgcttatgacggtcgatctttttaacgcgggcctcttgccccaccaaggggccctgctctatgtgcaacacgccgtcttctatgcgcgcaatgctgttgcgcaccacgccgtcgtcgtctagcacactgcggtaccagttctgtgcatcgtccggcatgggcatgtacgcccgctccctactaccggcgatgcgacagccaaagctcaactgggccaaagccctatcaagcgcggcggcatcgtgcgtggcgacgaagaaatattccttgtacataggtttggtttggagcgaccaggcgccgtcccgcttaaaccagaactccttttgcatcacaaaagcgttctgcatcagctcgtgcgggataatgtggcggaccttttcgcaggtctcgcgctcttttccattgggggtgtgaaccaaataccagcggacgcggccgtgctggctgttggtgctggcgccgttaaatgcgcccggcagctgttcttggcgccgtgccgtctgctccatgtcctcgcccccttttcttgctttgcggcacacgcaaatgcaggggcgtttagaacaggcttctcgctcgcagctaggcgcagtcgcaaaagtacaggtttttatagaggggtatggagatgcacctactggcagtacattttgcgtaatctgggtaaacgctgattaattgctcgtataatgtcgtcagtcgaaagatacaaaaacctgtacctttttgtgcaacaaaaaaggccgctcaaccagcggcttttcttatttcggcatgaaaaaaggcgaccgcccttcgtggacggtcgcctttgttaattgttatgaagtttgccttaggcgcgggtcttgatctcctcgagcaccttcgcaacaaactcgtcaacgctcatctgaacggtctcgttggagcgatcgcggacggagatgttgccggcctcgacctccttctcgcccagaatgagcatgtagggcacgcggtcgatgctgcgggcctcgcggatcttgtagccgatcttctcgtcgcgatcgtcgcagaccacgcgaatgccggcctcctccagcttggcgcacacctcgtgggcgtagtcgcggctcttctcagagacgggaagtgccttgacctgcacgggagccagccaagtggggaacttgcctgcaaagtgctcaatcagaataccgatgaagcgctcgatggagccaaagcatacgcggtgcagcatgatggggcgcttcttggtgccgtcggcgtccacgtactccaggtcaaagttgagcggcatctggaagtcgagctggacggtaccgcactgccaggtacgaccgagcgagtcctccaggtggaagtcgatcttggggccgtagaaggcgccgtcgccctcgttgacctcgtagtccatgtgcagctgctccagagcggtgcgcaggccctcctcggcgcgagcccagtcctcgtcggaacccatggagtcctcggggcgggtggaaagctcgacgtgatacttaaagccaaacttctggtacacggagtcgatgaggttaaccacgcccacgatctcgtcggtcaactggtcgggacgcacaaacaggtgggcgtcgtcctggttaaagcagcgcacgcggaacaggccgtgcagggcgccgcgcagctcgtggcggtgcaccaagccaatctcgccggcgcgaatgggcagctcgcggtaggagtgcggcttggaggcgtacaccagcacgccgcccgggcagttcatgggcttaatgcagtactcttcgtcgtcgatgacggtggagtacatgttgtccttgtagtggtcccagtggcccgaggtcttccacagctgcttgttcatgatgagcggcgtggagatctccacgtagccggccttgtggtggatctcgcgccagtagtccagcagcgtgttcttaaggatcatgccgttgggcaggaagaacgggaagccgggggcctcgtcgcgcatcataaagaggtccatctcgcggccgatcttgcggtggtcgcgcttcttggcctcctcgagcatgtgcatgtgctcgtcgagctcttccttggtggcaaaggcgacgccgttgatgcgggtgagcatcttgttgtccttgtcgcccttccagtaagcgcccgagacgccggtgagcttaaaggccttgagggccttggtgtagcagatgtgggggccgacgcacatgtcgatgtagtcgccctgctgatagaaggtgatgcgggcgtcgtcgtccaggtcgccgatgtgctcgaccttgtacttctcgccgcgctcctccataagtgcgatggcctcggcgcggggcttctcgtacacggtgaacttgaggttctccttgacgatctttttcatctcggcctcaatcgcggggaagtcgtcctcgctgatcttgacgccctcgggcaggtcgacgtcgtaatagaagccgttgtcggtcgcggggccgtaggcaaagtcggcctgggggtacaggcgcttgatggcctgcgccatgatgtgcgcggcagagtggcggatgacgtgcgtgacctcgtcctgcgggagctcggccaccgaaccgtcattgtagagtgccttcatgggtatgttttctcctctcggatgcctgatgcaagtgcgtgcgatgcgctcggcgtttttgacttgcatcattataggcaggttgccttggtatacaagcgcccgccgcaccttaatggcacggcgggcgattttctacgcatgcttcatcgtgtagggcggggtgtggggcgcgcatggcttgcgcgggacgcgcggtgcccgtgacttacggccggcccggcgatggatgcgttactggatgcgagttcggcagtaggggcagaccttccagtgcgcgtcgagcgggcgatggcagctggggcacacgttgcgaacctgggtgtcgcacacggggcagaccacaaagtccttctcgatgggggcgccgcactgcgggcaggtgccgtactgggcaagctggcgctcgcgcagggccatgtccagctcctgctcctcgcggtcggccgcgtaggagtgcggacgcagaaccagataggcgatgaggcccacaaacgggatgagggcgatgatgccccatgccacgtaggcgctggcgccgcggcggcgagcgtcgatgaacacatagacgaccgacagcacgtacagggcgatgataaagccaacgaaggcatagatgacgcccataagctgcggcgacatgagctcagagatgtacttggacattgaggtgtacctttcggaataattacagtccggtcaagtttaccacggggtatgtttatatgggaccacggctaggggcggggctagcgcggacacaaacatctcaatctgtaacaggtggaagcggaatccgggtctagatgttacagatcgagacacgggggtccctccccgacttcaatctcgatctgtaacatcttgactccaaaatcagctcttactgttacagatcaagatgaacggtgagccctccgttaaatatctcaatctgtaacaactaggggtcagaaacccttctatctgttacagatcaagacaaaggaaatgtccaatctcagtatctcaatccgtaacaacaactcgtcaaaaacaggtctaaccgttacagatttagacattcgaaaccgactgataggttcatctaaatctgtaacatcttggacctcaaaacggtccggaaatgttacagatcgagacagaaaatctctccctgactttaaatctcaatctgtaacacataggaccaatttccccctcttgctgttacagatcgagacaaacggagaggccggctggcaaacgtctcgatctgtaacatctggaacccagttcttctgtttaccgttacagattgagacaaatctcggacaccaaaggtggcagacgaggttgtcgacgttgccgaatctcccctcccctgccgttggcgggtgttgcggggctgttcgccgcattgccgctgcactgggggtgtgcagaccgtaggatagtcctattgacagcctgtcaactcgtcagggaggcaccgtggcagaaacgtttgatatcgcgattgtgggcgcgggcatcacgggatgcgccatcgcacggcaactcgcgcggtttgacctgtccatttgcgtggtcgaggcggccaacgacatcgcgctgggggcttcgaaggccaacggcggcctggtgcacgccggctacgatccggcaccgggcaccgtaaaggcgcaggtcaacgcccgcggctgcgagttgtatggcacctggtcccaggagctgggctttctgttctgccgcaccgggtcgatggtgttgggctttaacgacgaggaccgcacgcatctggagcagctacggcgcaacggccatgtcaacggtgtgcccgagctgtcgatcgtcggacccgaccgcatccacgaattggagccgcgcgccagtgccgatgcgacgtgcgcgttgtggtgcccctcgactgggcttgtcgacccgtttgaggttgccatcgccgcgctggagaacgccgtggcgaacggggtgacgtttatgcgctccgcaccggtggaggcaattgaagtcgcgggctcgggcgacgacgcgcgcttcacactggcgacccccgttggcaacgtgcgctgccgctatctgataaacgccgcgggcaacggcgccgccgacatctcgcatatggcgggcgccgagaagttccatatggtctggcgtcagggcaacatcgtgctgctggacaaggaaccgcgcacgctcatgccgctctaccccgtgccgacgccggtgtcgaagggtgttatcgtcacgggcaccgtgcacggcaacaccgtgatcaccgccacggctgccgtgcgcgaggcgggcgacacgcagacctatgcgagcgatgtgaacgcgctgctgaccggcgcgcgcaaactggtgcccgatctggacacgcgccgcgtggtgcgcgcatttgccggcgggcgtccagtcattcaaggaacgaacgacttctttattggacagtcggccgtggtgccggggcttttccaggcggcgggcattcagtcgccgggcgtggcgagcgcgccggccattgccgagcgcatggagtacgtgatacgcaaggcgggcgttgctttgcgcgagcgggccgattgggatccgattcgccgtgcgccggacgactttgaccgtacaccgcttgcgcgcaaggaagagctcattgagtccgaccccgcgtgggggcagatcgtctgccgctgcgagacggtgcccgaggccgagatcgtggccgcgatccgacgccgcccgggcgcggtttcggtcgagggcgtcaagcgccgctgccgtgccggcatgggtcggtgccagagcggcttttgccagagccgcgtggcggcgatcctagcccgcgagctggggtgtgaccctagcgaggtgctgctggagcacactggctcgtggctcgttgagggacctttgaagggggtgcgctaggatggcggaattcaaatcgagcgtgattgataccgatgccgttgaggcagtacctacgcaggccttcgacgtggtcgtcatcggaggcggacccgccggcatggcggccgcgcttgccgcgcataaggccgacgcgcgcgtggccatcgtggagcgcgagcaacacttgggcggaatcctccgccagtgcattcaccccggctttgggctgtcgcactttaagcaggagctcaccggtcccgagtacgcgcagcgctttatcgaccaggtgcacgcaaccgacattgcgctgttcctggacagcatggtgattgggattgattcaggcgagtccacggaagatgccgcggtccacagcgtcacgctcatgagccccaccggcatgttgcagctcaccgggcgcgcggtcgtccttgccatgggttgtcgcgagcgcacccgcagcgagatcaagattcccggcagccgacccgccggcgtgtttacggccggcctggcgcagcgatacatcaatatcgagaacctcaagcccggctcacgcgccgtcattttgggctcgggcgacatcgggctcatcatggcgcgccgctgcacgctcgaggggatttcggtcgagggcgtgtacgaactcatgccgtacgccaacggcttgcgtcgcaatgtgaaaaactgcctagatgacttcggcattccgctgcatctgtctaccacggtcacgcgcgtgatcgggcacgaccgcgttgaagccgtcgaagtgagccaggtcgatgagcatctggcgcccattccggggaccgagcgcgttgttccgtgcgacacgctactgctttcggtgggcctgattcccgaaaatgagctttcggttgccgcaggcgtggagctggacccacgtacgcgcggcgccgtagtggaccagagtctgcagacgggcgtgccgggcatatttgcctgcggcaacgtgctccatgtgcacgacctggcagacaatgtgacgaccgagtccgaacgcgccggtgcggctgcggcggcgtacgcgttgggctgtggtgctggggccgatgcggacgctgcgggcccgggctgtgaactcacggtctcccccgccggcatcgcaggctacgcactgccaggccgcattacgaccgtcgggctcactaagctcaacttccgtgtacgccgaccggtcgacaccgcccgcgtgcgcattcttgcaggcgacaaggagctgtttgcaggaaaggtccgcccgtttaaaccgagcgtaatggaaagcttcccgctgccggcaaaagtgattcagcgcgcactcgacctgggtgttagcgagattgtcctatccgtcgatcccgtagaggaggcgtaggaccatgagcacgaatgtgaccgagacgttgcagttcaactgcaccacctgcccatccgagtgcctcctgaccgtaaaggtcgagcgcagcgcagacggcgccgtggtagaggtgcactccgtaaccggcaacagctgcccgcgcggctacaagttcgcacaccaggaactcacctgtcccatgcgcgtgttcaccaccaccgtggccgtatccagcggcgacgaggctctgttgcctgtgcgcacggccgaagccatcccgctggcactccacgcccaagccatggacctcatccgcggcctaaccgtcgacgcccccatccgcatgggcgacgtcgtgctaaagaacctcctagacaccaacatcaacctcatcgccagcatggacatcgacccagcctaagcagctaattgaggacggggctcttttagctaccccgccatccaccccgccctcctccgcagttgcggtgaaatagttcctgatttccgccaagaccccggcatccaggaactattccaccgcaactatccttggaattggtatttagcctatgcctactttagtgccatttcaaaactatgccggattacggggctaaatcgagaacccctatccataccggcaaattctgagttttgacaagccctctacctgcggttttatttttgccatttcgttcatggacagccaagtgcaatccaaccccgtaatccgtcatagttttgaaaacatgctaattcggcacaaggctttttgactacttttgctgctacgtccattcccccacctgagttgcggtgaaatacggactgtttaccggcctggagtcgctcaacagtccgtatttcaccgcaactcatgagagtacgtatgggataccatggtggcaccctagcgaaaggacgatgtatggcacatgtcgatgaccagcgtgtggcgcgcgtgctcgatgcgctcgaggctcagcaccccggcgcacagctgcttgtgaatgacccgtggtcgatttattacctgaccggcttttatgccgatatgttcgagcgattttgcggcgtgctgctcgcacgcgactgcgagcccgtgatcttggtcaacgcgctgcaccagctcaccgagtacgacaatgcccgcgtcgcctatcacaccgataccgacgtcgtggccgacgccatcgctcgcgaggtcgatccgaccaaaccgctcggcatcgacaccgtcatgcgctccggctttttgatgccgcttatggagcgccacgccgccagcgagtttttcctgggcgactttgccgtgacggccgcacgcacgtacaaggacgctgccgagcaggagctcatgcgcgcgtcctcggccgccaacgatgccgtgatggccgacgcaatcaagcttgtccatgagggcgtgacggagcgtgaaattgccgatcagatgctcggcctgtatcgtaagcacggctgcgagggctttagcttcccgcccatcgtgagctttggcgccaatgccggcgacccgcatcacgagcccgatgacaccgtactcaagcgcggtgacgtagtgctgttcgatattggcggacgtcgccgcaactattgctcggacatgacgcgcacgttcttttggggcgagccggacgaggaggcggcacgcatctacgacatcgttcgccgcgccaacgaggccgccgaagcgcttatcgcgccgggcgtacgcatgtgcgacctggaccgtgccgcgcgcgatgtgattgaagacgcaggctatggacagtgctttacgcatcgcctgggtcactctatcggcctgcaggaccacgagccgggcgacgtttcgctcgtcaacgagcaggttatcgagccgggaatgaccttctccatcgagccgggcatctacctccccggccgcaccggcgtccgcatcgaggacctagccctggtgaccgagtccggcgtcgagattctcaacgcctgcccccacgatccggtccgcctagactagcctggtccccaagcccccaaactaagttgcggtggaatagttcctggatgggggtgcggacagaaagttggaccgtgaagcggtccggactggaggttcgcatgcgacacgcataaaaagcctcccatttctcgtgtccaagaaatgggaggcagttcagaaagccgtcgggcgcgtttttgatgtatcgatttttagccgaggcaagtccagttgacgggggtcgagccgtgctgttcgagtagccgattggctgccgagaagggacgcgatcccataaaggcggggagttctgccgtggcacggttggccgaaagcggcgaggggtgcgtggaggccaggcagaacttgccggttgccttgcccgcaccggttgcgacgagcttaccttcgaccatctgctgggcaaagcgaccccatgccaaaaagactaccggttggggcagctgacagcagcgctcgataacgtagtcggtgagcgcgctccagcctagtttggcgtgcgaattggcggcatgctcgcgcacggtgagcgtagtgttgaggagcaggacgccctgttgtgcccatggggttaggtctcccgtggcgggaatgggacaacccagatcggctttgagttccttgtaaatgttgcgcaggctcggtggcaacttggtttgcgtcgcggggaccgagaacgacagccccattgcctggttgggtccgtgataggggtcttgacccaagatgacaaccttgacctggtcggccggcgtgtaggcgagggcattgaggatgtcgtcttgtgctgggtagatagtctgctcggcacgcaaaagggcgatgcgctcgagcagctggttcgtagtgtcacgtaccggctgcggtgcatcgcccaaccaagttgctatgttgcggtcgcgggtcgcggcgtccatggggctcctttacgtcagatgctctgctggcatctattgtaaaggcgcaccggttgcctttatgccgcggctgtatgaagagtggggtctacgagacgtgctcgggcgctcctgccatgcgagcctgtccatgtgcgcggaggcgcggaagctcgacggttgctaccatgacgccggtgaggatgagggcggcgccaaagaaggcgatggggctcaggacctcgccgaccaggaagaacgaaaagacggcggagcagaccggctcgagcgagaaggcgaaaccggtggtctcggcgggcacgtggggctgcacgagcgtctgggtgataaagccgtaggcagagcagatgagcgcgagggcaacgacgaccacgatctcgctgggcgtactgggaagtgcgaaaccgccaaagacgcatgcggcaatgcccgagaacaggccgccaaagcccagctgccaaacgcccagggacagcggatcgacttcttcgacaaagcgcttggccacgataatgtggnnnnnnnnnngcatagataaaggccgagagcagcatgatgatcgcgccgggattcaggctggtaaagtcggcgcccgagagcagcagcatgccgcaggtgacgatagccgtgccgatgagcaccttgcgctcgggggcgcggcgcagcagggcggcgttggcaaacggcacgatcacgaccgtcaggctctgcaaaaagccggcagtggaggcagaagtgaggctggagcccaagcacatgcaggtgagctcggttgccataatggcgccgatgatagcggcacgaaccataaggtcgcggttgatgcggaacgcgcgcttgtggaagagcagcagacaggccacaaaggcgatgatgcagcgcaacgcgacgatgctcgtggcgttcatgctgtccatgccgatcttcatgaggggatacgaaaagccccatgcgacgggaacggaaaatgagagcgcgattgcttttttgcgatccatgggactccttttgttacagaacggtttcgcacaaaggattctgctctcagatgttgatgtagtaaagcgaatgtatcttcagtatgattaagaaacgctaaagtaggcgcgaaaagcgctggcaaaacgttttacggctgcattgatgtggaggcacgatggcatcgcggtatcagattgtttgtatggtggtcgaccgcggcagccttaaaggcgcggcggacgagttgggctatacgcaaagtgcggtgagccaggccgtcaaggcgctcgagcgcgagctgggcaccatgcttatcgagcgcggaaagcagggcgtttcgcttacgcgcgacggtaaacaatatctgccgtacctgcgccagattgtgaccgccgagctcgagctcgagggcaagcggcaggagctgctggggctttcgtcgactgatattcgcatcgcgacgtttaccaacgtgagtcgaaccgtgttgccgcgcgtgatccgcgattttggagccctgcacccgggcgtacgctttaccctcaagcagggcgattacacgcgcaacgcccagtgggtgcacgatggcgtggttgatttttgctttacggcacgcggatttaccgctgggctcgagaagcgcgtggtctatcacgacgagttggtggcattgttgccggccgcgcatccgctgacggcaaaggaaaaggtgacactcgccgacctggcgtccgagccgtttgtactgctggatgagggcgaacagagcctggtgctcgatgcatttgcggcgcatgggctgtcgccgcacgtgacgagcgaggtgactgacgactacaccatcatggcgatggtggaggagggcctaggcgtgagcatgctctaccgtcgtactgtggagggcatgcgagccgatattcgtgtgcggcccatcgtgcatgccccctcgcgcgacgtggtggccgcctggcgcagctgggacaccatgcctatcgccacgaggcgctttatcgactatatgagctcgcatattgtcaattaatgactgtcgtggcgttgagtgcggtgtttagcgggctgtcgctttggcttgggtggcgcgataggtgcgtgccgggtggcaaagtagtaccgccacgaccataaagaacgccgtggtgcccaggctgatggggtagaccatcatgatgttcgcaaaggtgcggaagtgcgggaacacgcagaacacccagtagaagcggatgccgcagacgcagatcatggtgatgagggcgggtgtgagcgagatgccaaagccgcgcaggtagcctgacatgttttcgtagaacatgctaaaggcgtacgccgggaagatcgagcacacgcggatatagccgatcgagacgatgttgggatcgctgttgaacagcgacaagatctcgcgccccaggccgacaataacgatgatcgtggtgagcgcgacgataccgccttcgaccaggcaggccttgagcgttttggtgcagcggtcgatctggcgggcaccgtggttttgtcccacaaaggtggtgcacgcctggctaaagctgttgagcaggttgtagcatacgtactccaagctcatggcggcgctcgatgccgccatgacctcggtgcccaggctgttgatggcggactggatgatgatgttggctacggcaaagacggcgctttggatgccggctggcaggccgatcttgacgatgcgcttgagggcgacggggtcgatagccaagtcacgcggggtgacgcggacgacagagtcggtcttgagcaggcggataaagagcgtagcggcgctgacggtgtaggcgatggcggtggcgatggcgacgcccgcgacgccccagtgaagtacggggacaaagatgaggtccaggccaatgttgaggacggtggacacggcaagcgcctgcagcggcatgcgggtgatgccgacggagcggaagatcgcggcctcaaagttgtagagcaaaatcgagggcatgctcagcaaaaagacgcgtagatagagtgaggcgagcggcatggtctcggcgggaacgttgagcgcggcgagcatgggctcggcaaagatctcgcccagagcgatgacgacaaagcccacgagtgccattaaaatcgaggtatggacggcgcgtttgaccatgttctgatcgttgcggccgatagcgttggcgatgaccacgttggagccaagcgacatgccaataaacaggttgagcataagactggtaagcggaacattggagccgaccgccgccatggcgagggttccctggtcgcccgagaagttaccgataatgaccgtggcgatgaggttcgacagctgctccaagatgctcgtggcggccacggggaaggcgaacaggggaatattgcgccacagcgagccggtggtcatgtcaatgtgcttagatacggtgtcagccatacgctctcaatctctaacatgctctttcgtgcttatttgcgcagatgatgatactcctaatgcaaccagtcggcacttggggacgttccttttctgtcggcagctggggacactccttatctcttctaactagtcattcaagaacgtccccaatgactaggtggggaaggcgtgagacaatggtgggcgttgtgttgttcgcgctaaggagttgccatgttgttgtgtcccgtttgccatgaaccgttggtggacgatgagcgtggggccgcatgtgcgggcggacaccggtttgaccgtgcgcgcgagggttatctatatctactgcgctcgtccaagagcggtgactccatgggcgatcccaagtcgcaggcacgcagccgtcgtgactttctaaaccgtggctactatgcgccgttgcgcgatgcaatggtcgagctggtgcgtgagcgggcggctgggtgcgctgcgtctacgaacggccccatgacgttgctcgatatttgctgcggcgagggctactacaccagcgccatgggcgcggtgccgggtgtggatgcttacggtttcgacctgggcaaagagatggtacgccttgccgccaagcgcggcgatgcgacctatttcgtggccaacatgaaggacgtccccgtggccgatggcgccttcgatatggtgaccgagctctttgccccctttaacgagcgcgagtttgcccgcgtgctggcacccgagggctcgctctacaccgtggtgccgggtgcccgtcatctctttgggctcaaggaggtgctctacgacacgccgtaccttaacgatgagaagctgccgaagaccaccgagctcgagttggtcggaacgcagcgggtgtctgcgaatattacgctccagacccaggccgatatcgaggcggtgttccagatgacgccgtactactaccgcacgcgccctgccgacaaagagcgcctggcaaacctggaaacgctccagaccgatatcgacttcatcatcgccgagtaccgccacagctaacaacctgccaaaaagggacaggtttattttggtaggttttatctgggcaaacgtaaagggccgaccgcggagatgcgcgatcggccctttttagttgcctggctgcaggggttatgagaagcgagcgcttataggcggtccttgttctcggccttaacggcgtgtgcctgctgaacaaagaacaggtcgtacaccacgatgacaaaggcgccaaagttgatggcgtcgccgccaaacgcgggaagcgtgagcaccgcttgggcaagcgtggcgaccgcggcaacaataccgagcttaaacgcgccgtccacctgcgaaggcttgttggcgcccttgataccggcgacgcctgcggcaaggtcgacgagacccttggcgataagcacgaccgctgcgagtgtggcgtacgaaccgtacgtggaatcgagaccgcccgtggcaataccgacgccggcggtgacgaggctggcgatgcccaaaacaaagtagatgagagcaaggattttgagagtcttgcgagtgaagctcatggctggtcctttcgatacgagtacgccaacttggcgcacccaatgtactgcacatatggtgaagcacattgtagttcaacgcggcgatgcatgcgtttgaaagcgcattgagcccgcgcagccaagcccaacctttcaaaaaggaaggctgggcgtaagtcaaatcgatggcagcgtatgcgcggcgctgcgatgatgggtccatggtaagagctggtctcaaggaggagccatgatgtacggagcagggcaagtgcatgagccgcggtcgttgggaaggcgcatgagtgattctgcgatcgctgccgtgtgcacgggattgatgacggtgctttgcattgggatgctgtgggccatgtcgcatgtgggacaatagcgaacggttgggtgctgacataaacggtgccccgcgtattcgttttgcttgttaaggagtgtccatgggcgtcgtcgatcccttatctgttgctcgggccgcggggcttgagctgatcgggaagcccgagggcctcacgctcaccgacggcacgatggagctgcgcgcggattttggccgcatgctgccgcgactcaagcagggccgtctgcagcaagagctgttggtaaaggccgcgcgcacaaaaggcatcgagagcccatgggcgattgacgccacggcaggctttggcgaggattcgctgctgctggcggctgcgggttttgccgtcgatctgtatgagcaggattgcgtgatcgcggcgctcctcaaggatgccttggatcgcgcggcagatgatccggcgcttgcgacagccgtggcgcgcatgcgcttacatgcgggcgaggacagcattgccggccttcgccatacagctgagctgatcgggcagggcgagctcaccgttcctgacgtggtgtatctggaccccatgtttcccggacgcaccaagagcgcggcggttaaaaagaagttccaactcttgcatcatctggaacagccgtgcgccgatgaggagacgttggtcgaagctgcgcttgcggtgcacccgcgcaaggtcgttatcaagcgaccggtgaaggggccactgcttgccggcgttaagccgagctatcaacttgcgggcaaggccgttcgttacgatgttttggtgccgccgcgcccgtagcttgcgtgcgatggctggcgctccgtcaatgccgtgccgatgcggcgcctatttccaagggtgcgacgtcaggtgccatccgccgcagtattcgcatttgtagcaggccaaaccgcgccgcccgcggttttcgcagtcggccataacggcctcggcctcggcgcgcgtgtcgtaacggtttttgcgctcgcacgacttgtagcgccaggcctcatcgcgctcggcgtccagggcgtcgcggcgctcgtcctcgcgtgcaaacaggtcgctcatatcgccgccggtggcagtgctcaaaaactcgctttttgcttttgaccaggcggctcgctttttgctccccatctgcatcgcgcccctctccaaacgttggtatcattgctcaatcaaagtgataccaataaacgtgaggtcgccgcgtgatgatcagaaaaaccctcgataccgacattcccgctgtcatggctatctatgacgcggcccgcgcctttatgcgcgcgcatggcaacgccacacagtggcccgagggcacgccttctgccgagcaactggctgccgatatcgccgccggtggcagctatgtgtgcgaagtcgatggccgcgtggtggcgacgtttgcctttttgcccggcccggacgagtgctatgacgtaattgaggatggtcaatggcgcagcgacactccgtacgccgtgctgcaccgtgtggcgtccgatggcaccgtgcacggtatcgcggctgcgatgtttgcctttgccaaggagcgtgccgatcacctgcgcatcgacacgcatcaggacaacctgcccatgcagggagccatcgccaaggccgggtttaagcgcgccggtatcgtatatgtgtcggacggtacgccgcgcgtcgcgtttgattggctgcgcgaggcataaaggccgagtcacataccagcgtttcaccgaaatgaaaatggccccgagtggggccatttttggtaaaacgcgttgttgtggggctcgcgttgctaccgtcccagatgaccccgggcagacaaaaaagggaggtgccggctttcgcaaggcgcgaacctacgaaaatcgccgcgcggcaacgcggggcgatgagctcggtcgggggatagggcccgcttcgcccgccggcccgtaaattgtatcatccagtgtggaacgaggatgcccgttgccgcgtgcgatgggcttgcaataagaggagagccatgtcgaagcaagcggtcgttggaattgtggcgcatgtcgatgccggcaagaccacgctggccgaggccatgctgttcaacgcgggtcgcattcgcaagcgcggccgcgtggacgatggtgattcgcatctggacactgacgcgatcgagcgcgagcgtggcatcacgattttctcgtcgcaggccgtactcgaccatggcgatacccacgtcatgctcgtggatgcaccggggcatgtcgatttttcggccgaggcggagcgcacattgcgcgcgctggactacgcgattttagttgtgggcgccaacgacggcgtgcaggggcacaccgaaaccctgtggcgcctgcttgcacgctatgacatcccgacgttcatctatatcaacaaaatcgatttggagaatcccggccgcgatgttttgctggcacaacttgggcaacgtctttccgagggctgcctggatgccagcgaactgctggcgggcggctccgttcaggaggacgctgctgcgttggacgaggcggcgctcgaggagtttcttgaggcgggtgagctttctgtcgcaatgctgtcacgcatggttgccgagcgcaaattgtttccctgctttgcgggatcggcgctcaaggaccagggtgtggcagagctgctcgacggcatatgtgctctgatgcgcgagcgaacatggccccaggggatacgcctaggcgcggtccaagaaatcgtccgcaccccctcctgattgttccggctttgggcttgtctacaataacccccgtaaaagaaatgcggaaggttaccgagtcccctcggacgtgggcctaaccaaagtctttgatcgcgagcgtctcaatgggcgcattcgattgattttggttgggctatatttatgaagggacatgtcaccatgggtttcctttctcgcctgatgggcggttcggatgagcagaagactgcagcttccgagttcgaaatcctcgctcccgtttccggcgagcttgttcatctagaaaataccaatgaccccgcttttagcagccgtgctgtgggcgatggcgttgccgtggttccccaagagggaacggtgtgcgctcctgtttccggcaccgttgcggcgctgtttccgactgagcacgcgctgggcatcatgtccgacgacagctctgctcaggtgatgctgcatatcggaatcgacactgttaaacttgagggcaagggcttccatgcgcttgttgctcagggtgaccatgtcgacgcgggccagcccctcgtcgaggtcgatttcgacgcggtccgcgccgccggcttcgatcccacggtcttcgttatcgtgtgcgagcgttcggagaactcgactcttcgtgagcatgcttccggccctgttgctgttaaagagcctgttatctggctttccgagtaaattcttgtggtgggtgccgtggttatcaagcgagtttttaacaacaacgtcgcaatggtcacttcggacgatggctccgagctcatcgtcatcggtcgaggcctctgctttggccgtcatgccggcgatgccatcgatgaggcgtcggtcgaaaagacctacgcgttgcaggagggaacttctcaggactcgcgtacgattgaccgcttggcacatcttttggagtccatccccaccgtcaacctcgtgattgccgaggacattgttcagatgctccgtcgagagctcaatgttgatatcaacgacaagattctcattgctctcgcagaccatatcagccttgctttggagcgtgagcgcaagggcgtctcctgtgagaatccgttgctgctcgagatccagcagttctatcgcaaggagtatgcacttgcgggccgtgcactgcagattatcaaggagtatatgggcatccagatgagcgaagaagagcagggttttattacgctgcatatcgtcaacgccaccatgccgcaacgctccgatcgtttgattgtttcggtccagcttgttcgcgacgtgctcgcgattgtttctgagcgctatgctacgaccctcgatgacacctcgctgccttacgaacgtttcgttcgtcacctgcagtttttcgcacagcgagcgctcgatcctacggccgggcaaatcaacggagacgcgctgttccgaatcgatgaaacggcgtatccgtgcgcattctcgtgcgcggacgccatagccgcccacttgtcgtctacctataacgttgtcgttaccgatgccgagaagagttatctcgcatatcacattgttaacctgcttggagaacctggtctctaggcataacgtgcccacacatcgattgatataaggcagggctcacggccttgtccagggcacatctgtcttaatttgcggaaaaggaaggggagtaccgctatgaccgcaaaaaagaagttcaatttcaaagcgccgttggaggtgttcgcgaagtcgatcgttcagccgatgatgtatctctcggttgccggcatcctgctcatcgtgggcatcattctgaccaacaagaccatttgcgctttgatccccgtgctgggctccggtccgttccagcttgtgggcgccgttgtctatcagtcgttgatgtttatcatcaacaacctctcgattctgttctgcgtgggtatcgccggcgccatggcaaagaagaacaagggccatgcttcgctgatcgccctgatgtcgttcttcctgttcctgcaggctaacaacatcgtgctcaacgccaccggctctcttgccgatgcgagcggcatgctcggccttaccggaaccggccaggccaccgttatgggcatccaggtgctcgataccggcgtgtttggcggcatcattcttggttgcatcaccggtgccgtgttcaacaagtactcgaacaagcagtttcccattgccctttcgatgttctcgggcgttcgcttcccgttcctgatcatgatcatcatttcctggatcatgggcgctggcttctgcatcgtttggcctccggttcagggcgccatctcctccgttgccggcatcattaaggagtcgggcaacatcggtctgtttatctacggcatgctcaacaagctgctcgttcccaccggtctgcaccacctcatctacaccccgttccagttctccgatgtgggtggtaccctgacgctgggcgatcaggttatcgccggcgcctatcccatccgtgttgccgagatggcaatgacgggtcagcccttctccgatagcacgtatttcaacagctacaccttcaacaacctgtggccctacatcggtatcggtctcgcctttatcgtcaccgcttacaaggggaacaaggataagaccaaggccgttatcatcccgctgatcatcaccgccgtgctctcctgcgtgaccgagcccatggacttcctctttgtctttgccgctcccgtgctctttgtcgttcactcggttctttccggcatcttcctggttctgctcaaggtcctctccgtgcccgcttcgactgcaggcggcatcatcaacatcgtggtttccaacctggtcctcggtgtcgacaagaccaactggccggttatgctggtactcggagtcgtcaacgccgctctgtacttcttcctcttcaccttcctcatcaagaagctcaacctccacacgcctggtcgcgaggaggagtccgagctcgccgagtccgttgccgagggcgaggccgccgcgtctgtcgcggtgaagcagggcgctgttgccgcagctcccgcagagggcgtcgatgcaggtattgccgacctggtcgcaggtcttggcggcaaggacaacatcgaggagctcgagaactgctttacgcgtctccgcgtgaacgttaagaacccggacctcatcaatgaggacctcatcaaccacgtgcccaacagcggcatcaaccgcaacggcaataatatccagatcatctttggcatgaaggtcgccgagatgcgcgacaaggtcgaaaacgcaattgagaaggagcagtaaacaatgatcattactctgtgtggtggcggatccacctttacccccggcatcgtcaaatccatcgccctgcgcaaggacgagctcgacgttgacgagattcgtctgtacgacatcaacgaggagcgccagcgcaagatcggcgtgctcgtggactggattttgcacgaggacctcggccttgacatcaagctcacggtgaccaccgacaagaagacggcttttaccgacgcgagcttcgtgtttgcccagatgcgcgtgggcggctatgccatgcgcgagcaggacgagaagattccgcttcgtcatggctgcgtgggtcaggagacttgcggttgcggcggccttgcctacggcatgcgcaccatcttccccatggtcgagctgatcgatgacgttgagaagtacgccaagaaggactactggattctcaactactccaaccctgccgccatcgtctccgagggctgccgtgtgctgcgtcccaacgctcgcatcatcaacatctgcgacatgccgatcgcgattatcgacgtggtttgcgccgcgctcgatatcgacaagaaggatgtcgagtacgattactttggcctcaaccactttggttggttcacctcgatccgccacaagggcgaggaggtgctcccgcagctgcgtgagtacatcaaggagcatgagattctgctgcccgattcctacctcaagggcatgggctcgctcatggcaaagaagcccgaggagaccgccgacgagcaccccgagcagaatcgccacaccaagggcagctggtactacgtctggaagggcgagtacgagatcatggagtgcttcccggagtacctgcccaacacgtatctgaactactacctgcagcagaaggagttcgtcgagcactccaaccccgagcgcacccgtgctaacgaggttgaggagacgcgcgagaagaacctcttcgacggcatcgatcactacgagaagacgggcgagatcgacgagagcacgttctatgcgggcagccacggcgactggattgccgatctggccatcgctctgaagaacgacaccaagcagcgcttcctggtcatttgcgagaacaagggcgctatccccaacatgccctacgacgctatggtcgagctgcctgcctacattggcaagaacggccccgaggtcatcagccgtgacaacattcctctgttccagcagggcctcatgatgcagcagctgaactccgagaagctcgtggtcgaggctacgatcgagggttcgtacgagaaggcgctcaaggcctttacgctgaacaagaccgtgccttcgatgaaggtcgccaaggaggttctcgacgacatgatcgaggccaacaagggttactggcccgagcttaagtaaaagcaacagagtcgctggccgcatacctggagcaatgcccgtccacgtgattgcgtgggcggggcattgtcatttggtaacgcgttttatcaaatatggcatttatctgcggtaatgttctattccaccgctgatggtgacatttcatgccgcctgccgaactgcgtggaggcctaacaactttataggtcagtgttgtgcgtgtagcaatttcgcccggcctcgcctccgggctgccgcatgagaggggatcttatggcacgactgcacgtaatggaacgcagccacgctcaggccgtcatggacgacctgcacgatgcgcttggacgccgtctggcggtgagctcgctcgccccgtgccccgtcgagtttacggcggcgctcgtcaacctgtgctccacccagagctgcggcaaatgcacgccctgccgcgtgggcctgagcgcgctgagcgacctgctcgccgatgtgctcgagggccgcgccgacgagtccacgctcaacttgattgagcgcactgcccgcaccatctatctttcgagcgactgcgccatcggttacgaggccggtgccatggcgctcacggccattcgtggcttccgggacgactttgagcatcacatccgcgagcactcctgcggctttgaccgcgaggctcgcgtcccgtgcgtctcgggctgcccggcgcacgtcgacattcccgggtacatttcgctcgtcgaggccggccgctatgccgatgccgtcaaggtcatccgcaagaacaacccgctgccgctcgtctgcggtttggtgtgcgagcatccctgcgagatgcactgccgtcgcggcatggtcgacgatcccatgaacatcctcgccctcaagcgttttgccgttgagcacagcgacctcaatgattacaagcccagcgtggctgacaacaccggcaagcgcatcgccgtgattggcggcggcccggccggcctttcctgcgcctactacctggccgtgatgggccataaggtgacgatctttgagcagcgtcatcacctgggtggcatgctgcgctatggcattcccagctaccgtctgccgcgcgagcgcctgcaggccgagatcgactggatcttgagcgccggcatcaacgtggaactcgaccactccgtcaacggcgaggagcttgcccgacgagttcgatgtcgtctatctggccattggtgcccacagcgataagaagctcggccttccgggcgaagaggctcccggcgtggagtcggccgtcaagatgctgcgtgccatcggcgacgacgagctgcccgacctgagcggccagcgcgtgtgcgtcatcggcggcggcaatgtggccatggacgtggcgcgctctgccgtgcgctgcggtgccgaaaaggtgagcatcgtctaccgccgtcgcatctgcgacatgacggcgcaggatgccgagattgccggcgcccaggccgagggctgcgaggttcttgagctcaccgcaccgctcgctatcgagatgggcgaggaaggtcgcgtgagcggtctgcgcgtgcagccgcagattatcggcgagccccgtcgtgggcgtccggccccgcgtgccgccgccacacccgagcgcgtcattccctgcgagcgcgtgtttgtggccatcggccaggacatcgactccaagccgtttgaggacatgggcgtcgcctgcaggtggggctgcgtggtcaccgattcggatggcgccgtgcccaacttcgatggcctctttagcggcggcgactgccagaccggtcccgccaccgtcatccgggccatcaacgccggtcgcgttgcttcggcaaatatcgatcgctatctgggctttgaccacaagatcaagcttgacgttgagctaccgaccgtacagtttaagggcaagcacgagtgcggccgctgcgagctgggcgagcgcgaggccggcgagcgcatccacgattggaatctggtcgagcagggccttaccgaggaggaggcacgccaggaggcaagccgctgcctgcgttgcgaccactttggctttggtgcgttccgcggagggaggaacctggaatggtagagctcaacaaccccactgtcagcgacaacaccgaaagcggagcactcaacatggtcaagctcactatcgataattgcgaggtcgtggtgcccgagcacaccacgatcctggacgcggccaagtccgtcggtatccagattcccaccctgtgctacctgcgcgatctaaacgagatcggcggctgccgcgtgtgcgtggtcgaggttgagggctgcgaccagctggttgccgcctgcaacaactacgtgctcgacggcatggtggtccgcaccaacagccccaaggcccgcgaggcgcgtcgcaccaacgtgcagctgctgctgtcccagcacgactcgcgctgtacgagttgcgtgcgcagtggtaactgcaacctgcagaccatcgccaacgacctgggcatcttctatttgccgtacgagcagcacctggcgcgcgagggctgggacttcgatttccccatcattcgcgataacgacaagtgcattaaatgcatgcgctgcatcaaggtgtgcgagagcgtgcagggcttagggatttgggacctgaccaaccgcgccacgcataccgccgtgggcacccgcgggcgtgcgccgatcggcaagaccgattgcgtcgcgtgtggtcagtgcatcacgcattgtccgacgggcgccctgcgcgagcgtgacgataccgagaccgtgttcgacgccatcgccgatcccgacaagatcgtgctggtgcagattgcgccggccgtgcgtagcgcctggggagaggaactcggcatatctcgcgaggaggccaccgttgagcgcttggcctgtgcgctgcgccgcgttggctttgagtacgtgttcgacaccgatttctcggccgacctcaccattatggaggagggctccgagctgctcgagcgcctgggtaaggccgccaagggcgagggcgacagccgtggctggcccatgttcacgagctgctgcccgggctgggtgcgctttgtgaaggcgcgttaccccgagtttgtcgacagcctgtctacgtcaaagtcgccgcagcagatgtttggcgccatcgccaagacctactacgccaaggtgctgggcgtggagcccgagcgtctgtttgtggtgtccgtgatgccgtgcacggccaagaaggccgagtgcgcgctgccgagcatggtgggcgaggacggcacgcccgatgtggacgttgcgctgacggtgcgcgagatggtacgtatgatccgcgcgaaccacgtgagcgtggacacgttggtcgaggagccgctcgacacgccgctgggctttggcacgggcgcgggtgtgatctttggcgccacgggcggcgtgatggaggccgccgtgcgctcggcctattacctggtgacgggcaagaaccccgatgccgatttctttaccgatgtgcgcgggctggacggctggaaggaagccgtggccgatatcgatggcaccggggtgcgcgtcgccgtggcgcacgggctgggcaacgccgcccgtctgctcgacgcgattcgcgacggccgtgcgagctatgacttcgttgaggtcatggcgtgcccgggcggctgcgtcggtggcggcggtcagcccatccacgacggctgcgagctggcagccgagcgtggccaggtgctctggggcctggatgccgctgcggacattcgcttctcgcacgagaatcccgatgtccaggcgtgctaccgcgagttcttgggcgagccgctctcgccgctggccgaggagctgctgcatactgaccatcacgcatggacgatgcccaacgaggggacgtactagcgatgcgcgcgtttgattttgagatgtcgcgccgggggtttgcctcggcgctcgccgcgggcgccctgtcgcttgcgctcgcgggctgtggcggcggggctgccggtgccgggtccgccgcgggttcggctgccgggcctgccgccgacggcgtcgtagccctcgtcggcgaccttgtcggcgagcgcggtcatcttcttgccggcctcgtagacgttcttgccgtcctcgacgtagccctcctggctaaagtgcatgatctcgatcttctcggtttccttcatggcttttcctttctgtcctgcacgcgaatctatacatcgcgtttcttttcgataccaattatagacatacacccaacgtgtttttaataccacttttcaatctgttccaatcctcggtgaacggtcgaaattctctggtgagtggtattaaattagaatttgatgtatagctaacgcccccggcgtctcccttgtgtgacaaagaacagcgttcctaccagcgcaataatggtcgatgctccaaacagtaccgtctggacgcccaaagcctccgccaaaaatggagccgccagcagcggcagcaccccggcgctcatcaggccaaaacgcacaaagccggtaatgcgccccaggtatttgatgtcggcacgctcctgaatcaagatcatctgcagcggctccaggaacccccaggccagaccgttaatcgcctgaccgataatcgcgacccccagcatatcggtgcccacgtacaccatggacccaatgcccacggccatgagcgcgccgagcagcaatcgcaggttgacatggcgagcagaaagcttggtcaggatgaacgcacccaccgaggaagtgaggcccacgaccgaggacagccagcccagccagacgatatccacgttgagcacatcgcggtagaacaacgactccagcgaatcgaacgcgccgaacgcaaagaaacccaaagagcccgatataaagatgaggcgcaagtcgtggtcgcgaaacgtaagtcgcgcaccctcggccatgccgcccaaaataccgcccttcggcttctccccttttgcgggagcaacacactcgtgacagcccaaggagagcacggccgccacacccatcatgcccgccatgagcagatagaccgattgcgtggcaaaacagctcacgatggcaccgccgagcagcgggccagcggtataggcgatattgctgtagaacaccatgaggccgttcacgcgggtacggccctcggtggtcgactccaggtatcccggaaacgcatgcgtgcaggtgttgataaagccgcccgcaagtcccaagacgcacgcggcaaacacaagcccagggacagacaacggcgccaaccccacgccaagcgatagcactgccgtaatcacgcacgtcacaaacgacgtccggcgcggtccaaagcgatcgatgaccgaacccgacaccatattgcccgccgacgtcataagattgcgcacgagcgtaatggcggcaaccaaaaaggccgtgccggccagatcatacgtggccgcaccgataagccccaaaaagtagaccgcgttgttggcgcaccactgcagggactcaataagaatcagcctgacctctgccggcgtcaggcgcattgcttcgcgatccttcgcgaacatacgaactccttctatacaaaaaggggatggagggcataggcctgctccatcccctttccaggttgcaacgaaaatctatgcagccggacccttacgccagcacgccgaagaacgcgccgatgatgcccacgaccatggtggccacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacgccagcacgccgaagaacgcgccgatgatgcccacgaccatggtggccacgatcagcaccatggggttgatcttcttggacagcagccagtagtacagccagaaggcgatcatgccgagcatgccgggcatgatgccgtccaggatgtcctggagggtctgggcgtcctcgcccgagccgatggccaccgggatgctggcccagaacatgtccttgcacatggcgcccacgaccatgacgcccacgatgcccacgcaggtcatgatcttctgcatgaggccggtcctctgggcctcgtccaggaagcccacgcccagctcgtagcccttgacggcgccccagacgcgcagcgcgaagccggggacgttgtagatgagcaggaaggcgatggggccgaaggggttgccggcctggcacaggctgatgcccaccgcggcggcgaccacgcgcagcgtcgacaggaagatggagtcgccgatgccggacagcgggcccatgagggcggccttgacgtcgttgacgctctcgggctcgatctcgccgcgggcgaccttctcctccatggccatcgcgatgccgccgacgaacggggcgaactggacggtgatgttgaagaacgcgcagtggcggtgcagggcctcggcgtagtcgtcggagcggccggcgtagatcttcttgagcatgttggcgaccatcaggcagaaggcgatgttcatctgcttgtagtaggtccaggagaactccatgcccagggcgccgacgttgacggcgctcttgacgaggtcggagcgcgtgatcttgttctcgggactagaagtcatcgtcctcatccccttccgcggagagctggggctgggctccgcccaggccgagcaggtcgaacttgtcgatgccgatgatgatggcgatcagggcgacgcccaggacgggcacgttggcgtaggagcacagcaggaagcccaggaagtagaagggcacgagctgcttggtgagcaccaggcggccgagcatggcgaagcccatggcaggcaggatgttggcggccacgccgcaaccatcgatcacaaaagacgggataaagtcgagtacgccctggatggcgtcggagcccaggtagaatgcgccgccgcacagcaggaagtactcaaggcagccaaagaggcccatgctccaatgtgccgcgtagatacccttgaggttgcccttggcagcgcacttgtcagcaatgtcaacaatgatcgagaatccagcatccgtaatgttgccgatcgtcagcgaaaggacggcgataggcatggcgagcgcgatggccgtctcggtaccctgaccgagctgaatggcaaacgcgcaggcgagcacgccgccgacggtttcgttaggcggtacgtaggcgccgatggagatcgagcccatgaacagcaactccaggctggcgccgacggcaaggccggtctgcaggtcccccagcaccaggcccacgagcgggcacaggacgatggggcggaacgcgtagagggtgccgagctggtagtcgaggcatccaaacgctccgactaagccgacgaggattgcttggacaagcataattcctcccaataaggaatctcgaaccgtcgtcactcccgtcgcgcgcgttgttgatatcaattccgggagttcgattccacggctcgaagcgtacctggtgtgctgctaacacccatgccaggcacaaatgatttgataccaattatagatatgcaggttcttactatttaataccactcgctcagcggggtgttttttaccgtaaacggcagacgcatcccatcaggcacgttccttgtttcgatggcggacaagcgccaccaaaaagccatcgccaaaggcatcgcatgccaagttgcctacaatcaccaaaacgataatcgccgcgcccaaaagctcgttccagcgaaagacctcgccaaagaggagcgccgaccagcagggagcgagcacgacctcactcatgcaaaccaagttggccgcaaacgcgttggtgcgcgcaatccccttggcatacagcacgctcgcaaggccactgcaaaaaaggccatgcaccagcatgagcccccactcaaatggtctcacggagtctagggcgccggcaaaatagacaatcggcagcatcgagataccgcaggagatgagcgaggacaccatgggcgacgcatcggggcgagagttcaaaaagaaacacagcccaaaggtggcgcccgaaatgacggcaagcaggttgccgagcatgccctcggcactcaaatcgcctaaaaagaaaagtcccatacccgtaaaagcaaccaccacggaggcaatcttcgcaggcgagggcaacgtgcgagttgcgagcgattgatacacgataacgaaaatcatcgaagtgtactgcagaacgatcgcgttgccgaccgtcgtgagctggtttgcaaagttaaacgtggtgcccgttacgaagttacagacggccacaaggacaataagacgactgacgcggaggacgggcctgccgacgagcaggataaagagcgccataaatattgccgtgacggcaccgatcaaaagagctgactgcgaattggcacgaacgaggatgccgataaaactccacaagagcgccgtgccaaatagatacatcgccccgctcacgctattatcgggtggattgtcagatcgaatcacgaagcacctccagctagctttcggtaataaaaaacggcgaccgcaatgggtcgccgtttcccttgggggcagaatagaacgaaggagtctacgccagcacgccgaagaacgcgccgatgatgcccacgaccatggtggccacgatcagcaccatggggttgatcttcttggacagcagccagtagtacagccagaaggcgatcatgccgagcatgccgggcatgatgccgtccaggatgtcctggagggtctgggcgtcctcgcccgagccgatggccaccgggatgctggcccagaacatgtccttgcacatggcgcccacgaccatgacgcccacgatgcccacgcaggtcatgatcttctgcatgaggccggtcctctgggcctcgtccaggaagcccacgcccagctcgtagcccttgacggcgccccagacgcgcagcgcgaagccggggacgttgtagatgagcaggaaggcgatggggccgaaggggttgccggcctggcacaggctgatgcccaccgcggcggcgaccacgcgcagcgtcgacaggaagatggagtcgccgatgccggacagcgggcccatgagggcggccttgacgtcgttgacgctctcgggctcgatctcgccgcgggcgaccttctcctccatggccatcgcgatgccgccgacgaacggggcgaactggacggtgatgttgaagaacgcgcagtggcggtgcagggcctcggcgtagtcgtcggagcggccggcgtagatcttcttgagcatgttggcgaccatcaggcagaaggcgatgttcatctgcttgtagtaggtccaggagaactccatgcccagggcgccgacgttgacggcgctcttgacgaggtcggagcgcgtgatcttgttctcgggactagaagtcatcgtcctcatccccttccgcggagagctggggctgggctccgcccaggccgagcaggtcgaacttgtcgatgccgatgatgatggcgatcagggcgacgcccaggacgggcacgttggcgtaggagcacagcaggaagcccaggaagtagaagggcacgagctgcttggtgagcaccaggcggccgagcatggcgaagcccatggcaggcaggatgttggctgcaacgccaaagccagcaaggacaaagggcgggatgaagtcgagcatgccctggatggcgtcagcacccagatagaacgacagcgagcacagcaggaacgccatgatgataccggtcaaaccgatcaggaagtgcatcgcatagacacccttaaggttgccctgggcagagaaaacatcagcgcggtcgaccaggatcggcagggcggcgttaaggatgttcttgatggcaaggcacagcgtggcgatgggcatggcaagcgcgatggctgcctcggtgctctggcccagctggatagcgaaggcgcaggcgagcacgccgccgatcgtctcatcaggcggcacgtaggcgccgatggagatcgagcccatgaacagcagctccagactcgcaccgatcgcgaggccggactgcaggtcccccagcaccaggcccacgagcgggcacagggcgatggggcggaacgcatagagcgtaccgagctggcagtcgaacttaccaaatgcggcgataagtccgatgaggattgcttgggtaagcatatatccccctttcctaataggacactacgaagagctcagactcttcgaaattgaacgcctagagcacgctggcgcagtcgaccttggggtcgtcggccaggggtcgaatctcgacctcgacgccacgatccagcatctcgcgcacatcggcttcctcggccgcagtcaggaagatctgacgagagacctgacgagcatcgggacgcttctcgtcctttggcttggtgttgcccaggttgaccgacttgatctgcgggcagccctcaacaagctgctttgcctcagcaatagtggcgacacagatgatcatcttgtacttgtcggtcacgcccgagttgatagcttcgattgcatgctccatatctttgatgacgagcttgcagccggcaggcttgcccatcttgagcgtcgtcttccacaccgggtcgttagcaaccttatcgcccacgcagaagatgcagttggagccaaggccctgaacccaggaaactgcgacctggccatgaagcaggcgatggtcaacgcgaagtagctgaatcataatgtgaccccccaaaggtcttgtgccgtcttacggcgtgtcagtaggtgctgcggattagaactcttcttcctcgtcgccatcgaccaaaagatcgttgacaaacttcacgcgcgtatcgtccgcagcgacgatggcgcgaatcgtctcctcaaccggcgccgactcgtcagagaacagcagctggatgagcagaggaaggttcatgttggtaacgaggtacgtgcggggacgcgtctggacaatcttggtgaactcgttgttgacgctgccgccaaagaggtcggtgcagacaacgacatcatcgtcagcagacatgcctgccagcagtttttgggcctcctcggccacgtccatgcggccatcgacgaacatcgaaagatcgtggacgttgtcgcgagcgcccgagagcagctcgacgctctccttgatgccggtagcgaagtgcgcatggctggcgatgatgtactgtctcattctgtgttcctctcaatagcccggcacgttcccgcacccgttttctttagtagtcgaactggtgatagtagcgacgatacttgaggttgtgcttggtgaccgtctcgtagtagcgagccaggcggtcggtcacgagcaccgtcagaatccacggggagacgatgacgcggaactcatcgtcaaggccggggatcgcgaactcggcggtgtcgatgatgttgatgtcggtgtaaaaagcctcccatttctcgtgtccaagaaatgggaggcagttcacgctgggcgagaggggggcctttctttgtgctgggggtgtctgaccggtcgtttgtctcgatctgtaacgggtagggccgatttcggacgctaggtgttacagatcgagacggttccgccgagctaaccatttcatctaaatctgtaacaccaaaggcgaatttcagttgctagatgttacagattgagataaacccaaggggaggggccggtatgtctcaatctgtaacagctggggccgtttttaccgagtagctgttacagatcgagattgtttggtagagtcgggtcacagggtaacgtgcgggcacaaaaaacggagccgtgttgccacgactctgtttctcaagaggatgggtaagggaagcgaaattagttcaggtgccagatctcgtcgttgtactgggagatggtgcggtcggacgagaaggcgccggcgttggcgatattgatgagcgccttgcgcatccaggcgtcctggtcctcgtagtcggccaacacgcgctccttggtctggatgtactcctcgatgtcgagcagggccataaaccagtccttgcccttaatgtcgtcgtgcaggcgctgcaggcgctcggcgttgccggtcgccataaaggcggggttggtgatgaagtccaccagcagtttaatgccgggcttgcggtaaagtgcaccggcgctgtaggtgccgtcggcatagagctgctcgacctgcttggacgaggcaccaaaggtatagatattctcgtcgcccacgagctcggcaatctccacgttggcgccgtcgagcgtgcacagggttagggcgccgttgagcatgaacttcatgttggaggtgccgctcgcctccttggaggccaggctgatctgctcggagatatcagcggcggggatcacgcgctcggcggcggtgacgttgtagttctcgatcatgacgacctgcaggtagggagccacgtcggggtcgtttgcaatccactgcgacagcgtcaagatcagatggatgatgtcctgcgcgatagtgtaggcaggcgccgccttgccgccaaagatgatggtgacggggtgcttaggtctgttgccgttcttgatatcgaggtacttccagatgatgtagagcgcgagcatctgctgacgcttgtactcgtggatgcgcttgacctggacgtcgatgatggcgttggagggaatggtcacgccctgctcgagcgccatgaactggcgcatgatggccttggcttcgaccttggtggcggccaggcgctcaagaacgtccttgtcgtcggcgaacttggcgagtttgctcagatcgccggtgctgcgccagtcggtgccgatcacatcgtcgagcaggctggcgagcgcggggttggccccatggatccagcggcggaaggtgatgccgttggtcttgttggagaacttcttgggatagatctcgtagaacggatgaagctcggtgtcctccaggatcttggtgtggagggcggctacgccgttgatggagaagccaaagtggatgtccatgtgggccatgtggacggtatcgtgttcgtcgatgatggcgacgcgcgggtcatcgtgctcggccttcgcgatctcatcgagcttgacgataatgtcggcgatggcaggggagaccttctgcaggctggcgagcggccacttctcgagcgcctcggcaagaatcgtgtggttagtgtaggcgaccatggagcgtacgatggtcacagcctcgtcaaactcgatgccatgttcggtggtgagcaagcgaatgagctcggggatgaccatggtggggtgcgtgtcgttaatttggaccacggcgtagtcggccagatcgtgcaggttgctgccgcgctcgacggcctcgtcgatcaggagctgggcggcgttgctcaccatgaagtactcctgatagatgcgaagtaggcggccctgctcgtcggaatcgtcggggtagaggaacaaggtgaggttcttggcgatctcggtcttgtcgaagtcgatggagctgccggggaccaggccgtcgtcgacgctcgccaggtcgaacaggcgcaggcggttcttggtgggctggccgtaaccgggcacatcgatgttgacgagcttggaagtaacggcaaaatcgccgaactcgacggtgtaggagcggtcatcgtcgactaggatgtcctgctcaccgagccactcgtcggggacggccttctgctggttgtcgacaaagcgctgacggaacagaccgtagtgatagttgaggcccacgccatcgccggtcaagcccagcgtggcgatggaatccaggaagcacgcggccaggcggcccaggccgccgttgccgagcgacggctcgacctcgaactcctcgatcttgttgaggtcgtggcctgcggcggtgagctggtccttaacctcgtcgtagatgccaaggtcgatcatgttgttgatgagcagcttgccgatcaaaaattcggcggaaatgtaatagagctttttcttgccgttgttgagcgggcaggcggcggagcgctcctgcacgagtttgaccagcagcttgtaaatgcgacggtcgtcgagctgctcgagcgaggtgccaaaagactgctcggcgagttccatgaggttaatttggggcatgttttctcctgtgatgggttgtttcatgtctgcaattcataagaagcccgcgcgaggggattggggtggcctcgcgcgggaaaagcaagcgcgtccgcacggtggggaggggtcgggcgcggtagctcctattgaggaagctcgatttcggcttccgacgggatgcggaagtaggtctcggtccagtcggtgagtttgtgctcgagctcgcgggtgatggcgccgtcgagcatgcgccaggtccagttgccgcccagcgtggcaggggtgttgatgcgcgcctcgttgcccaagttgagcaggtcctgcatggtgtagatgcacgtgtcgctcacactggcggcgatggtgcggttgagtgcgtctgccatgggttcgccggcctgctgatgggtgtacagggctgcctgctcgcgctgacgcggggtggccgttccctcaaaccaaccgcgcgctgtctcgttgtcgtgggtgcccacataggcgacggtgttggcgatgtagttatgcggcaggtagtacgagttggtgccctcaaaggcaaactgcaggatcttcatgccggggaagcccgagttgtcgcgcatgttgatgacgccgggggtgaggaagcccaggtcctcggcgatgatgggcagcgtgccgagcttttcctcgagcgtcttgaagaacttgaggccgggaccctgcgtccacgaaccgtaggacgaatcgggcgaggagaacggcacctcccaataggcctcgaagccgcggaagtgatccaggcggatgacgtcgtacatgtcgagggcggcgcgaatgcggccctcccaccaggagaaaccgtcggactccatggcgtcccagtcgtagatggggttgccccagtactggccggtggccgagaactggtcgggcggcgtgccggcgacgctcacgggattgccggcggcgtcgatcttaaagagctcaggcgtcgcccacatctcgacggagtcacgcgagacatagatgggcaggtcgccgatgatgagaatgtcgcgctcgttggcataggccttgaggcggctccactggcgatcgaagaagtactgtgtcatctggtggtagagcatacgcgccggatggtcggcgcagaccttggcggaagcctcgccgcgggtgcggagctccgcgggccactcccaaaatgccttgagaccgcactcctctttgacggtcatgaactcacagtaggggatgagccagtcctcgttggcctggataaagtcatcgaaatcggccggcttgtcggcggcaaagcgctcggcggcgcggtcgagaatctgacggcggccgccaaagatagcaccgtagtcgacattgctggggtcggatcccagatagacgccatcgatatcgcgctgctccagataccctgcctcgataagctcggcaaagtcgataaagttggggttgcctgcgcgggccgagaacgactgatagggcgaatcgccatagctggtcgtcgtaaggggcagaatctgccagtaatgttgtttgcacgaggcgagaaaatcgacgaagtcgtaggcattccagccaaagccgccgattccgtatggtccgggcagagatgagacgggcatgaggacgccgcttgcacgctccatgaatgcgctcaccaaccttcttgttgtggggtcggcctgccgatgggtgtgcagtccgcctccgatgttctgattcgatacgcctattgtaaaacatgttgtttaaacatgtacaggcaagataaaaaagttggtcgattttcggcgaatggttacatgccatgaaaaagccccgacctcacaacgtgagatcggggcaagagcggtatgtaggttttttgctactcggcgtcggcgaagccgttggggttgtggctctgccagttccagctatcgcggcacatgtccgcgatgtcgtactgggccttccagcccatcatgcgctcggccttggaggcatcgcaccagttggcagcgatgtcgccggcgcggcgctcgcggatcacgtagggcagctccttgccacaagccttggagaaggcggcgacgacctcgagtaccgaggtgccggtgccggtgcccaggttaaagatctcgacgccggtcttgccgttcatccagttaagggcggcaacgtgaccagaggccagatcgcacacgtggatgtagtcgcgcacgccggtgccgtcgggggtggggtaatcgttgccaaagacctgaacggcctcgagcttgcccacggcaacctgggcgacatagggcaccaggttgttggggatgcccttggggtcctcgccgatcaggcctgacggatgagcgccgatggggttgaagtaacggagcagcacgacgtcccactcggggtcggcggtgtggacgtccataaggatctgctcgatcatccacttggtccaaccataggggttggtcgcgggcttcttaggatcctcctcggtgacgggcgggttgtccgggtcgccgtagacggtcgaggagctcgagaagatgatggacttgcagccatggttgcgcatgacgtcgatgagcaccagggtgttctcgatgttgttgtggtagtactcgacgggcttgctcaccgactcgccgacggccttaaagccggcaaagtggatgacgcggtcgatctgatgggtatcgaagatcttgttcatcgcatcgcggtcgagcacgttggcctcgtagaaggtgaggttcttggcggcctcgtcgcccacgatggccttgacgcggtcgacggcgacggcgctggagttggagagatcatcgacgatgacgacctggtagccaccctcgagcagctgaacgacggtgtgcgagccgataaagccggcgccaccggtaacgaggacgcaggtgtctttggggtcgagtgctttggacatgtagtctcctatcgaatcaggaacacttcttcaggggagtatagcgcaggcagggacgcccaaatcgtgcgctgtaggaaaagcagaggattgtgctaacgtactcatagaagagcttgcgtacgcataacctgatctttggcatttgcttacgagccgctgaccttgcagtttcctgccgttcgtggaaatcgttgggacgcgccatatgtacgctaatatgtatgagttgagcgacatataaataagcatgtaacggagtacatatgtcaccaaacagcgattccatcctttcccaggagttctcgcgccgcactgccctcaaggccctgttcggcgccgcttctgcggcagttctttttggcctgcccgctcgcgcccatgcggcggaggcttccaaagaaaccaccgataaactgaatgccgcccaggcccagctcgacgaggttcaggcccagctcgacagcatcgcaaatgagtatgcggcgctggccaacaagaatgcccagaccctcaacgacatcgagaatgtccagggcaagattgacgacacgcaggcccagatcgatgaaaagaaggccgagctcaagaagaagcgcaacgacctttccgatcgcgtggccgccagctacaagtccggcggcacgaacatcctgtcgctgctgctggcctctggctcgtttgaggaactcgtcgccaacgcgcattacgttgagaagatcaacaagagcgaccgcgacgccatcgaggacattcagaccatccaggaagagctcgatgcgcaaaagaccgagctcgagtcgcagaaggccgacttagagaagctcaaggaccagcagactgcccagatgcaggacatgcaggccaagcagcaagaagtccagaccgtgctgaacggtctttccgacgacgtcaaggagctcatggctcagcgcgattccgagatcctcgctgctgcccaggctgaggaggccgctaggaaggctgccgctgccgcggctgccgcgaacaagaacaattcctactcgggtggttcgagctcgggtggtggatcgtacgcgcccggaactccgcagcagaatgccggctcgggcaagcagcaggctgtcgtcaacgcgtgctactccacgccttcgccgggtcagaactggtgcgcggcgtgggttaccaatgtcttccgtaacgccggcgttggctactttggcggcaacgcctgcgacatgttcaacgcctggtgctatagctccgaccgctcggcgctgcaggtgggcatgatcgtggccgattcctcgcacagcggcacgggtgctccgggccttatctacggtcatgtgggtatctacgttggcggcggcatcgttatgagcaacgagggcgccattacgtctaagtcgcttgactcgtttattagcttctatggcactggctctggcgtgcgttggggctggctcggcggcgtggcgctgtcgtaaagccgacggggccgcgtgcccgcccgcaatatatttgattgcctgctcgggcagtcctgcgcaagacgaaggccacattaagtggccttctttgcgtgcggaactcgcgatcaatcaaatatattgcgggcgggcacgcggccctcttgggttcggggcgggcttataggacaaaatgtgtgtccacgttgggggcatcggcgcaggtcgatgcccatgcgaacctccagtccggaccgcttcacggtccaactttctgtccgcaccccctattaggtgcgacgggcggcgcggcgggcacgggcttcttggatttcctccaagtggctaatgatctcggcagcgctttcctcgatggccttgccgtcggtacgcaccacaaagcagcctaggcgtttcatgagggcacgagcttcctcaagctcgctgcgcacgctctcgggctcggcataggagccggcaacggcacgagcgcagtcatcgcccaagcggctatcgcgaatttcggaaatcacatcgacggtcgaaatcaggccgaacaggcgcatcgggtcgacctcgtaaatcgacttcggcggctccatgccatgggccaacggaacattggcaaccttgtagccctgataagccagatacatcgacagcggcgtcttggacgtgcgcgatacgcccagcagcacgatatcggcacccgacaaatcgtcgcaaccgcgcccgtcatcgtgctcaacgaaatattccatggcctcgatacgatggaaatagcggtcatcggtcctgtgaatcacgcccgcgacgcctttgggcggcacaccgatgagcgacgatagcacggcgagcgtcggaccgatcaggtcgaccgaacggatatgcagcatgcccaggtaatcgagcacgcgggcgcgaagcgccggatcgacaatggtgtgaaacacggcaatatcgcgatggtcggcatcgacgcgcgggcccacaaacgactccacctgctccaccgaggtcaccttgggcaggcgcaacaaacgaaaagccccttcatcaaattgcccggacgccgcaagcaccacctcacaagcggtatcaccgagcgagtcggagataacgataacggtgggacgagcggtgaccgggcaatccatgcggggctccttttgcgcttacgcgcaggctggcttactttttacgagcaagctcaccgatgttggcgatgccggagaaaacggcctcgaagcggttgagcagcttaaggcgattatcgcggagctgctcgtccttgtccatgaccatgacctcgtcgaagaaacggtcgatgggcgcgcgcagggcggcgagggcagcaaatgcggccggataatcctcggtagcaagggcggcatcgacagcggtctgagcagcctcggaggcgtcggcgagcgcaagctcgacctcgcccatcagtctgcggtcgtactccacgcccagctcgggcttggagatatgcgcggcgcgagcataggcggtcgcaaggttgtcgaacgtctcggcgtcgttcttgcgggcctcgtcgagggcggcgcagcgggcgaagaagacggacggagcgatgatgtgcaccgcggagacggcggcaacggtatcggccgggatcttttcgtcgcgggccatgctcaccaggcggccatggaagaagtcacgaacctgctgggcgacctcggcggcgtcgaactcaatgccctgctcgctatagagctcgagggcgaagtcgatgagcgacgtggggtcgatcggcaggcggtcgcgcaggatgttgatgatgccgatagcggcacgacgcagcgcgtaggggtccgaagagccggtcgggggctcgccgatggcaaagataccggcgatggtatcgagcttgtcggcacaggccacgatgcagccagcggtgccctcgggcagctcgtcaccggcaaagcgaggacgatagtgatcgcgaatagcatgagcgacctcgtcgttctcccccatcgcgatggcgtagtaaccgcccatcacgccctgctggctcgtgaactcgacgacggcgttagacaccaggtcggccttgcacaggtgcgcggcgcgagcagcgtcggcggccaggtgggcgcccagatgggcctcgcgagcgatggcaagcgcgagttgctcaatgcgctcggacttggcgagcacgctaccgagcttctcctggaaggcgaccttggccagacgctcgcggaactcgtcgagggagatcttcaggtcctcctcgtagaagaacttggcgtcgtccagacgggcgcgcacgacgcgctcgttgccgtcaatcacgcgctcggcattctcgggcttgctgttggaaacgaccacgaactcacgcgtgagcttgccctcgccgtcatagatcgggaagtagcgctggttggtgagcatggactcgcagataatctcgtgcgggaccttgaggaactcctcatcgaaggtaccgacgagcaccgtcggccactcgcagaggttaataacctcctcgaagaccttcttgggcgtatcgacatggcagccgggacgggcggcctcgacctcggcgataccggcgaggatggcctcacgacggcgctcggcagaaagcacgccggcgtcctcgagcacctgctcgtaaacggcggggctggcaaccacatggtcaccagggccaagtacgcgatgaccgcgcgtggtgttgccactcgtcacgtcggcaaacgacacgggcacaacatcctcgcccagaaggcagcagatccaacggaccggacgcacgaacgtcgcgtgctcgtggccccagcgctggctgcggtagttgggccactgcaggccggcgatggtcttctcgcacagagcagtcagaatcggcgtagccggtgcggagggaatattcttctcggcgaacacatactcgcgaccgtcggtgtcctcgcgacggaccaggtcctcggcagccacaccgcacttgcgggcaaagccctgggcggccttggtggcgttaccgtcagcgtcgaaggcaatgttggccgcggggccacgcttgacctcgtgaacctcatcggtcgcggtggcgacgttagccacgagcgcagccaggcgacgcgggctcgagatcacgcggacctcgccgtgggccagaccggcctcgtcgagacccttggcgatcatggtgccaagctgcttgacggcattgttcagcggcgcggagggcatctcctccgtaccgatctcaaacaggaaatccttagcgtctgccatggcttacgccacctcgccttcctgatcggcattctcgttgacttcggcgacctcggccatataggcctcgcagcacgccttagcgacggcgcggacgcgcaggatgtagttagcgcgctcgaccgcggacagggcgccacgggcatcgagcaggttgaaggcgtggctgcacttcatgacgcagtcataagccggcagcggcagcttgcgctccaggcaggagtggcactcggcctcgtagtcgtcaaacttctgacgcatcatctcgacgttggcgacctcaaagttataggcactgaactcgcgctcgttctcgaggaacacgtcgccataggtcatgggcgttccgtcgggcaggtagctccacaccaggtcgtagacggagttgacgccctgagcgtacatggcaatgcgctccaggccataggtgatctcgacgggcacgggatcgacctcgatgccgcccacctgctggaagtacgtaaactgcgtgacctccatgccgttgagccagacctcccagccaaggccccaggcgccgagcgtcgggctctcccagtcgtcctcgacaaagcggacgtcatggtcgttgggatccaggccaatggcggccagcgaacctaggtagagctcctgggcgttgaccggcgacggcttgatgagcacctggaactgatagtagtgctgcatgcggttggggttctcgccgtagcggccgtcggcgggacggcggcagggctgcgcatagcaggtgcgccactcggcgggaccgagcgagcgcagcgtggtcgcggtatggaaggtaccggcaccgacctcggagtcatagggctgcataatgacgcagccctgctcgccccagtactgctggaggcgcaggatgatgtcttggaaggaaagcgatgaagcgttcatgcctctaatatcccctcgtcgaaacgattacacggttaggtactgtactatagcggtttttagtcgatagcgccgatgcggttgagcggccagtagcgcacaagcgccacagcgatcaaatcagagcgatcgacgggaccaaagtagcgtgagtcggcagagttttcgcggttgtcgcccatcacccacacgcacccgtcgggaacggtgtagggatagcttacctgagcgccgggcgcttggaccgaaagtggccagctcatgcccgtcgtatagtcctcgtcgagcgcttggccgtcaacgaccaccttgccatcctgcaggtcgaccgtctggccggccgtggcaataacgcgcttgacaagaacatcatgctcggaggtgccatcggggttgtgaaacaccacgatatcgccctgcttgacgggctgaccgagctcgaggctcaccttttgcgccaggatctggtcgccaatctcgattgtgtcctccatagagccggtgggcaccacaaagggctcgaccacaaacgagcgaatcaagaaggtggcgaccagtgcgatcgcgatgaccgcgatccactcaaaagcacccctcaacgcggaatgttgcgtaggaaccattctcactcctcgctctgcgaatacgaagcgtccaaaatctcctgcgcgtaagcgcgctcctcgggcgtgagccgcgctgtctcgatcagatcgggacgccagcggcaggtgcgctcgatggcgttcttacgacgccaggcatcgaccttggcgtgatcgccgctcacaagcaccggcggcacgccctcgccgttgaactcggcggggcgggtgtactgcgcgtactcgagcagtcctccgtcctcggcggtcgagaatgactcgtccacattgctcatctcgtcgcccagggcgccgggaatcaggcgtacgacggcatcggcaacgaccatagcgggaagctcgccgcccgtgagcacgtagtcgccgatcgacagacgctcatcggcatacgcatacgcgcgctcgtcgacgccctcgtagcggctgcacacaaacagcaggcgctcacttttgagcaggcgctcggccacatgctgcgtaaagggctcgccacagggggtgaagaacacaaccgtgggcttgggaccctctgcgccaatggcctcgatggcctctgcgataggctcgaccttcatgagcatgccctgcccgccgccgtacggctcgtcatcgacggtacgatggcggtcgtgcgtccagtcgcgcaggttatacgccttgaaatcaaaaaggccggccttgcgggcgcggcccaagatcgatgtggacatgacgggctcaaacatctcgggaaagaccgaaagggtctcgatcagcatgttgtcctccctacttgtccatatcgatcaggccgtccataacgtggacggaaattgttcctgtgtcgggaagatcgagcacgacctgctcgatcacgggaatcagtacctcgccgtaccgatcgccctcgacaacccaaacatcgttagcgagcgtcgacatgatctcgacgatcgtgccgagcgaaccgaagcgctcgtcgaccacctcgcgacccatcaggtcggtataggcagcgtcgagcgaatcgagctcaaaatcgtcacgatttgccagcacgtagcatcccgtgataccctcggcggccgtcaagtcgtcaatgccctcaaacgagaccagatcgccatcgcccgtatcggtgacggacacgaccgtgcaaaagcggtcgcgcttgagcgccggcggcgtcagggcgacgcgcatacccggctctaatacagaaggaagcccccgcagcggctgcgcgaggacctcccccttccttccgtgcggcttgaccacacgggcgatgtttttgtactgggacctcaaggtcctagcccagaacctctacctcgacagcagtgtcgaggcgagcggccagtgcacgggcgagcgtgcgaatggccttgatggtacggccacgacggccgatgaccttagcgacgtcatcctcggcgaccgaaacctcaattgtagaggcgtcgtcaccatcgatgacctcaaggctcacggaatccgggtcgtcgacgatctgaacaacgagatattcgacgagatcggcgatgcgatctgagagcattgcctcaccctcgagctgtgcagcgtcaacctcaggcacgatttactcctcggcgccctcagcggcctcagcggcagccttagcggcctcggcctctttggcgagctgcttcttggacttcttgacgacggtctcggtcttctcgccctcgttggcggccttgaccagagcggcgacggcgtcggtaagctgagcgcccttggactgccagtcggcgatcttctcgaggtcgaggttgatggtcttgggggcggtcatcgggttgtagcggccaacctcctcgatgatacgaccgtcacgcggggcgcgggaatcggcgacgacgacacggtagtacggacgcttcttagcgccgtgacgagcaaggcgaatcttgactgccaaaggaaactcctccaaccaagcagctttaggctgcaactacaaacaaacagttgaacataatacgccatcgacgcgggcaggtgaagtccgtgagaccaacttcttcggtgtagtcgagggcaaatccatatcttagacaagaattcgggatttgcaagcacatacacgcaccccacatgagctgcgcggtatactcatgacatggaaagacgcgaacatacatacggttatgaggatgccacgggcgtcacgccgcctccctggacgggtccggcggtgggcctgatggacctcgatgcgttttttgcgagcgtggagatgctcgatcatcccgaatggcgcggcaagccgctcatcgtgggcggagacgccgattcgcgtggcgtcgtgtccacgtgttcgtatgaggcacgtcgctttggcgtgcactctgccatggcctcggccgaagcgcggcgcttgtgcccgaaagccatttggacgcacgggcactttgatcgctaccgcgaggtgagcgcgcaggtcatggcgattctcgccgacgagaccccgcgcgtcgaggctcctcgtgcgtcgacggacggtgcatacccgtagcaaccagaatgcgcacgcgcgcggcctctgatgccgtggacgatggccctgtgtgccggcatgtgcatgagctgcgccttggtgctcaacgtggccgccgatgcgctgctgtgggagcgggcttcggcggtcgggccgctatgggccattcccgttacggcggcggtattcgttgtgctggctcaatcttgtgcgcggcttgccccttggaagcggtggctgtatgccgcgtccgtcggtctcgtggcgggagcggtcgtctcggcgtggtgggctgtgggcgtgctaagcgcctcgaaggcgctcgacggtcgagcggcaagcagccttgagtttgtcgtgcagggtgacccatccataaacgacgacgtgtattcctatacctgcgaggcacgcacggacggtaagaacttggcaatggttcgcctatcgtgcgacctcgagctcaaggtcggggcgcacgtgcgtgttatcggtcgcgtttcacgttttgagaacgatgcgtatggacgatcgcgcgtgctccgaggcgaggtgcgcaaggttaaagtcgttcggattttgtcggtcgatgaagactctccggggccgctgcttcggctgcgaaatgggctgcttgcgtccatcgcgcctgcgaccgacccggcgcgtgcactcatagccggtgtcgtctgcggtcgttcggccgagctgcgcgcccagccggcgggcgactggttttcggtgacgggaacggcgcatcttatcgccgtctcgggcagccatttggcaatcgtggggtttgtaatcgagggtgtattgcaaaagactcggtgttcacgcggtcttcaacgggcgatattggcgataacgcttgtgggctacgctgcttttacgggcgcgtctccctctgccgtgcgcgcgtgctgcatggtgttcgcgacgcttgtcgtaaacggcgcggggcggcgccggcacggcgcatcggcactcttcgttaccatgtccatctttgtgttgctgcggccgacggttctgttcgagatgggctttcagctttcatgtgccagcgtcttagccattctgtgcttttgcccctatgcgacctacgctttgggtgagctgagtgttccgtcgggcgttgccagcatgctttccgtcacgctgtgctcgcaactggcgacacttcccattaccattcctgccttcggtacgttctcgctcattgctccgctcgcaaatgcggtcctcggtccggtggtgagcgcactgctcgccgtatcgatcgtgctggttcccttttcgctcctggcgccgttgcggacttgggcgctcgttgtgcccatgattgccgcccgttgcgcgctgttctttgagcagctgtttgccgccgtgccgggtgcatccgtgagcgtgccgcccgatagcatgtggatttacctagtgccgtgtttgctggcggttctgcttgtctggtggccgcgtccccgtgcacgtcctatggcggtggggcttgcatgcctggtgctcttggctgcgattccgtacgtctactgggatcgattcgctccgccttcggtgacggtgctcgatgtgggccaggccgatgcgattattattcgccagggcggcgcagtggcgctcgtcgactgcgggctcgacgagcgcgtggtggcggcgttggttcgcaataacgtgcaccatatcgatgccgtctttgtgacgcattgggatgaggatcactggggtggtctgcctgccgtgctcgaacagttttcggtcggtacgattgccgtggcggcggatgcgctggaggatgctcctgccgaggtattgaaccgacctggcgtggagtatcggcaggtgcgccgtggggatacggtcgatatcggctcattttgcgcccgcgtgatgtggccattcgagtccgtggatggcgagggaaatgaggactcgcttgtcctgctgctctcatatgttcaggaaggcaagggcctgcgtatgctcctcaccggtgatgccgagatcgaccaagaacgggaattcgtgcaggaggtgggggatatcgacgtacttaaacttgggcatcacggctctaaggtttcagtcgatgatgagttgctggacgtcctgaagcccgagctttccctcgcgagtgcgggcgaagggaatcgatacggccatccgtccgatgcctgcatcgatgccgttaaggaagcgggcggcgtgttcgcgtgcactatcgaacacggcgacattaccgtcacgccggctgcgaatggctttgcgatgcgatgccagcgaccgtgacgacgtcgttggcgtgtggtgggcccctgggctagaatggcacggagcgaatacgaaggcctgcgggaggggagcgcaatgtccgaaaccggtctgctgccggcatatctgattgtcggtaccgacggagtcaagcgcgatcacgccgtctcgcgtatgaaagcgcgtctggaaaagtcgggtatggttgagttcaacctcgacgagcgcgacatgaccaaggaccccgatatcgagtccattatcggatcgcttaacacctttccgatgggcagcgagtttcgcctggtaatccttgatggctgctcaaagctcgccaaggcggtctcggagccgcttgtcgagtatttggcgagtcccagccccacaacggtctgcctcatcattgctgactcgcttgccaagaacacgcgcctgtataaggcgatcgccaagatcgacaagaaggccgtgatcgattgctccggcaccaagcgctgggagcttccgcgccgcgtgcagcagatggcgacgcagcacggcaagtcgatctcgacggcggccgccgaggagctcgtctcgcgttcgggtgaaaacactcgcatgctcgataacgacttggctaagcttgcccagatggtcgaggcgccccagattgagcttgccgacgttgagcgctggattgtacgtacggccgaggttcaaccctgggactttctcaatgcggtctcggcccgtgacatgcgccgttcgctcgagctcttcaatctaatgcccgccaagagctacgtgtggacgtacacattgctgtgcggccgcattcgcgagcttatcgttgccaaggcgctcgatgcgcgcggacagggtcgtgagctggccgcaacgctcaagctccagtcctggcaggtcaagaatcacctgacctgggcacgtcgcttttcgatggcagagctcgtcgcagcgctcgagggtgccgttgatgtggagctcgcgctcaagggttcggccgattctgagaccgcgcttttactctggattacgaacatcttgagaaaatcgtgatgatacctgcctatttgacaaattcgttctatccctttgagggggagcgtgctatagtaggcgcttgcatgacctcaccgtgtctcagaggtgtcatacattttttgcaaggaactcgaaaggaactccagaagtggcaaacatcaagtctcagaagaagcgtatccgcaccaatgaggcagctcgcatgcgtaacaaggctgtcaagtccgagctcaagacgctgaccaagcacgtccagtccgccgtcgccgagggcgacgccgagaaggcccaggctgccctcaaaaccgtcaccaagcgtctcgacatggctgccgccaagcatgttatccacaagaaccaggcttccaaccgcaagtccggtcttgccaagctcgtgaacagcatcaacgcctaagttgtaaatttcacaccacacagattacgcgcataaatggagcctgttttatggaacaggctccattttttgtaccgctcgggtaagatagtccgcatgaatacttcaattgacatttcccacatccgcaacttctcaatcgttgcgcacatcgaccatggcaagtccacgatcagtgaccgtatcctcgaactcacccataccgtcgacgaacgcgacatggagtcgcagctgctcgacaccatggatatcgagcgcgagcgcggcatcacgatcaagtccaatgccgttcgcgtgtcctatgacgccgacgatggcgagacgtatcagttcaatctgatcgatacgccgggccacgtggactttacctatgaggtctcgcgctcgctggcagcctgtgagggcgcggtgctcgttgtcgacgccacgcagggcgtcgaggcgcagaccgtctccaacgcgacgctcgccatgaacgccaatctggacattgtgccggccatcaacaagatcgacctgccctcggctcatcccgacgaggttaagaccgagatcgaggatgacctggcgatccctgccgatgatgccgtgtgtgtctcgggcaagaccggcgagggcatccacgatctgctggagtccattgtctttctgatttctccgcccaagggcgatgcgaatgcgccgctcaaggcactcattctggattcatacttcgacgagtatcgtggcgtcgtcgccacggtgcgcatctttgacggctccatcaaaaagggcgataccttgcgcatgatgcaggcaaagggcgactttttggtcgatggcgtgggcgtcaagcgtcccgccgagacgccggtcgacgcgctgacggtcggcgaggtcggatacgtggtcacgggcctgaaggaccccgaggccgttcgcgtgggcgacacccttacctgggcgtcgaacccctgccccgagccgcttcccggttaccgcgaggctaagcccatggtctatacgggcctgttcccgatcgataacaaggactacgagaacctgcgtgacgcgctcgataagctgcatgtcaacgacccgtcgttggtgtgggagcccgagacttcggtggcgctcggctttggtttccgcgttggcttcttgggcctgctgcatatggaggtcgtcaaggagcgcctggagcgcgagttcaacctggacctgattgccacgagcccttcggtggactatcacgtctacaagaccgacggcgagatgattgatgttcgcagcccgcaggatctgcccgaggctacgcgcatcgagcgcatcgaggagccctacctcaaggccaagattatctgtccgcccgagtatacgggtgccgtcatgcagctcgctatcgagcatcgcggcattacaaccgacatgatccatctcacgagcaaatcggtcgagatgcgtttcgacatgccgcttgccgagctcattctggacttttttgaccagctcaagagccgcaccaagggttacgcctcgctcgactacgagttcaacgaatatcgcccctccgagctcgtcaagctcgacatcctgctttcgggcgacgaggtggacgcgctgtcgtttatcgtgcacaaggataaggcttatggcctggcccgcggtctgtgcgacaagctcaaggaaatcattccgcgccagctgttcgaggtgcctatccagggcgccatcggcaacaagatcattgcccgctctaccgtcaaagcgcgccgcaaggacgtgctggccaagtgttatggcggcgatatctcgcgaaagcgcaagctgctcgagaagcagaaagagggcaaaaagcgcatgaaggccatcggctcggtcgaggttccgcaggaggcctttatggcgattctcaaggtggacgagtaggtccatggcactttctgaatacagcaagcggttgcttggcgcctatgccgagcagccgttccttatggctcccatggcgggcgtgaccgatcccgcctatcgcatcatgtgccgccgtcgcggtgcccatcttgcctatagcgagatggtgagcgtggcgggccttgcctatgccagcaataagacgtggcgcctggtactgccggccgatgaggagcagcagatctgcgtgcagctctttggctccaagcccgatcagtttgcgagcgctgttgctgccgtcgaggagcgtgtgggcgatcgcctgtcgctgatcgatatcaacatggcctgcccggctcgcaaggtcgtcaccaagggcgagggctcggcgcttatgcgcactcccgatctggccgagcagatcgtcgaggcggcggtgggcgcggcgcatgtgcccgtgaccgtaaaaatccgtaagggcttttacgccgaagaccgcaacgccgcgacgtttgcccagatgcttgagggagcaggggccgccgcggtggcggtacatggtcgctgcgccacgcagctctatacgggccaggccgattggtcggtcgtcgatgaggtggccgacgccgtcgagattcccgttatcggttcgggcgatgtgttctcggcagaggacgctgctgagcatctgcaaagctcgggtgccagcgcggtgtttatcgcgcgcggcatctacggcaatccatgggtgttcggcgatgcccgagcccttgcactcgatggcacgccggttccttctcgctcctcggttgagcgcctggatgccctgcgcgagcacctgacgctcacgcacgagctgttgccgctcatgtcgcgtgcccgcacgtacgcaagctggtatctaaagggcatgccccatgctgccgcctggcgcgctcaggtggtgcgttgctccacatacgaggagttcatggcactggtcgatgatatcgagcacgatgtggtggcctgtgaggccgcacttgccgccggcgagtcggtgcccgctcatccgttggaggcctaacggtggccgttaccgcgctgtacgtgcatgtgccgttttgcgcccaaaaatgccggtactgtgactttgactcacgcagttttgctccgtgcaacatgagcgttgcgctcgatacctattttgagcagttgtatgcgcgcctcgatgcttttggcgacgcaggcgcgcttgcacagatccgcaccgtctatgttggcggcggcacgccgtcgctggcgggggagcgtttggtagaatttgcgtggtagcccgtaccagattcgaactggtgatctccgccttgagagggcggcgtcctaaaccgctagacgaacgggccacatgacatctgcactgccgtgctgcgaagaaatatattacgggacaaaaaacgtcagcgcaagaagaaattccaaattgccaaaaaattgtcggcaggttatggaacacgcaggtaaactgggtagctaattcaagttgagatggaccaaaagagcttcgcgatcgttgggaatgttgtcttcgatcacggcgtcgagggcggagttgagaagctgacccagttccggcccgggcttgactccggcacggatcaggtcgccgccgttgatggagagcatcttgagcgtatagggctcccctgccttcagcagctcgtgcgccatcgcgcgcatctcctcaatcgtctcaacgtaatagaagcacgacggggccttgccaagtgtgtcggcacgcttaaggtccatgagctcgtcaatcaggcgggccgtgtcgacgccctcacccgaaagcgcgcgcatcatattgagcagacaggagcgctcggggcgcagcggcttgtcatggtatttgatgagcaggcacacgtcgcgcaccaagtcgtgcgagagcgccaggcgatccataatgacgcgcgccttcttggcgccgagctcggggtgaccgtagaagtgtccgctaccggcatggtcgaccgtgaagcactcgggcttggacacatcgtgcaaaaacgccgcccacataaggctcgacgagggcgcgacgccgtcacacagcgcgagctcccccgccaccgtcagcacacgggcaatatgcacgtagacgttaaacgcatgatagacactgcgctgatcaaacccgcgacccgctgccaactcgggcacggcggcgcagatgagctcgggatagcggagcatcgcgtctcccccatgaccggtcgaaagaatgccctcgagctcaatacccacacgctcacgcgccacggcatcgagcagcggcgcgcactcggcaagcgcacgcttggtctcgggctcaatcataaagtccagacggcaggcaaagcgcaccgcacgcagcatgcgcagggcgtcctcgttaaagcgacgcttgggatcgccgacagcgcgaatcagcttgcgctccaagtcaccctggccgtcgtagcggtcgacaagcccgcgctcgggatgccaggccatggcattgacggtaaagtcgcggcgcaccagatcgtcctcgagcgaggcggcacgctccacactctggggatgacgaccatcggtgtaaaagccatccagacggtacgtggtgacctcgatacgctcgccatcggaaatagccgtgattccgccaaatttaatgcccgactccacaaccgcgatgccggcggcctcgagcgccgctttggactcctgccacaggccgctacagcacatatcaacatcgtggctggggtaccccatcagggcgtcgcgcacccaaccgcccacgtaccaagcctcaagaccagccgcctcaagcgcgcgcaggacgcgcagggacgcatcggacggttgagtaccgttgagcgaaacattgcacatgcctatggcctcctgcgactatcaaattggctatcgattgcgtctgcaaaaagtctagcaagaaacagcctccactgcacacgcaagtccgataaacaaaaacgcatccgtcctagtctaagacggatgcgaaataatcaaactattcagacaaggtgccggaactagcagacctggcgaacctcgatgtgcttcttatattcgtccaccttggcaaaatcacccagaccggggcactcgaccacgttggcgccagtggccatcgaaaggcgcagggcgtcctcgacgcgctcgggggcgtcgtgccacacggacaggaaggcagcgagcgaggaatcgccggcgcacacagtcgacagcagcttgacgtcgaaggtgcggttggcaaaccagatatgctcgccgttggagaagtacgcaccggcgccaccaagggtcagcagcacgttcttggcgcccttggcgtgcagctcggccatagcgcccttgacggactcgtcgccaccaccgctcaccttgatgccaaagatgtcaagcagctcgtcgtcattgggcttgatcagcagtggctccagagcaatgaggtctgccagctgatggctcgagatatcgagcacgaactcggcgccctttgccttcacgcgacgcaggacctcggccaagaagccctcggaagtgttgggaggcagcgagccgctgatgaccaggcaggtcatgtcatcgagcgaatcgataagttcaaacatctcctgctcgttggcctcattgatggcggcaccggcattgaccatgttgtactcggtgtcgggaccggcgttgaggaacacattgacgcgcgtaataccgtcggtccacacgggcttgacgggcacgcccagggcctcggcgcccttaacgataaactcacccgagaagccggcgaagaaacccaggatcgtggtgtcgacaccatagtggtcaagcgtaaacgagacgttgaggcccttgccgttgggcgtgtagacggcattgcgggtacgcgtgacggtgttggcagcaagaccgtcgcaggcgatgttgtagtcaatggcgggatttgcagtgagcgtgtatatcatgaatgttcctttcacgaagcaacgtgttaatgaaagtatattccacgcatcggtaaaaggctaggacaactcggtgaacggtgtggaagcgatgaagtacggcaggacatctctcccctatgacggaacaaaaaggcgccctggccgaaaccggggcgccgcatgcgcacgaatatgtcgcgtttcgattactgacgatcgagcttgcggacagcaacgcgcttgctgtactcgtcaacgtgaccaaagtcgccaatgccgacggactcggcaacgttggcgccggtggccatagcgagcttcatggcctcctcgacgttgtcgcgatccctgtaccacttgtgcaggaacgcagcgagggtgcagtcgccggcgcagacggaagagaccagcttgatgttgaactcacgcttggcgtaccagatgtcctcgccgttggagaagtaagcgtcgccgcggctaccacgggtgagcagcacgttctgaacgccagcgtcgtgagccatcttcatggcgacacgaacctcgtcgtcggtgtcgaccggcacgccgaagatggccttcatctcgtgatggttcggcttgatgagcagcggcttcttgtgagcgagctccttgagcttgtcggaggacaggtccaggacgacgtcagcgccacgagcctgagcgtgctccatgacctgagccaggaagtcgggcgtagctttgggaggcacggagccggagacgatcaggcactcgagatcgcccgcggtgtccaggatgttgtagagctcctcctggtgctgcggcgtgatcggggcgccggggttcaggatgccgtactcgtgctggccatcgttgacgtaggtgttaatgcgcgtgataccgtcggtccagaccgggcggcagaggcaacccaggttcatgacctcctcgacgatgaacttgcccgtgaagccagcgaagaagccgagcgcgacggtgtcgacgcccatcttcttaaaggcgaaggacacgtcgaggcccttgccgttagccgtgtagctggccgaaccggtgcggacgttctcgtcgggctcgagcggagagctcgaaaccgtcatgtcgacagccgggttagcggttagcgtgtagaacatttacagtaccccctgtatatgtgagggccgcgtggccggcccattccaaccacgcggttacctctgataccaaattagcgagctgcggactcgagcagtgccttgacctcggcggcggtgttgcaggcgagcgccttctcggcgagctcgtcgcactcggccttggtccactgactgatggtcttacgggcgcgcaggatcgacggagcactcatcgagaactcctccaggccccagctgatcagcagcggctcgagcagcggatcggcagcggcctcgccgcacataccgaccatgatgccggccttcacgccgctctcgatgatgttcttgagcgagcggagcacggcgggatagtaaacctggtacaggttggagatggtgtcgttgccacggtcggcgcacatggtgtagccgatgtctgcgagcagcgaagcggcgggcgtctcgaccatgatgccgacctcgatgttctcgttgaacttgcgcccctcttcggtcagctcggccttgcactgctcgacgagctccttgacagccaagacctcctcgacgcaggtgacgagcgggatcatgatcttgacgtcaccgaaggcgctagcgcgcagcagagcgcggagctggaccttgtactggtcgggattggccaagcagtaacgcacggcgcggaagcccatgaaggggttgtcttccttgaccatatgcagatacggaatctccttgtcgccacccacatcgagcgtgcggatgatgaccggagcacccttgagcgcgctggcgaccttacggtaggcgttgaactgctcctcctcggaaggaagctcagcagagtccatgaacaggaactcggagcggaacagaccgatagcctcggcgtcgtgatcgagcgcgttgggcacgtcatcggggttaccgatgttgcaggcgatgatcttcttgatgccatcagcagtcacggacggcttgccacggaaggcctcgagggctgccttctcggcagcgaaggcctcggccttggcggtgtaggcagcgagcgtctcctcgtcgggatcggcctcgacgatacccttgccgccgtcgacgacaacggtcatgccgttgcgcagtgcggtgcagctgttggagaccgaaaggacagccgggatctcgagggctcgcgcaatgatcgcggagtgcgacgtgcggccaccggtctcggtgacgataccggcaacgtgggccttatcgatcgtggcggtcatggacggcgtgaggtcgtgcacgacaacgacagtgttctcgggcaggacggagaggtcgacgacctccttgcccagcagctcggccagaataccggtgcggatgtcggcgatgtcggccgcgcgcagacggaacatctcgtcgtccatggacaggaacatgttctcgaacatggtcgaggtgtccatgagcgcctgctcggcgcaggtaccgccgtcaatggcggcgttgatggcgtcggtcatacccgggtcctgagccaggacaatgtgtccgctcatgatctcggcctcggcctcgcccaccgtctccttcatgtggtcggcctgagcctgggtcttctcgcagaagaccgaaagagcggactgatagcgctccttctctgctgccgaatcagcaacctcatgcggctcaaacgtcaagtcgggatcgacggcgaccatgacggtgccgataccgatgccctcggaagcgttgactccctgatacattcccattcctctctccgtgtcatgtgataaagcgttttgccatatccatgacaaaagagcgcagttaccttacaacaggtcactgcgcccccaaatataacttagttgttcaacatgcgacccgtttgagttctactcgccaagaccgctcttgatgagctcgatggcagcagccagagcctcggcctcgtcagcgccgtcacacttgacctcgacctcggtgccgcaggggataccagcagccatgagggccatcggggacttgccgttgacctccttctcgggggtgacgaccgtcacgtcacaggcgtacttgcccatggtggaggcgaacagaccagccggacgcatgtgcagaccctgaggattaacgagggtagccttctcagaaaccatagttgactccttttttgtgtttaacccctgtcatgtatgtggcaggagtcagattcacgacgttgtttatattaactcacatcaaacggtttttcattatgtttcggacgaattgttggacagatgtgtttgtcgtccgcttgctcgcccacaggggcccgtgcgcggcctgtgagatttcctgctctacagtcctgctcgcacgaagagcacattaagtgctcttcggctcgtgcggaactcgcgataaatctcacaggccgcgcccggccccctgtgggcgagcaagctgcagaaactcggtcggtccagagcaatatcgtgcgaacggaattctggctaatgatctgttcgcgacaaagactcgataggtagccccctctatgcccttttgtaagttgcggtgaaatagggactgaatttggggttgaatcgtttaaacagtccctatttcaccgcaacttatgggagggatagaaaaaaggcggaggccctggggagggactccgccttatatacagggggcgatgttattcgcgggctgggggattagaccaggcgggcgttgatcgtcttggcgatctcggcggcgtcggtggaacccttgacggtggcacggaagtcctcgtccatgagcgcctcggcgaccttggacaggatcttaaggtgcgtggtgccggcctgggcacccgggatgagcagcgcgatggccacgttgacgggagcgccgtccatggtgtcccaaccggtcacaccggactcgtccttgacgacgatgacggcagcctcggtaatggcgtcggacttggcatgcgggatggcgaagccctccatcatgcccgtggtgccctcggcctcgcgggccaggaaggcgttcatcacggcgtcggcgtcgctggcgataccggcgtcgtagccctcgtcggcgaccttgtcggcgagcgcggtcatcttcttgccggtctcgtagagcgccttaccgtcctcgagatagccctcctggtcgaaatgcatgatctcgatcttctcggtttccttcatttgtctctcctttctggggttgtttccacatcccccatgccaacgggcatcaaaacccgcttacattccgtaacactcggccgctttggccttaagcgcattgactgactcttcgtagccctctgccttgacctccatttgcttggagacggcatcgagatacgggtgcacgtcccatgacttcagacgctcggcgatcattgccgcaatcgtctggaagaacacaagattgggaattgcgctgagcagcggagccacctgaggcaccgcaacctcgtgagccctacccctgggatgggccgtgagcagcaccgtttttgtcgtaacgttcgatagcgcatcggcgatattcgcaagacgctccgacccctgcggatcgtcaacgataaacaccagatagcccggaacgatctgcatctcgggaccgtgaacgaactcctcgccctcgtgatgcatggcaggaatcttgatggtctcgctcagcttgagcgccgcctcctcggcaacgccgtagttggggccgttgccgacgaccatggcgggcatgtgctcagaaagctcgagcatgtggtcttggacatattcctcggcggtcttgcacatcacggcattggcctggatagcttcgcgcaggtcgtcaagacgctgggcaacgcctttggcgtcaaccgttccgcgcgcctgaccgccgtaaataccaaagagcaccagatactcaacgagaacctcgacgcccagagttacaaagtccaccgactcgacgcccacaccgtagtcaagaacgatgtcagcgtgttccttgatgggtgcctcgacgtttgccgtgagcgcaactgcagccatatcgtgtgcgcgcatgtaatcgagcgccgcaatcgtattggtcgaatagccactctgcgagacggcgatgttgagcgcatgctgcggataggtgtgttcaaaatcgacgaaggcctcgggcgtcacaacggacacctgcatctgcagcgcatcttgcaggtaatcgcgggcgcaatcggcggcatggcgcgacgaacccgaagcaacgatgcgcagtgcgttaaaagaaccggactggaaaatatcaacgagctgcgctaccagctcagacgaacgctcgaggttctcccccatacgcacatgggcaagctgaacgtaatcgagcatcttcatcgtctcacctcgttacaaatcattagtatttgataccaatcacagttacaggttacggctttttgatacctctctgtcgattaatttatccccttcggcgaacggtcgattttgggccctgtaaggttgtatatacagctgacccaacgatcaaaactagttagtttcccaggcgttattcacaaaacaccagctagtacgtataggtatatccacccgcatcaccgcggttaaacgatttgacgtactcgatcgcttggccgcccgcatcgaagcttacgcactccagcgtcaaggcaagatcgccctgctccagtccaagcaggccggcatctcgcgcgcccagcgcttcgatatcgagcttttcctgtgccataactggctttcggcccagcatctcataggtctcgtacaaactgaagaccgacacgtcaatatcttcgatggttggaaacagcaggcacgggatgaacgccatctcaatcgatacagggtcgccgttgacgcagttcaaacgccgaatcgaatacagcaaatcatcctcggcgatgccaaacaggtcggcgtagtatggccccgcataacgcttggaacgcgcgagaatacggacggacggctcgccgcccgaagcacggaccgattcacggaaaccgcccgtgcgttcaaaaaaagcaggtactttctgcgccacaaaggcaccttttccccgaacacggcgaatctgcccgcgccgaaccagctcatcgacagcgcttcggatggtcaagcgtgtcgtaccaaattcctcggcgaggtctttttcggacggaatcatggaacccgtgggatatataccgcgctcgatacgctcctcgatgcggcgtcgaatgcgcatatagaccggggtggcatctactgtttcagccattgttcacctgccacgctcctcatgccgttctcttcgccgttatcggcaaagcggaactttgtgggcaaaatcaccgatttgcaatgctccacaaaacgcatgtccttatccaattcgatcgtgctctcatagaacaccggcgttccctcttcttgctggagcagctcggcctcttcggcgttcaaacgcgagatggagatatgctcacgtccatgctcaacacgcacgccaccttctttgagcaagacatcgtaaaggctctcgcactcaaaatcgtgctcgataagcgatgggcacagggacaggttaacgtgagccgtctcgattgacgccggctcgccctcaataagtcgaacgcgctgcatgcgaagcaaaggagcgcctacagacaccccaagcttgtcggcaagtgcctcatccgcctcgatggtcccggtggaaaccagacgagaagaggggtgcaggccggcagtccgcacagcatcggagaagttatacgtttcctggaagatgttcagcggcttgggagggcacacatacgtacccgatccgcgacggctctcgagcgttccacacgagatgagccgcgtgataccggcgcgcaacgccgtgcgcgaaacgccgatctcttcgcacagcacgcgctcggccggcaggcgatcgccgccggcaagctggtggtgctggatataccaaagaattccctcaacagcacgatctttggggggaattgcataagattcgcctgccattgcacagactcctcattcagaaacgtatgccgccaaaattagaccagccctcccatggcatcaaattcggccttgatcttctcggcaacattccgatacgacttatatagacttgaatcgcgtttgacttcgtcggtcataacgggaatctctaatttggaaacctcgtcttttcccgtctgaaccgccacaacaacgcccataccaagacacatattacgcttggcagcgtttattttcgccgccttggcaggatttgccaggatacgctgggcaaattcctgttttgagaccacttcctcggcctccggatcgcccgcctcggccacttcgcactgcaacacgtccgcatagtcaaaaatcttcggctcgccgccgcgctgatgcacggcccacttgcgacgcgtggcatcctggtagatagccggcaaaaacgtaaaccgcggcgggtccaaaatcgtatccgtgatggtaaacacatcgggatcaaaggcatcctgcgggtttttcttcttgaacagccccatatcagcctcccgtactagcattaaacaactcaagccgaatatagcaccaatttcaagctcatgctttagtagatcggtgcgcggcgtctatggctcgcccagcggaagagcttacggacgagggccggggcgcctgctttgttttgagaggtgggcttcgcgaacttctcaaaacaaagcaggcgccccggccccgccggcaaatagcggacgctccgcatgcaatctatgcaaacaaacaagtacgtttagctacattcggtaagttcgagcacgctgcccttaacgataagcgccggctccaggacgacctcttcggcacgcctgccgcccctaccggcaagacgcttggacatgcagccaaaagcatgctccgcaaggacaccaggatcctgctcaatcgcggtcagcgccggctcaaagagaacgtcggccgccgagttgtcatagctcaccaccgagatatcgcccgggatgctcttccccatctcgtgcaagcgcttgagcagaccgagggcgatgttatccgaacttgcgaacacagcggtggcatcagttgcgagcaccgcctccgaggcctcataggcactcggaatgtagtactcgctctcaaactccaaacgtgcgtcgataggcaggccaacctcgcgcagcgcgcgctcatagccggcaagtcgcttacgccccgtattggaacggcgcgcgttaaccaagcaggcaatgcgacggtggccctgctcgatcagatagcgagtggccatgtagccacccatctcgtggtcgaacatcaccttgtcgcactcgagcccctcaatggcacgatcgaccatcacggcagggataggcagatggctgacttcttcgcgcagggcgcggtcgtcggagaactcgtcgcctacgaccaggaagacgccatcaacgccgcgcgtcaccagctggcgcagcagctccagatcgtcatcggcgcttccgcccgagctggtaatgaagagcgcatagccgtcctcgcggcagcgcttttccaggctaccggcgagcgaggcaaaaaagcggctctcgatgttagggacgataaggcccagggtgcgcgactcgcgcatgaccaggctgcgcgcgatctggttgggaacatagtggttgcgcgccgcgacctctttgatgagcttgcggttttcttccgagatgcgacagggccgattattgagcacaagcgagaccgacgagggggaaagccccacctcctgggcgatctgcttgagggtgactttgttggccatctcgctccttccgggtttacgcgcaatctcttgaaagtatagcgactacccctctacctcgatgataaacactttaccaatccggtagacggctgttttatcgccgccagcgcaccaaatccgtccgggtggggtatattgcaatcgattgatgacaacgaccaccaaaaggcggatattcgtatgcacgagaacgacttttttaacgaggacctgctgtgcgcgcttgctggcgttgccggcgaggacaacgtactgatgagcgagcccatgcgcgagcacaccacgtttaagatcggcggcccggccgacgtctttgtcacgcccgataccgagcagggcctcgtcgccacgctcgatacctgctatcgctgcgatctgcccctcaccatcgtgggcaacggctccgacctactcgtcggcgacaagggtatccgcggcgtcgtcgtggcgttgggcgaaggcctctccgacattacgatcgacggcacgcacgtcacggcggcagccggcgcgctgctttccgatgtcgcagccgcggcagccgaggcctgcctcaccggcatggagcccatctcgggcatccccggatcggtcggcggcgcctgctacatgaacgccggtgcctacggtgcctgcatggccgatgtgctggagtccgtgcgcgtctacaaacccgctcgccagctcgacgacggcacccgcggcagcggcaatatcatcgagttcgatgtcgacgagctcaacctgggttatcgaaagagccgcatcgccgatgacggctttatcgtgctttcggccaccttcaatctcgccccgggcaacgccgcgatgatcaaggccgacatggacgactaccgccagcgccgcgaggacaagcagccgctcgacatgccgagtgccggctccactttcaagcgccccgagggttactttgccggcaaactcatcatggatgccggcctgcgaggacacgccgttggcggcgcgcaggtgagcgagaagcactgcggcttcatcgtcaacgccgaccacgccaccgccgccgatgtcgacgaactcatccgccacatccaggcaaccgtcaaagaccaattcaacgtagacctaaaacccgaagtccaccgagtaggcgaatttttataaaaagaaggccccgaaaggggccttcactttctttaattcagacaaccagtccggtgtgccgcgccccgaaggcttataggacaaaatgtgtgtcccgatagaacatccgtttctatccattaatcaagccagaacgggtacgggtccctgtggtggaggtcctcccacacggccctgtcgccccactccggccctccgtcctcgcgcgacggcgaggcggagtagacgctgaacaggaagtcgatgtccgcgtcggtcggcatcgcggcgagcttctcgcgcgccgtcctcgcgtcccccgagtgcgcgtggcaccaccagaacaccgccttcacgcgcttgaccgacgtcagcccccggtggttgcgcaggacggccctcagctgcgagttcacccctccctcgcgggattggtcaatctcggccgactatatttggctaaattattccggcgctaacagcgtcaccaatccgcttaacacgttatttactatgacacgctttgtgtcccaaatagatctcgtactggctatgtacgaactttgcggctggttttctgttttcgagccgacccccgctgtcgaaatgcagtaaaaatcgcgttaaaggagaatcgcaattccagcacgcaggatctgttcgaacttggagaaggcgaagacgagattccttggaaacgagtttatgcccgcacaaccgtaaaggtcccagcaaatgaaggccaaacgaacaatcgcgaggatggaagagaggttacgaaactcaaaggtacttcgctttggatgagaaagccactcatcgaactgagcgacttgcatcgattcgccgaaaaggtcaaaagtcaaatgtggggaaagcagttttatgatgccgctcagcaggttatcggcattgctgcatctccactcgaggtcgcgggggtcctgcttctaagtcgttctcgacgtctaggtggttcaggattcagatacgtatacctcaacgatttaacccctctatccgaggaagcccaaagcatcgcaggtcaaaaggtttgctacggtgacatcgtgattgtaaacccaatcctaatgaaggcagcaattatcgaaatccaaggtgaggtcatccatgggtcaggcgcggtacttgaccaagatgcggagcgcatgactgcgctccagagcatgggtttcgatgtgttcctggtaacccacgatatgcttaacgacaaaaaacagctagacgccatagtcaaaagcgtctgcagtcgtttggggattcgatataaagccaaatccgaggcaatgaagcgcgccgagacgcaactgcgagcaaatgttctgtgcaactggttggaactcggaaattagccggcgacaaggcgctagaacgacctagttttactgctagtgaattagtatcatttcaaaaccatgccggattacggggctggacccggaccggccgtccataccctgcatttcgctgaatgcgcaagtcgtctacctgcggttttgattttaccgattacggcatgctcgggggttcccggcctggccccgtaaaccggcatggttttgaaatcgccgggtcggcgggagcgcgattggccccgataatgggcccggcgccggcgggatggtcgttgggcggatggcggcccgtggggtggaagcgaaaaccggcgagcggcggaacccgagatgccctgggggcgccggggaggagggcggcggcagcgccgccgcccgcggggcgcgccccgcgggccggatccggcatcgcgggtcccttgccctcgagtccgcgccgcgctctcgtcccagcggcgcccgcgcctccggaaagtttttccaaaattgtccttgcatcgccgggggagttcccgtatagtacttcttcgcacgggggcgtagctcagctgggagagcgcttgactggcagtcaagaggtcaggggttcgatccccctcgtctccacccgagcattgaatgaggctccaacgcaagttggggccttttttcatataggaaaacaaggtcaaaggcggcaccatgatcctcctggtcgacaagatcgtgcgttgaatgggcgtcgcgtgcatggtagtatttcacgacgtggttcaatgcgttggaggctgttctgccaccccaactgtaagtgccactttataagggctcttggcgcaacggttagcgcaggggactcataatccctgggttctgggttcgaatcccggagggcccaccaggtttttcaacaggtcaggcaatatgtctggcctgttttctttttcatggcagtagtttccacttgcaaatagcctgcttgctcacttccggacgccccctgtcgactgcccgcgatgccgccgccacgaaaccggcccatctactacgtttaagcccgacccctcgaccataccccgtatttcgcgaaaaccgcaggccgtctacctgcgattttatttttgcccgaggcgccatggtcgggggatgccggccaaacgtagtagatgggccggtttcgtggcgggaggccccgggggcgggcggagtggagcctgatgggagggcggcggcagcgccgccctcccgcggggcgcgccccgtgggcttagtcgggcatcgcgggcccatcgctctcgagtccgtcccgcatccgcgccgccgccccaggaaagtttttccaaaattgtccttgcatcgccgggggagttcccgtatagtactttttcgcacgggggcgtagctcagctgggagagcgcttgactggcagtcaagaggtcaggggttcgatccccctcgtctccacccgagcattgaatgaggctccaacgcaagttggggccttttttcatataggaaaacaaggtcaaaggcggcaccatgatcctcctggtcgacaagatcgaaaaaagcttcggcgcgcgcgtcctctttagcggcgcatccttccagatcaaccccggcgagcgcttcgcgctcgtgggccccaacggcgctggcaaaaccaccatgctcaagatcatcatgggcatcgacagtcccgatgccggccaggtccagtacgccaaggactgccaggtaggctacctagagcaggaaactaatctggagcaaaaggacaccaccatccttgccgaggtcatggccgccgccaaggaaatccgccgcatgggcgagcgcgccaacgagctgcaggcccagatcaccgagctctccgatcagggcaaggacgtcgacgcactcctcaacgagtatggccaggtccaggaccgctttgagcacctgggcggctacgagctcgagagcaacgcccgcaagatcctttccggcctgggctttaaggtcaccgactttgagcgcccgtgctccgagttctcgggtggctggcagatgcgcatcgcactcgccaagctattcctgcgccaccccgacctgctgcttctggacgagcctactaaccacctggacctcgagagcgtccaatggctgcgcggctttatcgccaactacgacggcgccgtcctcatcgtcagccacgaccgcgcctttatggacgcctgcgtcgaccacgtcgccgctctcgaaaaccgtcgcgtgaccacctacaccggcaactacagcagttacctcaagcagcgcgaggacaacctggagcagatgcgcgccaagcgtgccgctcaggagcgcgacatcgcccacatgcaggtcttcgtcgacaagttccgctacaagcccaccaaggctgcccaggctcaggagcgcatccgcaagatcgagcagatcaaaaaggagcttgtcatcctgcccgagggccacaagcacatcgactttaagttccccgacccgccgcgctccggcgacatggtcgtggggctcgagggcgtctccaagtcctacggcaaaaagcacatctacagcgatatcgacctcaagctctaccgcggcgagcatgtggcgctcatcggccccaacggcgccggcaagtctaccctcatgaagatcctcgccggtctggagccgccaactaccggcacgcgtgatctgggcaccaacgtgggcgtggcctactacgcccagcacgcactcgagggcatgaccgagtccaataccgtcctgcaagagatcgacaccgtcacgcccaaatggaccgtgccgcagcagcgcagcctgctgggcgccttcctgtttagcgacaacgattccatcgagaagcaggtccgcgtcctctccggcggcgaaaaggcgcgtctggcactggccaagatgctcgtggcccccgaggcgctcctgtgcctggacgagcccaccaaccacctggacatcgactcggtggacatgctcgagaacgccctgcaaaacttccccggcaccatcgtgctgatcagccacgacgagcacctggtacgcgccgtggccaatcgtgtgatcgacatccgcgacggcaaggtcacggtctacgacggcgactacgactactacctctacaagcgcgaggacctcgcggcccgcgccgccgccgagacagcaggggagagcgtgcctgtcgcggccaagtccgccaaggtcaccgcggcccagcccgatgcgcccgccgccgcttccaaacctgccgagggcaaaaagaccaaggagcaaaagcgtgccgaggcccaggcccgcgctgcgctcaacaaaaaactcaagggcgtgcgcaaccagctcaagaagatcgaggcagagctcgacaaaaagcgtgcccgctatgacgagcttatggaattgatggcaagtgaagagctttatgccgatcaggacaagttcaacgccgcgctgggggaatataacggccttaagcaggagctgcccaagctcgaggacgaatggctggagctttccacccagatcgaagaggagaccgcgcgtgaactctcgtaaggccgccgccgttgcgatgatcatcatcgccatcgcctgtcgcatctgcggcatctttatgagcgcaatgaccgttctgctgtgctttagcggcctcaccgccaagctgcagatcgttggctttgtcgttgagctttcgcgtgcactgccgagcgccatcgccggctacggcgtcatcacgtcgccttttggcggtgtgttccgcctggattatgctatcgtcgctgtgatcctgtttgtaattgactacctgctcacgcgcgcctcgcgccgcgtccgctaggggagtgttatgtccagcagctacatcatgaacctgctcgccagtgccgttgccgtcatcgttggcatcgtgatccacgagagcgcgcacgccgccgcagcctgggcgctcggcgacaaaacggctcgctcgcgcggccgcgtctcgctcaacccgctcaaccatatcgaaccgtttggcaccatcatcctgccgctgctcatgctcgccgcaggcggtcccgtgttcgccttcgccaagcccgtgcccgtctatctcaacaacctcaagcaccccaagcgcgacgaggtcctggtgagcgtagccggccccacatcgaacatcgcgctcgcgtgcctggccgcagccctcatgcacctgacctacggcaacctctacaccagtatgtcctttgccgtagcgtcgcaaatcatgaactttggcgctacgtttatcgtggtcaacctatcgcttgcgttctttaacctcattccgattccgccgcttgacggctcgtcgatcatcgtgccgttcctcaaaggtaaggcgctcgccaactactaccacctgcagcaatacgccatgcccatactcatcatcgtgctgtatctgctgcccatgtggaccggcatcgatgtaatcggccgctatttcgacgttaccgtgtatccgcttgctgagcagctgctcaacttcgcaatcgccggcatctaaggtaaacttacaggtcgaccgtgcaaaactgtcgcaatatgcacccaaaccgcgccgcgaaggcgccgtcaaaggaggtcgaagatgtcgtatcgcgtgtcgacgcaggtctacagcggaccgttcgacctgctgctgcagctggtaacccgccaaaaagtagatattggcgccatctccatcagcgaggtggccgagcaataccttgccgaggccgagcgcatcgaagcactggacctggacgtggcgagcgattttttgctggtcgcggcaacccttttggacatcaaggctgcctctctggtgccgcaggaggccccacgcaaagccgatgaatacgatgacgagttcgacgaagatctcgaggagctcagcgcgctcgacggcgacgccctgcgcgaggtcctgatccagcgcctgattgcctacaagcagtttaagggcgcggctgcggccctcggtgcccgcatgcaggccgaaagccgtatgcatccgcgtgtggccggtcccgacccggagttcctaggccttatgcccgactaccttgccggcattaccctgcgcggtctcgccgtcatctgtgccgacctggacggcaagcgccagaccttcttgctggaggccgagcatgtggcaccgcatcgccctcccgtctcctgcgcccctcccggaactgtccacatcagtgtagccaatccagtcgcagccccgacccgcggtcacgagcgggggctcctgtcgtttccgtgcccctggattgggtcatagtgtctgacttcgccaaaacatcggcgttgcccgaccagtcgttttggcacttagggacgttccttatgtgccggcacttggggacactccttgggctaattgccgggatagtcgttggggacgttcttgtttgactagtcatttaagaacgtccccaacgactacctcgttttcgtaaccttttcgcaacaatgcgctcttcgcgaccgtagcgcccgctcacaacgtcccctgcgctacacttagtcgcactgtggcgctgctgcgccgtgcccgaaccaagggagaccctcatgaagaacactcagctgctgctgatcaacgatatgtgcggctacggcaaggtcgcgctctccgccatgctgccggtgctgtcgcacatgggctatcgcatccacaacctgccgacggcgctggtgtccgatacgctcaactatcccaagttctacatccatgacaccaccgagtacgtgcgccagagcctcgctatctgggaggagctcgggtttgagttcgacgccatctcgaccggctttatcgtgaccgaggaagagacgcgcatcatctcggacttttgccaccgccgtgcgcaaaagggcaccaaggtgttcgtcgaccccatcatgggcgacaacggcaagctctacgccggcgtgcccgagtccacgattggtctcatgcgcagcctgctcgagtgcgccgactatgcggtgccaaactacaccgaggcgtgcctgctcaccgatgcgcccattgccgagcaaatcacgcccgatgagggccgcgctcttgtggatgacgtgcgtgccctgggcgccaagtcggtggtcattacgagcgctgtggtcgacagtgcgaacgccgttatcggttacgaccatgtggcgggggagtactttacgattcccttcgacttgatcccggtttacttcccgggcacgggcgacacgttctcggcagtgctcgtcggccgcgttatggccggttggagcctgcagcgcgcgacgagcgatgccatgcgtgtggtagcggagctcatcgagcgcaatgccgaccaggaggataagtccgccggccttcccatcgaggcctgcctggatgtgattgaccatgagtaacgccgacgagagcagtaccgaggcggcgggcgagaacaagccgctcggcgcgccgcgtggcaagcgtccgcgtattcgcattagctgcgcggaccagctgggcacatgccgctgccatcacgggcacaagccgggtgacgtcttcgacttcgaccgcgaccgcggcaagatgtgcaccatggcctgccatgtgggctttccctatatagatatcctgcgctatggcggaaccgtgcctggcaacgagcccggtacggcaaagttctgctgccccgaggtcgatacgctgaacgtctggcttgctgagatcgtcgacgagtagtcgagcgcaatgtgacaaagtgacagttcttttgtcacattcgcgggtgctgtcccttcttttttgcttataatcttaaatctctgcatttcatccgatttcaggttctaaaaattctgcgtttcatcgataatcaagcgtataaaactttgcatttcatttgatgacaccgaggggagagcctatgctgcgcaggaaaatagcggcagagctggagcgttggctgaagtctgccgagcaaaaggccttattcattacgggttctcgccagatcggcaaaagctattcgattcgcgcatttggcaaagccaaccatgcaacctacatcgagcttaacctcatggaaaatcgtcaggcaaaagatgctcttctcgaggcgcgggatgccgatgatttcatcagcagggtgacgcttctttcgggaaagtcgattgcaccaggcaaaacgctcgtgtttatcgatgaggtccaagaggcccccgacatcatgacgatggcaaagttccttgttgaggacgggaggtgccgctgggcgttttcggggtcaatgctcgggacccagttcaagggcgtcaggtcctatcccgtggggtatgtccacgagcttaggatgttcccgctcgattttgaggagttttgctgggcaaccggggtgagcgagggggctcgccaaacgatacgtgacgcgtgtatcagcgagaggcccattcctgattacattcatgacgcgatgatggcaaacttcaggacctataccgttgtcggcggaatgccggaggtcgtgcagcgtttccttgacacgcagggcgatcttgcctctgttcgtcagctacagtcagagctcaacgaacagtaccggcgggatatctccaagtatgcaagcgggcgagcccttcaggtgcagagcatctacgatcagctccctattatgctcgagggcgaaaataagcgcttcgtgctcaattccattgaccccaaggctcactacgagaagtatcagcgagattttgtatggcttgtcgatgccggcgttgctctcaaagcagatatcgtaaccgagccaaaatcgcccctgctcaagacggcacggccatcgcagttcaagctatatcaatcggatacgggcatgttgatggcgcgctaccccgttggagtcgcccaagcggcgtatcttgatagcaaggagcccaatctgggcggcatttacgaaaacgtggtggcccagcagctgactgcccaaaatcgccagctttactactatcagacaaaaaagcgtggtgaagtggactttgtggtcgatggaccggatgggacggctgttccgatcgaggttaaatcgggctcctattaccacgcgcacgctgcgctcggccatgtgcttgatacggctgaatatggcgtaaggctcgggattgttttctcgagaggcaacgttgagcgcaatggagcggttctctatttgccgctatatgcgacctgggccctttcggatgttttgggcgactcctgtgccgaggggataaagctggaggtcaagccggtctagggccagtcccggatgtgacaaagggacagcccctttgtcacattcatgagtgtggattttctcccaccgagataacgagcgtggattttctcccgtttagagcgcgctcgaacgctcaaagtgggagaaaatccacgctcgttttatgccgatggcgtggcccgtgtgcccgcgccgcccgagcgcctacagctgctcgagcatagcggtgcaaccggcgagtacatcgcggtaggtggcgtcgaaattgccggtgtaccagggatcggccacgtcgccggggcgatcggtccaatcgagcaggcgcgagatcttgccatcggggtccttcccaaagatacggtgcaggccgcaggcgttctcgtcgtccatatagacaatgtggtcccagtcgccatactccgcgcgacgcacctgacgcgcgcgatgtgcgacgacgggaatcccgacctcgcgtagtttggcaatggtgccgtggtgtggcgggttgccgatctcctcggtcgaggtcgcagcggaatcaatgacaaactcgcccgcgcgcccggcgcgccgcactaggtcggtaaacacggactcagccatcgtcgagcgacagatgttcccatggcagataaacagtacacgttgcatatgcggtttcctttcgatcgccatcatcgagctcgagtatcgcatctacgcctgcgcccttgcccgcctgcgctcccagtgagccaatttaatcgtcaccagcgtaagcacccaggccacaagcgagaacgcggcacccactgcgcctacgtgcgcaatgccaatgctgcttaccacggcgccgcccactgcggtgccaaacgagatgccgacgttaaacgccatgggctcaaccgaacttgcgagtaccatcgacttgggatggcggctgcgtgccacgtccatgaagtgcgtgatgcacgacaccgagaacaagtacatgagcagcgccaagctaaagacaaaggccagcgcgagcggcatggtgccgcccacagcaaacagcccgagtaacgccgcagcctgcagcacgaacgtcacaagcagcgccttcatgccaaagcgcgcatcgatccatccgcccaggatgttcgagatcaggcagaacacgccgtaggccatgagcgtggtactggcttcgaccgtgcccatgcccagcacctgctcaagataaggcgtcacgtagccatagaaaacgtagaccgaccccacgccaaacaaaaagatgagcatgccggtgacgatgctcggctcgcgtagcagacccgcctgctcgcgaaaggtggcgggctcgtcggtttgcccagcgcgcggcataaacatcacgagcgctccgcagatcagaacggcaaaggccagcgtgccgtacatggccacgtgccaatcgagcgtatcggccacaaacttgccgatcgaagtgacaaagaccatcgccacggaaaacgcgccgtacaccaccgagatggcaagcgaagtttgctgcggggacagcagctcggggatatacgtcacgcccacggcgagcagtgcgcccgagacggagcccaagatgatgcgcgaggcgaacagcacttgaaagttgggtgccagcgccatgaccaggttgccgagcacaaagacgatgctatagcacacgagcagctggtaacggcggaagtgccccgtgctgagcgcgagcgccggcgtcgcgatagcgtagaccagtgcgaacacgctaataagttggcctgcggtggcaagcgatacgccgagttccgtcgctaggtcgctttcgatgccgacgaccacgaactcggagcagccgagcgagaatcccaacagcacgagcagcgccaggcagagcttggtgcgtgcgggggagagcgcggcggcagttgacttactttttggcgtggttgcggcggtcaaggttgtcactccaatgtcgcatgaataagcgggattcaatccctgcaactctaacagaatgtgacaaagggacagtctctttgtcacatggagagcttgcctgtatagtcgcaatacaggcgaagatggtctcaggtacatcgcgggcgacaggagatcccatgggtatgcacacgacaaaggttgcagtgggcgagggcaagtttgcgcttgaggaggccctcgaggccccctccattcgcgctgccctcgcgatgtgacaaagggacagtccgtttgtcacattccattccttagaaacttgcaaattcttcaagtttctaaggtaacatcttataaacttgcaaaaaatgcaagtttataagatttcatgtctggccgggcgctagggagactctatggatatcgttcgccgaagccgttatcttgatcgactcattgcttttcaggataccgacctcatcaaaatcgtgacgggcatacgccgttgtggcaaatcaacgttattggacatgatgagggactatctggcgcaacagggggtgccagccgagcgtttgctgacctttaagatggaatctctagagtacacgggaattacggattatctgacgttttatcgtatggtccgggagcgcattgacggcatcgatcatccctacctgttctttgacgagctccagaatgtcgaaggttgggaaaaggcggtcaactcgctccgagtggatttgccgtgcgatatctatgtcacgggctccaatgcctttttgctaatatgagaaagccattgtcaataggcatgttcgtttgagcccggtttaaatccggcggcggcgcgcggtaccaccaccgctattgccgacagccacgagatcgccaatgtttccggcttggacggcctgcgctttatgatcgaggacggtcgtcgcgctcctatttccatcaagtacatgatgccctcgtgcgtgcccgcactgcccgacgagcaggccggtgccgtcatcaccgctgccgatatgcaggcattttttgccgaatatccgggtgatgtctttggtctgggcgaaatgatgaacctgccgggcgtctttatggccgatcccgagacctgtgctcgtatcgacgctgccaaccagacgccgtccaaacaggttgacggtcacgccccgctcgttgccggcaaggacctcaacgcctatgccgcagctggcattatcgccgaccacgagtcgacgattcccgaggaggcgctcgacaagctatctcgcggcatgtatgtgatgctgcgcgaaggcacgtgcagccatgacctggccaatctgtctccgatgctgctggaaaaccccgcccgtgcccgccgctgctgcttcgcgaccgatgaccgcgctccctccgatgcactttcgaccggcatgatcgacaacgcctgccgcgtggctatcgaggccggcattgaccccgtggttgccatctctatggcgtccctttccacggccgaggcgtttggcctggaccacggttgccgcgacccgcatgagctgcgtggcgccatcgccccgggcaagcgtgccgacctgctgttgctcgatgacctgacgtttgctaaggctccgcatcgtgtttatgccgccggtgctttggtggcgcaggacggcacctttgtgggcgagattgcacccgagatggccgaggttgcggcccttgccgatgagctgcgcgcctccgttaggctgccgaagctttcgctcgacgtgttcgattatgcctttaagccgggcgaggcggttattgatgtgatccctggcatggctatcacgggcatggttcgtcccgagactgacgatgacttgcgtcgcattatgcttatcgagcgccatggccgcggcgtgtcgctgcaggccgagggcgtcgacggcgacggtcccgccggcatggggctcgtcggcaagcatatcggtcgcggctgggtgcgcggcttcaccatcacgggcggtgccattgcctccacgatcggccacgactcgcacaacgtgtgcgtggtgggcgacaatgcggcggatatgatggctgccgttgaggccgtgggccagggcggccacgtgctggtgcgcaacggcgaggtcgtggcgcgcattccgctggcgctcggtggccttatgagcgagggcacggccgaggatgttgccgcgcagcacgacgactttatggtcaaggcgcgcgccatgggtattgagccgccgctcgaccccatcatgggcatcatcttcctgcccctgccggtcatcccgacgctccgcatccgccccgagggcatgttcgacgtcacaaccttcacctacgccgactagtcatcggggacgttcttaaacgactagtcatcggggacactctttggcgggctgcctgacgccgcgaccgtaggacctctggcatgtgtgagctatttgccaggtccttgtaacgtttacgcccgcggagtcttatttgagctccctttgggtacgttggaatcggatacgcgtctgattccaacaagcccgaagggagcttttctatgtttaaactgattgcatccgatatggacggcacactgcttgacgaaaacggccaggtgcctcccgagacctatgaactgattctggcgctacacgagcatggcgtgcatttcgccgcatcgtcaggtcgtcgctacgatcgcctgtgcgagttctttgcgcccgttcgcgacaagatggactttgtcgccgctaacggcgcccaagtctacgccgacggtaagatggtagaccgtgaggtgtattcccacctggcgattcgaaggctcgcccaagccgtcaggacgtttcccaatctgcatcttgcgctctttgaccgaaccaagtccttcctgctcgatgacgagtgcaagttcgtgcgtgaggtcgataaggaccttcccaatgccgagcgcatttgggagctgcccgatcccagcgtaaatatcatcaaagcgagtatcttttgcgacgacagtgcggttatggacagtgcgtacgtgctacagcgcgaactcggtcagctctttacctttgcgccttcgggcaacgcgtggattgatgccatgcagcccggtgtgtcgaaggcctcgggtattgcacagctcgcggagcattacggcattgggcgcgacgaggtcatggcgtttggcgactcgatgaacgactacgagatcattcgctttgtcggcacgggctgcgcgatggaaaacgcgcgccctgcgctcagggcggttgccgatcgcgtggtgggtcgtaaccgcgaccacgccgttcagcaggagctccgccgcgtgctagagggcctcgcttaatccggcagctggggacgttcccgttctgccggcagtgggggacagtccttgcagcttttcacgaagagtgtccccaacgactagtcattcaagaacgtccccaatgactagccgatgactaggcgagggcggccatgatggtgcgggcgacgccgtcgtggtcgttgtcgaactcggtgatggcgtcggcggcggcgcggtcttcgggctcgccgttgatcatggctatgccgtggcctgctgcctgcagcatgggaatgtcgttgatgttgtcgccgaacgcccaagcgtcggcgagacgctcgcccaggtgctcgcagagccacgtgagggccgttcccttggtggcgccctcgcccatgacctcgatattcatggcgtacgaacgcgtgacttcaatgcctccgagcgtgtcgagttccgccgcgatggcgtcgcgatcagccgggttgtgccagtacatggcgatgcgctcgagcgtctcgacctcgtcgatcttgctgtcgatatccatgtcgatcggtgttcgtgtgcgcttgagcgaagccgcgatgtgggggtcgccgccgcagaattcgtccaggcgcgtgtagagcgagcgggggaggaagcactgcccatccgcgaagatatcgaaggtcacatcgtggccggcggcgatgcgatggatgcgatgggcaatgccgcaatcgagcggacggctcaagatgcacgtggcgcgcgaggcgtcggtgggcacatcgtcgtcgagctgccagacgctggcgccattggcgcaaacggcatagtgcacggcggtatgggcgaggatgggctcaaagatgcccgacagcggacgtcccgtgcagggcacaaattcaatcccgcgtcgagcgagctcgtcgagcatcgcccaggtggcatcactcatctgcttatcgctcgtcaacagcgttccgtccatatcggaaaacacaatcatttgatgcagccctttctgctggcataaaaagcgtggccgagggcgatgatgccctggccacgctcgggttctataacggtccgcgtcctagcgatcggcgagcggcttgtactccagcggctcgataaccgggcgatacgcggggcgaataatgcggtgcgcgcagaagagctcttccatgcggtgtgccgaccagccggccatgcgggcgacggcgaatagcggcgtaaaaagcgtctcgggtacgccgagcatcttgtagataaagcccgtgtacaggtcgatgttggcacagatgggcttggtcatgccgtggtcgcgcatcacctgcggtgccaggcgctcgatgcgctcgatgagcgcgaactcctcgcccaggtccttcttggcggcaagcgtgcgcgcgtaacggcggcagacctcggcgcgcgggtcgctcagcgtgtagacggcgtggcccataccgtagatgagacccgtgccgtcgaaggcctgcttgtcgaggatcttgcccaggtaggctgcgacctcgtcctcgtcctcccaattggagacgtgcgcacggatgtcctcgtgcatggacacgaccttggcgttggcgccgccgtggcgcgggcccttgagtgagccgatagccgcggcgtaggcggaatacgggtcggtggccgaggaggacagcacgcggcaggcaaacgtggagttgttgccgcctccgtgttcggcatgcagcatgagcatcacgtcgagcagcatggcttcgtcgcgggtgaatgccatgccgccgcgcaggacctgtaggatggtctcggcggtggagaggccgggcgtggggtgcggcacgtgaacttcggagccgcgaagcttggcgaccgaggccatgtgtgcgaaggcggcgatgcgcgggagacgtgcgagcatggaaatggcgacgtcgatttcgtgctcgggcgtaatggcgtcgggctcggcgtcgaaggcgtagagcagcagcacggcgcgctgaagcacattcatgatgctcgacgacaccgtggtcatggggaactctttgacgtactcatcgctcaggtgcctaaaagcgcccagacgtccgcaaaaaccgtcgagctcctctttgttgggcagcgagcccgtgatgagcaggtaggcgacctcttcgtagccatagcgattctcggcctgggcgttgttgaccaggtcctcgatgctgtagccgcgcagcgtaagcttgccctggtcgggcacgactttgccgtcgaccttgttgtagccgtgcacgtccgagatgcgggtaaggcccgcgaccacgcccgagccatcggcattgcgcaggccgcgcttgacgttatgctctacgaacaggccctcgtcgtacggggcggtcggcaggccgtggtagaggttttcgctttcgggcgaaatctgacggctcgcctcgtaatccagaaccaggcggctcaggtgatcgtcgaagcggtagtagattttcttggcgtcgtaggccatgcgcgctcctctccggtccgctttggggccgcgcgcttggacgatatgacgtcaagctgccccgagcggcttgttcgctacaggcggtacataaagttaaagacgtcctcgcgctggatggacacgttgacgcccgaaagctcgccggcctcggccagggccttctgcagctcggcgaagtcgagcttggactcggcggtgtcggccagcatggtcatggtgaagatgtcctcgataatggactgcgtgatgtcgcggatgtcgacgttggcctcgcccagaacgcgggtgacgccggcgacgatgccggggcggttcttgccaaggacggtgatgacgatacgggaggacgagatctcggccatgggaaaccctttcgcgtggttgcggcgcgcgcggggcgctccgctacggtacagtgttcatcattgtacctgtctggcgcaaaaaaggcgcgctcgctgcagcgttacatgcctgcaacatgagcgtaagggggaaggccgtacggggaagagccgtctggcgcgtgtccggctcgtgttgggttgatttccgatctcagccgaacacattgagcggatgaactgcctcccatttcttggacacgagaaatgggaggctttttatgcgtgtcgacttgagggtgaagcacgacatcgaggccaggaaggcggcgatcgggctcttcgagcgaggccacggttacaaatcggcggcgaaggcgctgtcggtcccgctcggcaccgtgagacaatggctctacgtataccggtcgttcggaagcgaggtgctgctgcgcatggacggaaagcagggcaggtacacatacgagcagaaggtcgccgccgcctccgccgtcgtcgacggcggcatgacgaaggccgaggcgatggcggcgttcggcataatgtcgatgtcgccgctcaagaagtggtgcgcgctatacagccggggcggcgcggaggccctgcgcccgaggcccaagggccggccgagcggttccaaggcgaggccgcgcacccgcgagcaggagctcgaggagcgctgccgaaggctcgagaccgaggtggcctacctaaaaaaattgcgtgccctggtcgagagggacgggctctgaccagggcgaaggccgaagcggtcgcggccctgcgcgccgaggggcacgcgctcgggcacctgctcgcatgcgccgagctcaagcggtcgacctactactacgccctcgcgcacccgccgaggcccacgcgcgccgagctctgggaggcggccgccgagatcttctcgcgcaccgccaacggctgcgggcaccggcagatagcgatgtgcctcagggcggaagagggggccgtgatagccaacaagaccgtgctcaagatgatgcgcgagatggggattcgctgcggcatcagacgcgagacggcctaccacaggtacaactcgtacaagggcgtcgtcggcagaacgttcgagaacgtgatcgcgagggatttcgacgccggggccccgtggcagaagctggggacggacgtcaccgagttcaaggtggctggcggtaaggcctactgggccccgacgctggacttctgcaccaaggagatcgtggcgagcgacatatcgaccacgcccgacatggcccagcaggcgaggatgctcgacgagctgctgtccaagatccccgagggcgccgccccgaccatgcactcggaccggggctggcagtaccagcacgcctcatacacatccaggctcgaggccgccggtatcgtccagagcatgtccaggaaggcgaactgcatcgacaatgccgccaccgagcagctcttcggccacgtcaaggacgagttctacaggggccgcgagtggaagacgttcgaggatttcaaacgcgacctggaggaatacatagtccactggaacacgagccggaggcaggtaagattgaagggcctgaccccggaggagtaccggaatcaggcccttgcggcctagtcgctatttagggcgtccaagatttggggcgcggttcacttcgacggggcggtttcctttttcgcgaaggtccccctctaagcgtcgtgcatttttaggagtattcaacataaccaagagcttcgggcgccacgataaatgccaaagaccgcgaatatccctgcaaatcaaacgctgccagcccataaccccgcccatcattcgtagaaaacatcgagaactcccgattttttgcccgagatcggtatgcagggaccttcgactgcagaatactcgcaaaaatgcacgtcgccaccgcccccacatggcgcgaagcaaagcaaaagcgcagcctaaaaggccgcgcaccatctttattcagattaatcattgcccgttgtgacatcgccgaacccgcagggcagagaacaagttccctcccggcgcactccgcaggacgcaagaagccctcgccgcacgaagtgcgcagcgagggcttcttgcatgtccgaggacgcgccgggagggaacttgttctctgcccggataggtaagacaaattacgcgacggtgtaaacccagttgtgcttgtcctcgacagcaccagactggataccagtcagggtctcgcgaagcttcttcatcacagggccgatctcggtgtatccagccgggaaggtcacggtctcgtcggcgccgtaaaccttgttgtcgatttcgccaaccggagagatgacggcagcggtgccgcacaggccgcactccacaaaggtgccggccttgacctcggcccactcgacggggcgctggtcaacggtcatgcccaggtcctgagcaacctgaacgagcgaacgacgggtgatagagggcaggatggagtcggtgtgcgactgcggaacgacgagcgtgccatcctctttcacgaacaggacgttggcgccaccggtctcctcgacataggtgcgggactcggagtcgagatacaggttctcggcatagccctcgcgatgggcctccatcgtgggcttaagggacatggcgtagttcaggccggccttgatgttgccggtgccgtgcggtgcagcacggtcatactcggaaacgcgcagcttgacgggcttgaggccgcccttaaagtacggaccgaccggggtcccgagaatgcggaacgtgtactcaggagcgggagccacgccgatcacgtcaccggagccgatcataaacggacgcacgtacagggtcgcgccggaaccgaagggcggaacccaggcggcgttggcagaaacgacctgcttgacggcctcaacgaacttgtccttgggaaacgggggcatctcgaggcgctgggcagagttatacatacgctcagcgttcatgtcgggacggaagcagacgatgctgccgtcctcggcggtgtaggccttcaggccctcaaagacctcctggcagtaatggaagataccgccgcactcggagacatgcagggtgtggtcggtggtcaggccgccctcgtcccactcgccatccttccaatgagcctcgtagctgtaatcggtcttcatgtagccaaagccgaggctaccccaatcgatatccttcttctcgacagtcatatgtcgctccttacatacacagttgcatactcgcgaacccgcacgcaaggaccgaggccgaccgcgtcgcaacgtcgcacgcccggagcgtagagccggacgggacacgcgagcagcatcaaagccgatggcacgtcgattcgcatgcacgagattgtactccccgcatgcgtctgataaaacgcttttctttaactaagtaaagtattttcatttgaccgaagcaaaaaggcccgccaccgtaagcggtgacgggcctcaactgtacggtctgcgcgctggctcgagctaggcgttctatttacccagcttggccttaaccagaccgaccacggtcgggatgatcgacacggcaacgatgccgataatcagcagctcaaagtgctcttgcacaaagggaatgccgccaaagaagtagcccagcagcgtaaagaccgtcgaccaggtaatgccgcccagcacgttaaagacgacaaagttgcgccagtgcatgccgcccatgccagcgataaagggcacaaaggtgcggataaacgggaagaagcgacccaggaagatggccaggtgaccccacttgtccaagaagtcctcggactttttgatgcgctcgggcgtcatggccttgaccttgcccgaagcgatgatcttgcggccaaagaagtgaccgatcataaagttgcactgatcgcccaaaatggcagcggcccatgcggtggccagaagcgccacgatgttaaagccgccgttgtgggcaaagaaacccgaggcgaacagcagcgaatcaccgggaaggaacgggaagaacaccacgcccgtctcgataaagatgatcaggaacacgcagccgtaggccataagcgggccggcggcgatccagctggcgatcgcggtgcgcgggtccttaagcagctcggcaataaaattgatgaaacccatgaagtaaaacctctcagttgtgggcgcggatacgtccaagttgaccagtatacggttgcggtgccccctcgtgcgcaaccccacaaaagcatgactccattaccagcaagtttgcataactgacacttgtagcgcaaagccgccaagattgtcctttttaatccctagcgaatcgctatactttattgaatcgcattgccatggcgctaagggagggcggccggtgagctttatcaataccattcgcgaggacatcaagaccgtccaggcgcaggaccccgccgcgcaaaacggtctggtcatctttctttcctatcctggcctgcacgccaagtggaaccacgtgcccgagcactggctgtgggagcacggtcatcgctcgctcgcccgcgtgctctcgcaaatcacccgccacatcaccggcgtcgagattcaccctgccgcgcagattggcaagcacttctttatcgaccacgccatgggcgtcgtcatcggcgagaccaccattgtgggcgacaactgtgtgctctaccagggcgtcacgctcggcggcaccggcaacgagaccggcaagcgtcacccaacgctcggcaacaacgtcaccgtgggcacgggcgccaaggtgctcggcaacatctgcatcggcaacaacgtcaagatcggcggcaactcggtcgtcgttaaggacgtccccgacaactgcaccgtcgtgggcgtgccgggacgcatcatcaagcgcaacggctgccgtgtgttcgaggagagtttcgacgccaagcactgccgttgagtccgtggccgctaacggtgccgcgcccgcgagcgcacccgtcgccgtcacgcccgcagctcccactccggccgtccccgcgatcgcgtttatcggctaccaaaactcgggcaaaaccacgctcgtcgagaaggttatcgccgagctcacccgccgcggcctgcgcgtgggttcgctcaagcatcacgggcaccacggctttgatatcgatgtgcccgctaaggatacgtggcgccatcatcaggccggatccaaacacgtgggcctcatctgcgccacgcgctgggcggagtacgccgacacgcgcgaggaggacgagatgcccgcgcgcgagctactgtcgcgttacaacgatgtcgacgtggtgatcatcgagggctacaagaccgagggcttcgacaacattgtggtcgcgcgctccggtgtcgaccgtctgcgcggcaagagctcgctcgacctggtcgacggtcacacgctggcccttgcctgcaatgaggccttggcgcgtcaggccttcgacgccggcttcgcgacccgagccatcaacatcaacgacgcccgagccatctgcgacctcatccaagaccacctttaaggcttgacgctgaacctgccaaaaagggacaggtttattttggtaggttttatctgggcaaacgctgtttccaccacaaaggggccaggtacctttgtggtgattttgctttgttagatgtgtgggacatgccttacaatctaccaagtagttcatactgagcgaaaaacggagagaaggggcttgatgcgcccttaatgtttcatgcggatagattgatttgacagacggtggcgaatgcccgccgtccgcattcgtatgaaacaaggagtctccatgcttgcctctcttttctcaaaacctcaaccatcgctgtccgtgcaggccaagcgcctggtggcgatgcgctttctcatctacaccggttttcagaccagctactttatcggtgtcatcggaacgctcacctatgcagacgatgcctcggtcgtggcgacatcgctggccgttctgtttatgaacgtattcgtgatcctggggtcctttgcgggcggcgctgcgctcgacgcctggggcccacgtcgccatttcttgttgagtatcgtcggcacgctggcgacgggtgcggcaatcatcgcctttggcagcgcgaccggaacagtccttgccgacgcggcgctcctaggttttgtgatgggattcgcccaacccatcgccacgtcctatccggcatatctcaccgacgatcccgccgaactcaaagacatcaactccgccataaccatgttctccaacgtgagcattatcgtcggccccacactgggcggctttgtcgcggcggctacatcgtcacgcgcggtgttcgtgctcatgatgatttttaccgtactggcgttcattgccggccggggctttagaccgcaagcagttcgcgtcgccgcgcgtgaaagtactcccgcggacagcagtacaaaggcaatcactgccagccaaagctccaaccccagcacgttcgcccgcgtcaccttcgcgacaagcatcaagacagtcttcaccaacagtatcctcgccttgctgttctgcattattttcctctcgaactttggctacggtgccttcgatccgctggagtcgttcttctaccgcgatgtcctgcacgtcggtgtcgaatggatgggctggctctcgtcggccagcggtgtgggcgcggtgctgggcgccgtggccgcgctccgcttgccgccgcacctggtcaaccttaagacgctgcttgtggcgctcatgtccgtgggtctgggaagcctgctctacgtgggaacgctgtacgtgggcgtagcccttgtcggccagattgccctgggcgtggcctggggcgtcgtcaacccgctccacaacacgatcgtgcaaacgacggccccgctcgagcagctcggtcgcgtgaactcggtcatgggttttggcaatatgttcgccggcgtggccccgctggcgattgccccgtggctggcggcgacgtttggtgtgcagcagacgctcgttggtgcgggcatggtcgtgacggcagttcccgcggcgttgctgctgtttggacgccggcattttgatcgtgccgcaaggcagtaaaaaccatcacaacattcgatgaaaatcgcgattttgccgaataacgtcgaatgttgtgatggtttgcgttccggccaggccaccacaaaggggccaggcacctttgtggtggtttttgctttgacgggccgcgcctgtgccttggtataccatgtacgccgttcacgaatacgccccacaccgccgcacaacccagaaaggcccccatggacaccaccttcagccacattaaagccgtgttctgcgatgtcgacggcacactgctcacaagccagcacacggtgtccccgcgtaccgtggcggcgatccgcgcactgcgcgagcgcggcgtgctctttggcctgtgcaccgggcgcgacgcccacgcgaccgaggccatgtacgagctctggggtatcgaaggcctggtggacgtgctcgtgggctgcggtggcgccgaggtcatcgaccgtgcacacggcatcaacgagctgagctacccgctaccgggcgagaccatcgcgcacatctgcgagcacatggcaggcctgccggcaacgcctgtttgccctcgggacggcgtgctctatgtgcccgagagcaatgcgtgcgtcgagcacctgtcgcgtgtcgacggcgtgccctacaaggtggtcgactttgccgagtttttgcgcgagccgcagaccaaggtgatgtttaccatggcgcccgaggtgatgccgcaggtcatcgagcgagcgtcgacgttcgccgacgataccgttaaagcggctgctctacagaccacgcagcgactctacgaattcatggatccgcgcgtgtccaagacgcgcggccttgtgcgcgcggcggagctcaacgacatggagctccagaacatctgcgtgtttggcgatgccgataacgacacctgcatggtggccgacgccggcgtgggcgtggccatggcaaatggcagcgatgctacccgtgccgccgccgactttgtaaccgccagcaacgacaaagacggcatcgcgatctttatcgaggaacatctgctgtagcgccggtggagagccaccacaaaggggacaggcacctttgtggtggccgcttgattgcaatagacactcaggtgatttagatgaattgatgcctaaaatctgcgcgcaaattcaaatatggttgtctgaacattacgcttctaaccaccgatgggttaaagatattctcatcagtttggtaggatattccttccggttgatgacctactgctcgcggtcgattttcgaccgtgagcaggatgtttgctattgaacaaaaatttgtgcaaataaatctaatgccattaaaaaataatgtgcaactaaattaccagtagaaacaaaaaatagatagcgaataaacgaaggtaaatctgagcaaatgtcaagagaattgagactcctctacaaaaatgtcggttttgttgctcagatgtctaaacaatcgttacaatatgaacattaaacgtgcgcaattacagattgcgcagatacgtttgatagtgaaagagcaagatcgcggtctcttggggaggagacatcgatgaaagcaaattcagacaaatctaagcagagtaataaagcgacgcgccgtgtactggcaggcgttttgtgcggagcatctgttttgagcctggtgctgtcgctcgtcatgcctccgatctcgcaggccattgccaacgatgcccagacggtttctgccgaggaatccgttgcgggcgaaggcgctttggacgaggaggccggtgcagacagcaccgcagataagggtaccgaaaaccagaatggtgatgacaccgagcatagccagggcgaagacgccgctacgacggacccgtctgccgatggcgcggaagccaagggcgccgcgcagccttctggtgatgaagcggatgatggagatagcatcgctcccgttgcagatgacgaaactaaatacgatattcatagtggggaagagttggcttcaaagcttcaggacgagagccttcggcttataggacaaaatgtgtgtccacgttgggggcatcggcgcaggtcgatgccgggcccgtgggttataccctaagagcaaaccaccctttttaagggtggttctgatttacatcagcccccagaacatgtttgagaactgtgcctgaagtatgtatttgcaggccccgaatcggtgttgcctcccggcgcattccgcagggggagcgatattttgcagcacgaagtgcgcagcaaaatatcgctcatgcccgaggacgcgccgggaggcaacaccgattcggggccggacacacggatctacctgcgcatttacaaattcgtaaacttttttgaaaaaagtgcttgcacagttctcgaatcataggttattatcttcctcgttgaacgcgcgggtccaacaaaacggaccgcgaatcaacaacatagcatgtcggagtggcggaattggcagacgcgctagcttgaggtgctagtgaccgctttttggtcatgcgggttcaagtcccgcctccgacaccatcgcatttgagaagcctcttcggaggcttttttgttaccgatagacggtggggtccacgatggaaacgcttgaacgcaacgagtgggcagacgttgcccaactagtcgagatcacgagcgatgctgtcatcatctgtgagctcgacggaaccattctgcatgtgaataatcgcttacttggtttgatgtgcgaggaacgcgccgacgtcatcggtggagatgttaaagacgtcctgtactcatccgcttttgaacgtgcgacggaacatcgtctgccatttgaaactgatggctccgagaacgaactgatgctcaagctgagtgacggctcctttatccccgtcttggttcgtgcgggctccgtgacgcctccacgcatctttgggcgccgcgcgccacgtgtcctggtggcgctccatagcatcgaagaacagtattctcacgaccgtcaactcaagcgtgcgttatcggagcttagagtggcgaacaagcgtctctctggcacgctttcggtcattatgagcactgtgggctccgatgagttacccagcctgcttgatactgttttgaaccagcttgtaggaacgctcgatgcttcgggtgccgctatctatttttctgagagcggcggttttaaacttcgcggtgtttccaaggagctgtacgacagctacctgcctgagtttttgccgtatggcgctggcattccgacgtatgttcttcgtgagtcgcgtgcctgtcgcttgtcgattcaacaggaccttgagggcgataaggccgcctccggtatgttcatggacttggacaatcgttctaagcacctgttgcgcgtgcaggatatgcctccgtaccgcagcgagatctgtcttcccgttttttacggtacgcagatccttggcgtgctggaagttggttggaaacgcccccaggcaccgctcgcctatgacgttaatgtactcgaggtcacttgcgattacttgtctatccaactggtcggcatggcatcgagtcttcgctctcgtcgcacggccgagcttggccgctcgctcaatgtcttacgtgatgagttgtttacctttctagacgattccgtcgcggctacccaggcggtatcgtccgagatctgcaatatgctcaactgccatttttgccctgttgagtatgacgccagtctggattcctacgtcatagattttgaaggcggcagtcgcgttgctttgccggacgatcccgagaagcttttcttttccacgacggcgccagcggcacgtctgggggctggccctgatggctttgaggcatctgttttggggggtacgagtgccgaggaccttaaacacgtccgtataactcgcgttgacgaatcgatgcctatgggaggctggcttagggcgcatggtctgccttgtcaaggtctctacgtcgactccggcatcgaggcggggcacccgcgctctgagggcgatggcaagcacagtagcgacgcgattgttcctgcttctgttgcgaagagcccgacgacgcgcgcgctgctgcttcgtgatggtagccaagagccgattgatgaccttgaatatgactacttggtgcacttggcgcatgactttgaactgatctacgaaggcgaatctcaaaagcgcgaggagcgccatatcgctcagacgctccagattggcatgagaaattccctgggggatgttccgggtatcgcaaccgattcggtgtacctgtcggccacgaattcggcgttggtcggaggcgatttctatacgctcattcgtcttcccgacgactgcgccgtcatgattctgggtgatgtgtctggcaaaggcattgaggccgcatcgatgtccgcgctcgtcaagacggccctgacggcatatgcctgggagggcgctggaccggcccgcatggcacgctcccttaacagcatgctcatgggcttttcgagggtcgagacgttcgtgacggcctttatcgccaagattgaccttaaggccggacgcgcaacgtattgttcggcgggccatcctccgaccatggtcatcaggccagagtcgatgccgctgggtggcggtgaggcacgtgggggagaggttgagctgcttggatgccaatcgggcgtaatcggtgcctttgagagcatggtgtacgagacaggcgtgtttacgttcgcccccggcgacatgctcttcatgtatacggatggaacgattgaggcccgcgaccgcaccggagcgttctttggcgagcagcgcttgcgcgaccttctgctttctgtttcgggggagggcgtgtcgggcatttgcggcaaggtcttgggcgagcttgaccgatttaccgaatcggcgctggacgatgacattgcattggtgtcccttgagtttttacggggtcgttcatagacgacgctgggcgggctgaatccgcacggttggggaaacgaatgcatcgagtgggcttttttgggaaccatggtcgtatgaatgagtggaatgacatagcggttttgacgccaccgggcgatatcgacatcgccacggtgcctgcgctgcgtcggcggctggatgctttgattggccgcggcgtgcgtcgtgtcgtcatcaactgtcaggctgttagctttatcgattcgacgggcttggcattcctgcttacgcgcgctcgtgagctcatgaggcgagaaggcctgctttcgctcgtcaatgcatcaggtgaagttgttcgctttttggagattgctcgtcttgtcgatatccttcatgtcgcggggccggcacgggagtctattcccgccattccggtgggggagctgcctcgctggagtaagagcgttgaggtccgtcagggtatcgagaatcttccatactaccgacatcgcatcgccgaactccttgaatcgcttccgttgcgccgtgacgagcgctacgatgtcgcattggcgtcgggggaggcgctgggtaatgcctatgaccatgcgggcggtatcgggtgcgtcctgacggttcaggcctatggcgatcgcgttgtggttgaggtgcttgatcgaggtgccggctattctatcgataaaacgagcgagccggtcgcatccgaggaacgcggccgtggtatcaagcttatgcgtatgctcgtcgataacgtggaggttgctcgtcgtacggacggcgccggcacgcgcgtgcagatggtgaagctgtttagcggagcgctggaatcgtgtgcctagccaatcgctttaacgcgtttggctactaagaacatgcggcagacaagttttttgaaaaaagtacttgcgtcttttggacaactcgcgtaaattaataacccgcaagcggacatggctcagttggtagagcacaaccttgccaaggttggggtcgcgggttcgagccccgttgtccgctccatttgggcgtttagctcagggggagagcgcttccctgacacggaagaggtcagaagttccacgagcgggggctcctatctttttagtgccctcggattgggtcatagtgtctgtcgttgccgaaacatcggcgatgccggagtagtcattggggacgttcttaaatgactagtcagaaatgagcgtggataatctcccggttttggcctgtgtgcgggctcaaagtgggagattatccacgctcgctttaatttgcctgggctgcgatgcctatctaatcggctcggcgtcttccctgagaatcgaaagatactcttcatacccgtactgccggtatctctgtcttgactcgtcgagaggacggaggatacccaattcttcaaatgatttgacgagcgagctcgcggtactcctgccgatatcaagttgggcagcgatgaatgcggtgtcgacgatggggtgctcttcaagaatgcccaacagcctttgcccgtttgcagcggtccttccgagattttcggtaatggttgctgtggaacggttatggaggtcaacaaggttttttaaagaccctaccgagtccttcgcactctcgagaagactgttgcagaaaaactctatccattcctcgtaagtgcctctctcccttacggatgtgagttgccggtagtactcgcttcgatttttcttgaactggaacgatggatagaacaagcaagaatgaagaacgccatcattgatgagcataaatgtaatgagaagcctgcccaggcgaccgtttccgtctaggaatggatgggcagtttcaaattggtaatggacgagcgccgcccgcacaatcggatccatttcgacttgaggctcattgataaagcgttcgaggtcctggagcgtgttgctcaaatcttcaatgtttggagggacaaacgatgcggttgcaatggtgcagcctgaggggccaatccagttttgtgaggagcgcagctcgcctgggttcttctccgttccgcgcactccgtccagcaggactgcatgaacttgcctaagaagtctcgtgcacaagggcatctttttgagcagttctacgccgcggtcgacagcacggacgtaattcacgacgtctgcgacatctttatgatggagttgtgtttgcgatggactaagtaggtcgtcaaacgtgcactgggttccctcaatttgcgaagaaaggagcgcttctttgcgcacgtacattgccagatacatgtcggcgttgggaacaaagtagagcatgccttcaagctctccaagctttcgtgagcatgcggaaagcgtgcgataggtttcctcggtgaggtttagctgcctcaatgattgcaagggcgttggaaaaaacgaatagtaagccaatttccccgatagattattgcggagcgttccctggccgttctcctcgatttgcatcgcgccctccatatctttagtgccggaaactcgttattaggctaatcatatcaattctaataacgagtttaaggattaaatagttattagaattgatgtaaacaatctaatgataaaaagtcgttattacttgaccatggagctcggcttggtacaagggggtcatccaaaatgaacgtggataatctcccgtttttggctcggtgacggcctcaaagtcaaagtgggagattatccacgctcgttagttaagcgtccgaaaatccacactcgccaaacctaccaaaaagggacgggtttattttggcacgtttcggtcggtatcaggaagtgtcagggacggggcggcggcaggactcgagagcgaaaagaagtatcgggtttggtgcgcccgcttctgcccgtcccgtgcgcagacgatactcggcttatcgacccgcgatgcaaaggagatgctcgtcccgcgagcactaccgggaagggctcgcgattcgagtccccaccttagcatttgaaccatttggcactataatcaccataggcatgcgcataacgttgcgcttaatcaagaggagaaaacgtatgggtctgtttgacatgtttaagaagaaggctgagcctgccgctgctgcagctcccgcttccatctctgcttctgccggcgccgacgtgctgtgctcgcccgtcaagggcaaggtcatcaagatggccgacgtgcccgatcccgtctttggtggcgaggttctgggcaagggctgcgccgtgtggcccgaggacgacctggtctacgctccctgcgacggcaaggtgaccgtcaccatgggtcacgccgtgggtctgcagtccgatagcggcatcgaggttctggtgcacgttggcgtcgatactgtcaacatgaacggcgatggcttcgagggcttcgtcaaggccgacgacgttgtgaaggccggccagcccatactcaagatcgaccgtgccaagatcgccgctgctggttataaggactgcgtcgtggtggccgtgtccaacaccgccgagtttgccgacgtcgagctcaccgttgaggcagagtccgccgtcgccgccggtgacgccatcgttaaggtcgtccgcaagtaaactgcggcatccaaaggatgtgcaagggtggtcgggttttccggccaccttttttattgcatcgcggggaagcgttttattgcacgttgggcgggcttgcaaaccgttcggacgctaaaacgaaccgaccgcgccttcgcgttgccgagggtgttcataagtggatagtatgggcttacttattacaacgtgtgccgcgtccgggaagcgcggtgccgctcattgggaggaacaacatgaaaaagaagctgctgcttgcgcccctcatggccgtcttggttgcatgcgtggtcgtactttccggctgtggaggtccttcggttgaggagctcatcaccgaggatcttacgacacagtttgacgaggtcaagaacggtggcgacgacttcctctctggtctggaggaggcttcgggcgacgagttcgagcagctgggtatcgatcccaaggagtacgccaagacctatctcgagggctttgactacaagatcggcgacgtgacggtcgacgaggacaagggtgtcgcgaccgccgaggtctctatcacctgcaagtctatgaacaagatcgtcgaggacttctccacccagtatcaggagaaggtcgctgcgcttgatacggttccttccgatgacgagctgtacaagatggccggtcaggtcatggtcgatgtgaccaaggccaccgagcccaggaagaccacggtcatcttcaagtacacctgcaacgacgacggcgagtggtctgccgacgactccgtcaactccgagatgatggatgcaatgctgagctagttcgttgcggcgttttaccaaacgccgcaactgctcgacgctgcaagcccgccagagcggcaatctgcctttcaacttcggcggcatgaccaaaaggtcaatgccgcctcgtttcaaggcaccttgctcgccctggcgggctttcgctcatatgacccaatccgctgtcaagagccacaatggccccgccgaccgctgggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgagaggggggaggcgccgaaggtgtggagggtgaggggggtgaagtcgtaacaaggtagccgtaccggaaggtgcggctggatcacctcctttctagggagataaatcttctagagagaaaacactttaactcgaatagagggcaggagcccgtccggtagatgtccgccaggataagtccccgcagcacccggtccccggggtcgcacccgcgtaccttgagagccgcatagcgataggagagagatggaagagtatcctcttccagactcgattcttttctgcgatttatcagacagaatgatagcaatcattcatccgatccaaacaagaagaattcacttatatatgagtgaggagcatctgatcgcgagcacagtgaagacactgtgccgcggtatgagatacccgaattgcgacatacgagcgctattcatgatatcgattaattaactttagcgacacgtggatatcccgcgggcccgatgcggtcccgcaagataccacgggcgcacggcggatgccttggcacagggagccgatgaaggacgcggcaagctgcgataatccccggcgaggagcacacatccttcgacccgggggtctccgaatgggcgaacccatgcacagcagtgtgcatatccccccgctgaacgcataggcggggggaggacaacccggggaactgaaacatctaagtacccggaggagaggaaatcaatctcgagactccccgagtagcggcgagcgaaaggggaccgatggccaaaccgtcgagcgggcatacccggcaggggttccgccgacggggttgcagggccgcgcatccgggggctgccgcccccgggcgcaggtccggctggggagcggaacggcatgggagggccggccgcagcgggtgacagccccgtacgcgaacccagaccggacggcgcgacgcggtccctgagtagggccgggcacgtgaaacccggtccgaacctgggtggaccaccatccaagcctgagtactaccctgtgaccgatagcgcaccagtaccgtgagggaaaggtgaaaagcaccccgggaggggagtgaaacagtacctgaaaccgtgcgcccacgagcagtcggagcacctttatggtgtgacggcgtgccttttgtagaatgagccagcgagtcgctggcgcggggcgaggttaaccgaaagggagccggagcgaaagcgagccttaacagggcgacttgagtcccgcgccgcggacgcgaagccgggtgagctatccgtgggcaggctgaagcgggggtaagaccccgtggagggccgaacgcacgtcggttgaaaacggcggcgatgacctgcggataggggtgaaaggccaatcaaacccggagatatctcgttctccccgaaatagctttagggctagcgtcgcgcgttcaccgccggaggtagagcaccggatggacgagggggcttcgccgcctaccgaatccaaccgaactccgaatgccggcggcccagagcgcggcagtcagagcatgtgggctaagctgtgtgctcgagagggaaacagcccggaccgcccgctaaggtccccaagttccagccgagtggcaaaggatgtgcgtccgcccagacaaccaggatgttggcttagaagcagccatccattcaaagagtgcgtaacagctcactggtcgagtggacatgcgccgacaatacacggggctaagctggacaccgaagcggcgggattttgattttcagaatcggtaggggagcttcccatgggcggagaagccggagggcgaccgacggtggagcgcatgggagtgagaatgctggcatgagtagcgagagacgagagagtaactcgtccgccgtgaacccgaggtttcctgggcaaggctaatcctcccagggtcagtcgggggctaaggcgaggccgggaggcgtagccgacgcgcagcaggcagacattcctgcaccgcgcacgcggcgctacgaccgacggggcgacggatgggggtggctcggcggggttctggacgtccccgtgatggagcgcggcccgcggaccagggaaatccggtccgcagaagggcgaggctccggacgaagcgactgagcgaagcgagtgagcccgaggtccctagaaaaacccctaggcaggcgcgtgcgcgcccgtaccgcaaaccgacacaggtgggtgggtagaacataccgaggcgatcgggtcaaccatggtcaaggaactcggcacaatggccccgtaacttcgggagaaggggtgcccgcgcgtacgtgaacggacttgctccgggagcggaggcgggccgcagtggagaggcccaagcgactgtttaccaaaaacacaggactctgcagaagccgcaaggcgacgtatagggtctgacgcctgcccggtgccggaaggtcacgcggaggagttagcgcatcgcgcgaagccccgaagccaagccccggtaaacggcggccgtaactataacggtcctaaggtagcgaaattccttgtcgggtaagttccgacctgcacgaaaggcgcaacgacttgggcgctgtctcgaccatggacccggtgaaattgcactggtcgtgaagatgcgacttacccgcggaaggacggaaagaccccgtgaaccttcactgcagcttggcattggccgctggtcccgcgccttcgaggccgagcgcaaaatggattctaaaaaacaccttgccaaataggagcgtcaggacgcaaagaggctccgcagcgcgaagcgcgatgcggagcctctttgcatgtccgaggacgttccggagagaaacccccgtcacgcccccggattcccggtgggagttctagaccttgtcggccttagtacataccgccgccctgctgaccagcggtggcagcagcgatagcgtcctcaagctgagtgttcttgggcacatcggagacggtggcctcggtgatgaggatcaggctggcgacagaagcagcgttctgcagggtgacgcggctgaccttgacggggtcgaggacgcccatctcaatcatgtcgccccactcgccgttggcagagttgagaccctggccggcgggcagctcggcaaccttgtcgaccacgacagcgccctcaaagccagcgttcttggcgatggtagcgaccggagcggtcagagccttcttgacgatatcgacgccgatcttctcctcggggtcgtcgatctcaacagcgtcgagcgcaggagcagcgtccatgaaggcgacgccgccgccagcgacaatgccctcctcgacagcagcgcgggtagcctgcagggcgtcctcgacgcgatgcttgatctccttgagctcagactcggtagcagcgccgaccttgatgacggcaacgccaccggagagcttggccaggcgctcctggagcttctcgcggtcgaagtcagaggtggtgttctccatctcgcccttgatctgagcgatacgggcgtcgatggcctccttggagccagcgccgccgacgacgacggtgttgtccttggagatggtgacggacttagcggtaccgagcatatcggcggtaatgtcagcgaccttcacgcccagctcgtccagggcagcctggccaccggtgaggacggcgatgtcctcgaggatgcgcttgcggcgatcgccgtagcccggggccttgacggcgcagacgttgagggcgccgcggatcttgttgaggaccagggtcggcagtgcctcgccgtcgatgtcctcagcgatgatgagcaggccacggccagcgcgctggacagcctcgagaacgggcataatgtcctgaacgctggagatcttctggtcggtgatgaggatgtacggatccttcatcacggcctccatgcggtcgttgtccgtgacgaagtaagcggagacatagcccttgtcgaactgcatgccctcgacggtgtcgatggtgatgtcgaacgtctgggaatcctcgacggtgatgacgccgtccttgcccacgacctccatggcctcggcgatcttctcgccgacctcggggtcaccggcggagatggtaccgacggaagcgatctgctccttggtctcgaccggcttggcctgcttcttcatctcggcgacggcggcgttgacggccttgtcgatgccgcgacgaatggccagcgggttggcgccagcggcgacgttgcgcaggccgtcgttgacgatggcctgagcgagcagggttgcggtggtggtgccgtcacccacggtgtcgttggtcttggtggcgacctccttcaccagctgggcgcccatgttctcgatgttgtcctcgagctcgatctccttggcgacggaaacgccgtcgttggtgatggtcggggcaccgaacgtgcgctgcagcgcaacgtagcgacccttggggcccatggtgacggtaacggcgtcggccagagtgttgacgcccttggcgagcttagcgcgggcatcggtgttgaacgtaatgttctttgccatggtgagtaatcctccaaaagaaatgtgactcgcgtcgccgcttccgagtcctatgcggcaggcgcgttcaaagacgaatcagagattccgacgagactaggcctcgacgacagcgtagatgtcgtcggcgcgcatcagcagatacttctcgccgtcgaccttgacctcgttgccaccgaacttaccgtagatgacaacgtcgccaaccttgacgtccatggggatgcgctcacccttgtcgttgaccttgccggcgcccacggcaacgatggtgccgcgctgcggcttctcctgagcgttgctggcgatatacagaccagaagcggtcttctgctcggcctcgtcgggcttgaccagaacacgatctgcaagcggcttcaaagacgacatgcttgtctcctcctttttgggccgcgtggttatgccacgcgaattaaccctttttgtttgcgtacgcgttgaatggtacccacgaatggcgggttatacaacacagagtcaaaaaatcttattttttggcacttagattttctgaatgccgggggataacttggcagtggctcccggggcggaccggagggcatgaagttttagcgctactgtaaaaacaaccaatttcgccatcgcactttagccgattccgccaacgcaatttccccgatcacgccaacgcattttcaccatttccaccaacgccggggcttacgcttcgaccgacaagcgaacgatgctttcgggaggagcggccgtggcggagaagaacctgatcggagagttggacatgtacagggaagcgggcataaagcccaacttcagcgacatagcgaagcgctacggcaaggacaggcacaccgtggcggcgtactggagggccgagggcggccggccccgcgacgggcgcgccgacagggcgggctccttcgacgcgcacatcgaggaggtggccgccaaggcgcagctgccgggggtcaccaagaagggcatccacgagtggctgctgcacaggtatcccggcgagaacctggccggctacaacgccttcacccagttcatgcgcaagaacggtatcgccgtcggggcctccgtcggcccggaaccgcacccgcgcttcgagacgccgcccgggctgcagctgcagttcgactggaaggagtcggtcaggatggcgaaccgcgacggcgagctgttcgagttcaacgtgttcgcggcgacgctgggccattcccgcaggcacatattcatccggtcggggaccaggacgaccgacgacctggtcagatgcatgtacgccacgatcgcgaggctcggcggcgtgccccgcgagtgggtcacggacaacatgtccgccctggtgacggtcaagggcggcaggcgcctcaaggtccagcgcgcatacgagttcgccaaggccgccggcttcgagctgaagctgtgccgcccgcgcagcccccagaccaagggcaaggtcgagtcgtcgaaccgcttcctgtcgcggctcgcggcctaccagggcgacttcgacggctgggacgacatcgacgagatcatcgcgcggatcgaggacgccagcaactccgagcccaacgagaccacggggctgccgccctccgcgctgttcatggaggagaaggacgcgctgctgcccgtcggcaacctccgcgccctcgaggaggcgatgggcgacgtggtgcgcgtggccagggtgccggccacgatgctggtcagcgcgcacggcgagcccatgtcggtgcccaggcgctgcatcggcaggcccgcccgcatcgtctgcatgcccggcggcgcgatggactgctacgtcggcggcgagctggtggcgacgcacgtggcgggcgggccggcctacgacccggcgcactacgccgaggccatggccgggaagcgctggttcggcgacgccgccggcgacatcgaggcggccgccgccgccaacctcgggctgctcgactcgatagggggctcgctgtgagcgccgcggtgcaggccagcccgctcaaccgcctggcggccaatctcgaggagctggggctcgagggcatggcgtcgtcggtgcccgagtacgtcaggctcgtcgccgacgggaggaagagcctggtcgacgccatgctcgagctcaccgacgcccagatagccctcaagcggcgcgccgacgacgagcgccgcacgaggatggccaacttcccctacataaagacgctggccgacttcgactggggtttccagccgagcgtgccccgcgggctggtcgagcagctggccacgctcgagttcgtcgaccgcggcgacaacgtcgtgctcgtcggcagcccgggcgtcggcaagacccacctgtcgatagccataggccacgaggcggtgatggcccgcaagcaggtgtacttcgccgactgctcgaggctggtcgaggacctcaagcacgcctcggcgaaggaggcgctggcgcgcaggatgcggttctacgagcactgcagcctgctgataatagacgagctgggctacctcgatatcgggaaagagggcgccgacctgctgttccagctggtgaacaggcgctacgcgctcaagcggtcgacgatcgtcacgaccaacgtgccggtcggcaggtggggcgacgtgttcggcagcaacgtcacggcctcggcggtcgccgacaggctgtgccaccactgcgcgatgatcaagataacgggccggtcgtaccgcctgaaggacgtgtccatcggcggtgaggacgggaaggaggagggcgcctaggcgccgaaagcggcacatccgcgttggcgaatccggtgtatccgcgttggcgcgattggcgaaaatgcgttggtggaaatggtgaaaattatattgacgctaacattcccggttccaccgggccgcgcggcaaggagatatattgccagaccggaggggcgccgggggcgggaatctgggcgtacacatttcctacacatctaagtactctcggctggctggttaaaaacaggaggggacctcgcatccgagatcccctctttcgcccatctatagcaatagactcttaaataccttatgccagcagcttgcgaccggactcctcgatcgcgtcaagtgctgcatctgcctcggcggcatccgcgcccttagcgaagatgtacagcttaatcttgggctcggtgccggaaggacgaacaatacccttgttgccaccctcaagatcgaactcaataacattagccttcggcaggccgttcacgcaggtgttgtaatcaacgacggcctcaatcttggaaccggcgagctccgcgggcgggttctcgcgcagaccggccatgatgccggccatctttgccgcaccctcagcacccggatagctcagcgaaatcgtcttgttgtgatagtagccatacttctcgtacagctcgtgcatcgcgtcggcaaggttctttccctggagcttgtaatactgcgccatctggcaaatcaaaagcgaagtgctcacggcgtccttgtcgcgcacgtggtcgccggccagatagccgtagctctcctcaaaaccgaagataaagcgatcgacctcgccagcatcggaaagagaagtaatgatgtcgccgatgtacttgaagcccgtcaggcaacgacggagctcaaaaccgtactcatcggccagagcgtcaaccatggcggaagaaacgatagtagtgacagcaaccttcttagtgaggtcctcaccgcgagcagcgcgggtcttgcagatatagtcgagcagcagaacgcccatctcattgccggtcagcagcagatagtcatcgctattcttaacggcaacgccaacgcgatcggcgtcaggatcggttgcaagcagcagatcagggtgaacctgctcgcacaggtcaatgcccttctgcatggcctggcgaatctcggggttaggatacgggcaggtcgggaaatcgccgttaggctccttctgctcgggaacaaccgtgacatcggtgatgccagcgcgctcgagcaccgtcgtgacgggaatgaggccggtgccgttgagcggagtgtagacgagcttaagcggagcgccagcgatctcctcggcagaaaggttggtcacgccgcgggcgagaacggcgtcataataacgctcgaggcacgagtcatcgatccatttgaccagaccctgctcaagagcctcatcgaagtccatggacttcacgccggtaaacgtatcggtctcggcgatagccttagaaattgcatcggcagcctcgctggtaatctggcagccgtcggggccataggccttatagccgttataaggcgctggattatgactagcggtcatgcaaatgccaccggagcacttaaggtcacggacggcccaggaaagcgtcggcacgggagaaatcttaggatacacgagagcagtcacgccgtttgcggcaagaatggcagccgtcgtcttaacgaacagttcacccttattgcggctatcgcgagcgatggcaaccgtcggatgctcgaaggtcgcattgagatagtcagcaaaaccctgcgtcgcgcgaccaaccgtatagatattcatacggttagtgcctgcaccgatagtgccacgtagaccggcggtaccgaaggcgagatcttggaagaaagcgtcggtgatggcgtcttcgtcaccctgctccttcatcgtgttgagctcagcgaggagctcctcgtccttgacattggcaatccaagtatcaagcagctcatgaacatctgccatgtgagtccttccgtcacaatcaataaaacaacccgtgtaaaacaggacaagcgcatcagcgcgctaaagcaaatattagtccattgagaacagagaaccggccacagaacggtgaacgtttatattcaccggtggatgattggattgatttaattgcttagtgaatgccgcctataacgcaaaaaggaggaggccgcgaggcctcccccttccaagttcaagcgtacggctcggtgccgtccaccggtcagcggcgccctggcctcccacgggctgacccttcccggttccaccgggccgcgcggcaaggagatatattgccagaccggaggggcgccgggggcgggaatctgggcgtacacatttcctacacatcttgtgatccgactaacgtttgccagccgttaactaccgctcgccgagcatctctttatataaggcagtctcatggttaaagcggatacgtccccctagctaaagcacagccagcatcgagcaactcatcacgttcttccaccgagaacccctcggcgtagacgcgcaccactggttcggtcccgctaggacggaccagcagccacgtgtcatcctcgaatgacagacgcaagccgtccatatgactaacgttttgcggcaccttgccacaaatcgacttggggtttacgcccggcagcagggttcgtaacgtttcggcatcttcggcctcaaggcgcaaatcgcgtcgaccgtaactcgtcttaccaaaactgtcctcgagttggtcgaccagaacgcccaaaggcgcgtccgtctttgccataagctcacacagaatcagacaggcgaggattccatcgcgctcgggcatatgcgcggcgatgccgataccaccggcttcttcgccgcccatgaggacgccgcccttcttcatctccgccgctatatatttgaaaccgactggtttgacggtcacgcggcagtcaagcgcctcggcaatgcgacgcacgagcgtcgagcatgaaagattgacgacgacgcgcccctccaaattacgaaattgaaccaagtcgcccaaaacgagcgccatgatctgatgcggatgtatatatctgccgcgctcgtcaaccgcgccgatacggtcggcgtcgccgtcggtcaccaggccagcgcaagctccgtcctcgataaccgtgcgctcgcaagcgtccacccacggttcaacggggtcggggcagatatcttcttggtcagacgcctgcccggcgtgaatctcgtgcacctcaacgccaagctcgcgcagcaagtcggctagatagccctgggctgcgccgcccatgggatcgacaaccacgcgcaagtgcgcggcgcggatggcttcggcatcgacaaacgatgccaccgcctgcatatagtcaggaatgatatccgcggtgcgatattgcccctcgatccccattggctcgggagccatagtctcttcgagctcttcgatgacatcctggttggcggtcgagccgtcacccatgcgaatcttgaggcacagatagccctgcggatgatgggaccccgtcaccatgagcgcgccgcacgcttcaccgtcataagccgccgcccacgtaagggcaggggtcgggacaggtcgcgaagcgagcacggcgtctagcccgtgcgctgctagcacgcccgccgcaagctcagcgaactcgcgcgccaggggccgggtgtcgaaccctatatataccgttttgcccggattggtcttttgccataactcgccgacggcatcggcgatacgggcaacgttatcggcagtgaagtcctcatcgacgcgagcgcgccaaccgtcagttccaaaatgaattatcgcgcacacgcgcagacacctcacagtgtttggatcatggtacgcatggggtatacccgcaacatgcactcggcaacctgccggcaccagcattcaccatttgggcaaatgctgccgaggacatgcaagcaatcagaaccacccttaaaaagggtggtttgctcttagggtataacccacgggcccagacgatatgagaaagccattggggtcgcctcccccgcgttgcagtttctttccgcgggctcggggtgccacaatgggctttgagtatcggcccgtgcggtagcccttaccgcacctgcggggaggaggcttcccatgccccatgttacctccatcggcctggacgtccacgcgcgatcggtcgccgccgcggcgttcaaccccttcaccggcgaggtggtgcaccgcgacttcggcaccgacgccgccgagatcgcggagtgggccctcgggttcgaggagcccagggcctgctacgagagcggtcccaccgggttccacatggcgcgcgagctgcgcgccctcggcctcgactgcgccgtggccgccgtctcgaaaatgcagaggccggcggcggacgcgcaccgcaagaacgaccggcgcgacgccgagttcatcgcccgcatgctcgccacccacaacatcgtcgaggtcccgctgccggacgcggccgtcgaggccgcccgcgacctcgaccgcgccctcgacgacgccaccgttgagtaccgccgcgccaggcagcgcctcaacatgttcctgattaggctgggatacgtctgggacgagcgcaacgccgacgggacgaggaagaaggcctggacgcgcgcccactggaggtggatatccgagatcaggctcgagggcccgcagcgcgacgcgctcgagtactacgtcacggccgcccgctgcgcggaatcggacaggcggcagctcgagaggagggtcgtcgcgctggccggcgccgaccggtggcgcccggccgtggaggcgctctcctgcatcaaggggatcgacaccctgacggccttcaggctcgcggcggaggccgggtccttcagcaggttccgctcggcaccggccttcgcgagctggtgcgggctcacgccgtcggagcactcgagcggcgagtccgagcggcgcggcgggataaccaaggccggcaacgcgctcgcgcgcacggcgctcatagagtccgcatggcactattccatgtgctccccgaggcccaaggcccccgcccccggcaccgacgtgcccacggcggtacgctcgagggcggacgactgcaccgccaggctccaccgccgccgcgaggcgctcgcgcgcgccggcaagccggcctgcaaggccaacgccgccgtggcgcgcgagctcgcctgctgggtctgggagatcgggtgcaggtccgaagggaccatcctctagcggccggcgacaaccgactcccgccgagagggcccgcgcctcgacgcatcgccggcgcgagttcacggcctcttttatgggcagcccccgggccgcgcccgacaaaagactggattcgcacgatcgcgccggacggagaatcgaaatgcggtggggtgcgcggacataccgggctgaccgccggcagcgcacccgaaagagcccgcggatattagcttgccaggcaagcgtcgactaaacgtgcagcgtgcgcgggccctcccgacgggaaacgaaaaagcccggatttaaaccgggctcaaacgaacatgcctattgacaatggctttctcatattagattaatggatggaaacggatgttctatcgggacacacattttgtcctataagccgagccttcgcaatgaaaatggtgccgccacttttaagcttgttgccgatattgagtacaacgatgaggtagggctcgtacaaaacaacgagcaccccgtcgtcaatatcatcttggatttaaacggtcacaagcttaagcacttgagtaatagcaattcattattcgatgttgccaacggcgcgacacttacaattaaggattctgtgtatacggaggaaaaggtcagtaacggccagcagctaaatgatcagggacagaaattaactcgcgccaattatggcaaggaagccaaactgtcttacgacaacgatggcattccgacttacctttcctactatgtgaccgaatcgtccccagaaggaacgggcacaaccgagtcgcttgtagagcatggtgttgatattaaaggtaaaggcgatattaaaggtaaaggcgccattgtggcttgcgacggttcaagaggactgaagctcatcaacatccatgacggcggtcatttcagtcttgagagcggcgtgctcacgcaaaagaaagacagcagtgtccgaaacctggtgtacgcggggagcggctcgaccgtcaatatgaagggcggttatgtttgcggaggttattgtccggacggtgctgccggcgcaggaatatctgtcgaaaattcgactcttagcatttctaacggcgtaattgccggcaaccgcgctcctagtggcggcggtgtatatgccaatgggtctgcagtcacggtgaccggcggcgtaatctccggtaatagcacgcttgatggcatgaacggatttggtggcggcatcatggccgaaggcggcagcgttactgtttccggcggttacattacgaacaattgctatgccaaattctgcggcacggatggcaacggtgaccatggcggcgctgggcttgctgccaagaacggtacccatgtcaccatttccggtggccagattactggcaattattctaaagaagccggtggcggcgtttacgttaccgatcaatggcgagacggttctcgcaaggatatggcatggctcaacattacgggaggaattattgcctctaacgtgagctaccgatctgaaggtgccggcatccgagtgggccagaaggttgacgcgatgattaacggccctaaagaaagtaacggcactaaagaaagtatagtctacatcacaaacaatcactgcatgtctcgcttcgactggggcggcggcggcatctttgttcagggcgattcaaacactgcatctaatgcgggtaggctatttgtctataactcctatataagcagtaatgaggccggtggctatggtggtggcgttgcggtttgcccgacgggtaagactttggtgacaaacaccgacggcacggcgatttttggcaatagagccgctgacgcgagcaagcaatagggggtgcggacagaaagttggaccgtgaagcggtccggactggaggttcgcatgcggtggcgcgcgcagacgtggtgtaagagtgtcctgaggtccgtcgctgcaagccccgatgttactccttcttgaggccgcgcttctcgactatctcgtccactatctccctggcgcgccgcccgagcgcgcggcgcctcccctctgtcggggccggcctgtccgcgggctcggcgaagccctcggcggccgaggcctcggagaacacgcgctgctgggaccactgcccctcggtctccatgaggctcgcgcacgtcagacgcagcatcgactccctcgaggggaaggactgcacgaccctgtagcggcgcttgatctcgcggttggcgcgctcctggacgttgttggtgcggagcttggcccagtgcgccctggggaaggccgtgaacgccagcgcggagtcctcggcctgctcgaagacctcgccggccctggcggacaccgacgccacccagggcgccgcctcggcccacacgcagcgcgcgaggtcggggtcgtcctggtagaccgcggcgtgcacgaggtccctgacggccgccttggagtcctcgggcctgcccgagcaggcgctctggaggttgcgctgcaggtgcgtcacgcagcgctgccaggcgcagccctggaacaggcgcgagacggcggccacgagcccggcgtggctgtcggagaccacgaggcgaacgccggccagcccgcgctcgcgcagcccgccgaggaatgccgcccaggagtcctcgctctcggtgtcgaccacgtcgcagcccaggaagtgcttgcgcccgtcggcgcccagcccgatcgcggtcacgacgccctgcgagacgaccgacgagccgaccctgcagctcatgtaggtggcgtcgagccacaggtagcagcacggcgtgcccgaaaggtcgcggcggcggaactccgccacctcggcgtcgaggtcggagcagaggctcgagacctccgagctcgacagcgaggatatgcccagcttggacgccacgcgctcgaccttgcgggtggacacgccgcacacgtacatctcctgcacgagggcggccaccgaggtgtcgacgcgcgaccatcgcgcgagcatgccctcggggtagtaggtgccgtgcctgagcttgggtatctcgagctccacgtcgcccacggcggtcttgagcgacctggggcggtagccgttgcggctgttctccctgccgtcgctgcgctcgttacggcccgcgccgcacatctgctgggcctcggagtccatcagcgcgttcatcacgccgcccagcaccctacacgcgaactcgcgcgcgtcgccgcactcctgccaaagcctcgccgcctcgagggcctcgtcgcggccgaggcgcagtacactctcttcttggggcatcgcctttccttccattcgtcaccttcattactccaacgacgaattctaggcggtgtcccctccctttcaagaaagggaagaggcgggtcatgccccgcctcttacaccacatctctgcgcgctacctggattggctacactgatgtggacagttccgggaggggcgcaggagacgggagggccgtatatgagggaccccaggcacccgaggcatttcaccgacgagttcaagaggcagatagtcgacctctacaacgccggcaagcccaagcgcgagatcatggacgagtacgacctcggcaagagcaccgtggagaggtggatcaagtcgataaacgcgaccggctcgccgcgcgccgcgtgcaaccgcacgcccgagcagaaccggatcctggagctcgagcgcgagaaccgcaggctccggatggaggtcgacgtcttaaaacaagcggcgctgatatacgctcgaaagtgagggccatagcggccaacgagggccgctaccccatatcagcgcagtgcaggctcctcggcgtcgcgaggtcgacgtactactccatgcgctcgcgggccgaccggcccgccgcgccggaccccgccgcgccggccgtggtcgcggcccacgccgccagcaagggccggtacggctcgcgcaagataaaggcgtcgctcgagaggtcgggcgtcaccgtcagccggcgccgggtctgccgcatcatgagggagaacggcctggtcagcgcatacggcaggaagaggttcaaggtgcaccccggggcggtcaacgaggccgacgtgcccaacgtcgtcgcgcgcggcttcggcggcagggcgccgcgcacccatatatgcagcgacctgacctacgtgcgcgtcggggcctcgtggaactacgtctgcctgctcgtcgacctctacaacagggagatcgtcggccactccgccgggcccaggaaggacgcccggctggtcaagtcggcgttcgcgacgctctccttccccatctcggacatcgaggtcttccacacggaccgcggcagcgagttcgacaacgccgagatcgacctgatgctcgaggccttcggcattgagaggtcgctgtcggccaagggctgcccctacgacaacgccgtcgacgagtcgaccaacaggatactgaaggccgagctcgtccaccgcgagacgttcggcacgacgcgcgagctccgggccaagctctcggactacgtgcactggtacaacaacttcaggatccactcgacgctgggctacatgtctccggtcgagttcagggaggcggggctgtccctcccggaatcgtccaaataggtgttgccaatccaacagacactatgacccaatccgagggcactaaaaagataggagcccccgctcgtgaccgcgggtcggggctgcgacaatgatgttgaagtgccataggcgcagccgcgccgcaacgaggttgggaggctcccatgccaaagtattctaccgcgttcgggatggacgtccacctgaggtcgaccaccgtctgcgccctcgacgcggacaccggcgaggccgtgacgaggaggttccccggcaacccctggggcgagatcgccgggtggatggatgggttccccgggccgtcgctcgcggcctacgagagcggctacctcggcttcgccccgcaaagggagctcgccgggctcggcgtcgagtgcgtcgtcgccgcggtctcgaagatccccaggtcggccgccgactcggcctccaagaacgacaggaacgacgccgccaggatggccaaggcgatactcgcccacgacatctcccccgtatgggtcccctcccccgaggtcgaaggcatcagggacctcgccggcgcctacgacggggcgaccgcgcgcctggcgaccgccaagcagcggctgctcgccttcctcgcaaagcgggggttcgtctacggcggcaccacgcccgccggcaacccgaggaagtactggacctacgacttcctgaggtggctcgacaaggtcaggccggaggacgatggcggggttcggacgctcgccgccctgaggaacgaggtcgaggccgcggcggaggcccgggcggacctgctctccgagtacagggccgccgtggatgccagcccgatcgccgcggaggtggccgccctccagtcgatcaagggctgcgccttcgcgctggccgcagccttctcggccgaggtcggcgacttcgcgaggttccgttccggaaggcaggtcacggcctatttcggcctcgcgccgagtcagaggtcgagtggcgactccgtgcggctcggaggcatcagcggtgcgggcaacgcgctcgtgaggaagctggccgttgagggttcatggtgctacgccgcggcacggcaccagccgaagctcatgccgagggacacgggcgtgcccctcgagataaggatgcacgggaggaaggggtccgagcggctcctgcggcggcgcgaggagatgctcgcccgcggc
